United States Patent 9,567,581 (SELECTIVE REACTIVATION OF GENES ON THE INACTIVE X CHROMOSOME) - sequence listing, part 30

SEQ ID NO: 3616 - DNA, 257659 bp, human
gaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctgaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaatcgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccgtacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaaggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtagtagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttagcattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaaagattacttaccaaacccttttttgactttagcataaagtaggatgagaattaaaacgaaattaggatatatatgtttcaaatattatatcaattgttgaaagtaatacttctgaatgtcattcatttgctttgccattattaaaaaactaggtacaatttatgttttcaaatatttcatgtttttaagattttttaacacgccgaataacttccttaagaaaaatcttaaaaaattatatgtaatacagcacatccgtttttactataaactgtcagtatgaaacctgaaacttcttcatcagcaaagatgatacatttaacaattttaaataaccctaactttagatatagcaaacatttttttttctgatccaatgtttcttctctttagtcaactgttggattgaatataaagtaatagataataagaaaaaatgaggaaaatttgctctgcttgtaagcttacaatattatagccaattcttattccctcccctttctccttttcctttaggttaatgcaatatattgttattctctgtattttcttttggtattttctgtttttcacataatattctgtaaaactattcataaaataccttaggtccttctttctttctttctttgtttttgtttgttttttgttttttgttttttgagacagagtcttgctctgttgcccatgctggagtgcaatgtcacgatctcggctcactgcaacctctgcctcccgggttcaagtgattctcctgcctcagcctcctgagcagctgggattacaggcacgcaccacaatgcccagctaattgttttgtatttttagtagagatggggtttcaccatgttggtcaggctggtctcgaattcctgacctcttgatccgcctgcctcagcctctcaaagtgctgggattacaggtgcgagccaccgcgcccggccagatctttctaactaatggcatatgtcagattttatatagggcatatttttaaaataacttgaacaactattttgcattacagtggccatattttgtgataattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaagaactgaggtagataattttttttctttacttctaattgggatagatgaattgggataaaagttgaattgatatggatagttgatattgaagtaattggaaagtgaaggctaatgaactttttggcaatctggcatgtttcaaaatggcttttatagaaatcttttcaagaagtcatatcttgatggtatagttattctttgtttcttgttcctccatgctctttatttttaactccttctagggagaacgtggatttccaggcagtcccggttttcctggtttacagggtcctccagtaagttataaaatttgggattatgatgaacacaggaattaacaaaagaagcagaaatgtagtgagagagcccaatgcattcatgtggaacaaagtaatacattttaaagtaataaactagaggaaaatgtttcaaaaagaagttggtaatatagctttctcctgggcaaaagcaaggattttgtatgtatataaatgtcacctctaagtatcctaaggtatatcctattcagaaatgacgctacagcagtctactcattttatactctatttagaaagcattctgtaattggcgtgtttctctctcatacatataaaataatcccttttctttttaataatagggaccccctgggatcccaggtatgaaggtaagcatctcattctggggaacaaatgttttgaataaaatattaggaaagctggcaacttcaataggataatgactcaaacttctgtcttaaaatcgatgtttctagaagttgtgcaggtgtaaacttacaagctctccttaagtagtctcctgtgttcccatggctttaagtaccttgtatgtgctgatacacttgaaaatgtgtatatcagacttgagtttctttgctgacactttaagtcttcatcttcttacactttgatacagttaaccacttactctctgtagaattacttttttccctggcctctgtgacactatcctttcctgatttttcttctacacctctggttaatttgcagtcttctatgtaaggtcattattttatgtccatcaagcatcaggtcacagtctgtactccttccctgcaatgcccagaaatattactaatgcccatattattgattactatctagttactaaataccaaatgagacttttcttctgagttagctatgtgtattcatcagcctctctgacatctccacatgttccaagttaatccacccacaaaataaacccgctcctccctgtggctcctcatatctcaaatttgcatctttatatgttatgtacacttttacacgatctcaaaacctgggagttaatatttatatcttccattccttcacccaccacctcattcaattccatcactaaacactaagtgtgcctgtaaaaggcaccttaaattcatccacttttcttcattcccactgttaccacgttaatcataatgtctcatctggattactgcaataacctcttacgtagtctctagtctctttttttcaccactactccgcccttacctcccatcctgttttattctttacaaagcaaccaagaatgacattttaaaagtgttcattgataatttaatatgcttataaaccttcaagggctttctactgtgtatctaaggtaaagtccatagtttgtttgtaagaactgcatgctctggtccttgcctacattgacagccttatcttaaaccactaaacttatcccttagctcactgaccacatcagtctgcatttagttattgggatgtgccaaacgttttgcttttagggtcttttgtatatatggtttactttgcctaatattcttcctcctatctttgcctggatgactccttattatccttcaggtcttaacctgaatgttaccttcacagattgcccttctttgactacccaagctaattttctccactagtttttttttttcaattattgtaccatgttatttttcttcatagcccttaatattcacagcccttgatattgtcatcttatatttttacatattagggtctgtattttcccattatattgttagctttatgagaacagaggccttgtttatcttctccattactgattacccagaacctaccacaattgttggcaaatacttaatatttactacatattttttaatgagtaactgaaggtactacactcttaataaatctactgttcttcagtgtactctggccacttcctcattttcctttaaaaggtaaacttatcatttttattactgagatggcctaatcttttagtacatctctgttacaaattgaatcttcagatcatttttctggttttgctggttttcatgtataataactgtgtcttagaacttccattgatggcttcttttagggtgaaccaggtagtataattatgtcatcactgccaggaccaaagggtaatccaggatatccaggtcctcctggaatacaagtaagtatccagtgattttctttttttgctatattgattaaaccagaagattacaacaatccctcaacctttagtactctctgtttttgtcataaaaattatcatcagatgtttactagacattacatgtactttctacctgaaaataaaagcaatctggaccagggagaattttaacaacatcggcttcattcttttgcctttctatccagtgttttggggattggcagcagaaatagggttctatattcttattcttgtactgtggagagcagtagggtcttttgtacatttacaaaagacctaattaaaaataaaaattatggaagtcccattgaatatattaagatatatcatttgtaacactatcagttatgcataatatatgaacatattttgaaggctgaaggaatacagtttatgcatggtgaacatcaaatgtaatcttaagaaaaaaattttagcctacagaaaacatgcatagagagagcagtaacttttgagtatagattaggaggtcaatttcttagggtttatatttcatgataatcgaatcctttgccaaaaatgaaaaatcaaaacttcctggtagtttatcactaagatacaagattggggacttttttcattagctaccttgtcattccttacttgatatcacccatccatagtttttaaaattcactcaatcttgccctttatattttataaattgttatgaagtaatatttgaaaatacaacagaatacatgcaaaatatatgtatgttatgaagcataactataaagtgaacaacatttaagagctagaaaattacaaataattttgaatcaacctgtgtcccccttggtaatcaaatccttctgcattcccccaagacatagctaccatctgtgccttaaaaatagctttattatatatgcatatatttctaagcaatagaatatttagctttgctttataaaataatgtaatatttatgtagttttctgcaacttactttttctacttgatatgctaagattcatccatattattggatatggctttagttcactctgtttcactttcatataactttccatttgtggacatactaccatttggtgttttttgttttatgtggtgtttgttgttgttgttgttgttttgagatagcatcttgcactcttgcccagaccggagtgcagtggcatgatcatggctcactgcagtcttaacctcctgggcttaagcaatcctcccacctcagcttcctgagtagctgggaccataggtgcacatcaccacacctggctactttttgaaaattttcgtggagacaagttctcaccatgttgccaaggctggtctcaaacatctgagctcaagtgatcctcctgcttaggcctccaaaagtatgaggattacaggtgtaagcctctgtgcccagcctacaattttttcattacaaaaaaaaatccatgatttatatctaagtatagaattgctagattgtaggccaaattttcagtttttaacatgccaaattattccataacacttgtatcattctcttataatttatcccagttcctctcatttccctctgtctttaatcttatctattttaaaattagagaagctatcttgaaagtagtagcctttcccttctcattggtagcataaaagccctaactaaatgcatacctttatcactttgttttgtaaattttccttattatttgtcttatgtttatttaccactttaaaccacaagttttcttataattacttaatccttttatccctttgcattttaaaatttcacttataatattgctgaatgataaaattgtagagcagaattccaatgacgactgaagtttaaatgaagtctaaatttcatccatttagttctttgtaagatacaattagggggccgggcacagtggctcacgcctgtaatcctggcactttgggaggccaagtcatgagatcaagaccagcctggccaacatggtgaaaccccgtctctactaaaaatacgataattagccggacctggtggcaggtgcctgtaatctcagctactcaggaggctgaggcaggagaattgcttgaacccaggaggcggaggtcgcagtgagttgagatcatgccattgcactccagcctgggcgacacaagtgagactttgtgtaaaaaaagaaaaaatacaataaggggcttgtttttcttttttttcatcattttctttactcactttataacagggcctacctggtcccactggtataccagggccaattggtcccccaggaccaccaggtttgatggtaagctctcttctttaatttaatttccccccctttcctttctgacttctttcaggaatattaatattatttataatacttgaaaacataatgcattctcaacattcataatttataattttcttatgtaaaggtgactttacaatgatatggtgaataatatgcattctaagtaatggctccattttatagatggaaaaatgaggtatataaaaggaaagatttacaatgaaatattttgttggttgctcttgatgtatcagtgttgaagtcaattctggccatttcagaaagtcttttaaggcagttttctaatcacttgatgaaacatgtttcttcaaactgcaattgtttgtttaagaagagcaaaagcagggcttcataaaaaatattggctctcatttcctaggcgcctgggacaaaacagtagaattggtgaggggagtgatcactatgcaattggtcacaggtttttgtaccccaaaaacttctacagatcctgaatgtgcaaccggttctcttactttactagctctgtagtcactcttattttctatcctagtaaattctaagtatttttacttctgcaatacttagatttcattcaagtcatgttttggacttacagctttgctgttgccctcttaaaagggcaagaaaattgtatttcagtagaagtaatttctcatgtgccactctatctctcatctaccatatatttaagtgacagttttcattatacctttataggttgtacatttttgtttgtgacaattggtcctgcacttttgagtgaaggaaataatgtttgataactgctagaagaatctaccagaaaagattgtgatttctgctttcctgtaactttttgggggaagatgagaaaacccttttgtttgttttagttgtagacttcatgcaaagcatgaaactatggactttcgcactttttcctaattctgctgttggaacattggtgccccttgagtatattgttacaccttgaatttcctcaaccattgtggccacttaaccgattcactttacgtttctggatattccttgaattaacgctaattcaacaggtgaagccaaatcttagaaatgccaccaagaggccaggtgctgtggctcatgcctgtaatcccggcactttgggaggctaaggtgggtggatcacctgaggttgggagtttgagatcagcctgaccaatatggagaaaccccatctctactaaaaatacaaaaaattagccaggcatgatggcacatgcctgtaatcccagctactcgggaggctgagacaggaaaatcgcttgaacccaggaggcggaggttgtggtgagccgagatcgttccattgcactccagcctgggcaacaagagggaaactccttctcaaaaaaaaaaaaaaaaaaaagaaagaaagaaagaaagaaatgccaccaagatacaatatataaataaataggcccattgaggttaagaggcaacatacttgagcagaaaggtgcctatttaattttttaaaccttgaaacattctcagatacacaaagtcatattgtataaaaatcaaactggattttaaaaaataaacacatgctttttagaacttgagagttaattagagttaattgctttatggtacctaagtttacctataattctgatgtgaaaaatttgatgggtctgttgagattaacttttgaattgatttttgacaatggggctacctctctacctctgcccatcccagcttttttctcttgcccatttctattttgtcatcagaggtactcacattcatctagctcattttaatcaattaaaatgtgtgtctctgactaaaatgaaaacaaacaagaaaatactattttgatgggctttttcacaccttactctttctgaaactaaataacttttaaaattaacttattaatataacattttattttctcttttgtcttctcttcttagggccctcctggtccaccaggacttccaggacctaaggtaattttctttttctttatatcttttatttggtgtggattccttttcttactgtcagtgagatttttaaatggaaacttctctctccaggggaatatgggcttaaatttccagggacccaaaggtgaaaaagtgagtaaagaaagagagctggttattcagccctcagctttctctttttgtagtcatttgaactgtctttttctttctcttgcttcttgaagttatcttatcttacatgttatattactgtctgtggagattatgaagtatcaccactgtcttattttatcttgcaaacagggtgagcaaggtcttcagggcccacctgggccacctgggcagatcagtgaacagaaaagaccaattgatgtagagtttcagaaaggagatcaggtgagtaagtagggaggaagtcaatgaaaatcttgctatggatatgttaattagtttgatggtggtaatcacatcacaatgtatatgtatatcaaaacatcacattgtttacaccttagatatatacagtttttaatttgtcagttatacctcaataaagctgaaaaaaataaaatgataaaaagttaaaaataatatttctatgtaagtggaattccattaaaatgcattataagctgaaatgtggttatatataagggtatttttttttaaataacaaggatttgagattattaattttttttttttttttgagactaagtcttgctcttgtcacccaggctggagtgcaatggcatgatcttggctcactgcaacctccgcctcccaggttcaagcgattctcctgcctcagcttcccaagtagctgggattacaggtgcccaccaccacaccctgctaattattgtatttttagtagagacggggtttcaccatgttggccagactggtctcgaactcctgacctcgtgatctgcccgcctcggcctcccaaagtgttgggatttcaggcataagccaccatgcctggccaagatcattaaattttcaaaataactttatcaagatacagtctacatacatataatccacccatttaaagtgtacaattcaattttttttttagtgcattcacagggtagtgaaactatcagtgcaatctaactttagaaaattctgaggcttcctcaaaaaaatctccatacctatgttagttgtactccttatttctccccaaattgaccagccctaggtaatcactaatctacttcttggctctgtaaatttttctattctgaatatttcatataaatggaatcatacaatatgtggtcttctgtgtctggcttcttttacttagcatagtgttttcatgttaaatcactttgcagcacatatcagtgcttcattcctttttatggctgaataatatttcattgtgtaaatagtctacattttgtttatccatttattcatcagttgatgggcatttgggttatttccatttttggctatttgaagaatccattcatgtataaaattaggttatggtaagtcagaatgatgacagtgttccctacatttcactgatatgcaaggagaaagataatgttactctataaacctttgttgtgtttagaaataattatctgataccctgcttttgctagagtagatgagggaaattagatatatttttaaagcatactggcccacactttaacaaacagaatgtgtgcatttttgtttcacttaaatgtgaataagaaagttaagaataaaggaaaagttgtattgaaactctatcatcaatatgaatttggccatttaattatctcccaaaatatatgtatgccgtgtgaccccaaaatctctttgttttaggtattcttgctttttataaaatattttataagaataaaaaattgtcattattttcattttaagtgttgccttgttatttacctcaaatcttggcttgtatatagacaaaaaattaactgaaatgagcaaagatagctctagttaattttgcctagaagatttcaactttaagttagaaacaccctattatctttggttgtactacatgagtattcagttcagtttaatttttttagggggagatttatttttattttattttattatttaaaaaagtcaacctttattttagatacagggggtacatgtacaggtttgtcacataggtatattgtgtgatgctgaggtttggggtacagatcccatcagccaggtagtgaacatagtactcagaagttagttttacaagtattacctgcctccctctactcttagtagtccccagtgtctattgttgccatctttatgtccttgtgtccccaatgtttagttctcagttataagtgagaacatgtggtatttgattttttgttcatgcattaattcacttaggattatagcctccagctctaaccatgttgctccaacatagatgtagctgtggttcagtttattaaaaatgctcctagctagctctagtgcttagaatgaaaatgcatgttccagtattaacattgatttcctttcccctactactgcatagggacttcctggtgaccgagggcctcctggacctccagggatacgtggtcctccagtaagtacctaaagtgctttagcatcatttaatgtaaattggtattggtacacagtatcccatgaaccattgtgaaactatttttatgtgtacagggtcccccaggtggtgagaaaggtgagaagggtgagcaaggagagccaggcaaaagagtaagtgatgtaactgctaatattctttgcaaaaaaattctaaatgtgtgtgtgtgtgattttattctttcttcctacatcttccattgtttcaaaatatcactactgacattataatgttgatgtctaaaaagtctacttaatatagtccaagccaggaataaagcttgttatattctttaactttatgcttcctaactaacaaatgtatgttgttgccctatcatttctttgtatcctatagggtaaaccaggcaaagatggagaaaatggccaaccaggaattcctgtaagtagctaaggttctttccccctgcaaaactggagacatttatgtgttggtataacataaggtggcagagaagcagtatgacaaaaattgtggggtctggaaatagtttaaatgaattgaaattatccagtctttgtcttttgaatataattttcaatttttaaaaaattttgtgagtacatagtaggtgtatatatttatttatgaggtacatgagatgttttgatacatgtatgtaatgtgaaataaggacatcacagagaatggggtattcatcccctcaagcatttatcctttgcattacaaacaatccagttacaccaaatataaatttgaggttcctctattttttaaagtcagatttattgagatataatttacataaagtaaaaggaactatttttagtttacagttctgtgtttgacaaacacatacagttgtgtcaccaccaccataatcaagaacacttccatcaccttcaaaagttccctcatgctcttttttagttatcccctccctattcccctatcccaacccccttataacgactgatcttttgtcaatctctttaattttgcctattcccaaatgtcagatacattggatcatattgtatgtagcctttcgaatcaggatcctttcacataacataatacattgaattgtgtatcagttcatttttttattgctgagtagtatttgatagtttgaatataccatggtttgtttgtccatttacacattgaaggatattttggttatttctgtgttttggccattatgaataaaacttttatattcatataaaaatatttatatgaatataaatattcccatacagtttttttgtgtgtgtgtgaacatgttttttcagtaaaagttttgacaggtaattcttctacttactaccaaaaaggggcatgggaaataaaatatgtaagtccaagaacattatttcaagcagcttcagtatcaagagtatccgcagtaggcaagagtttttcaaagacagagagaatatttgatgaaatttgtaagttattctaagggaaaaggataattcttaacaagacaggttagaattactaaattcagataaattggtttcaggatattttactaaacaggcaatcctcaacttacaatctctagttcaaaaatattttatattataaaatatcaagaggtaaattcagggcctcagttcctggcttcttttggaacaattggtctttgtcttgattcaggcagctgtgatattcaacaattgcctcttagtgttttcaacaaattggggttgcggggtggggaggctgttctcttgttctctgtttgcactgggagaacccaagttgggtcaaataaaggcagccttgcaaatagccttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagctttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggtaagaattttaatactttgaagtgactggtttagtctagctaaaataatccttttcttctcccaggcttgagttataaatggaaaaagtctacataactagcttttatattcaaaatatgccttctttattcatcttttgctcatttttcttttataccacacttgctaaattttattccattgccataaatcacagtccatgttgcagaaatacattaagcattgtttaactttagcatttccactgtgaaaagtcattgcctttactttgagcatgtatcggcaaaacttctttttttccacaaagagaattcagcactattttagtgaggtcctcttactaaaaaggcttataactgtgaatgtagaacgtcgccactaaacatttccattctgtatgcaattattgtctgtaagtctgtggctaattctttgttgttttttcccccctactgggccaatgcagtctgactgaggtcatttatttagttacctatttttcaagtgactttgaaagattgtatgaagcatacaattaccagatttttagcagggcacaaaataaccagtcctccaatccctcttgtttttaattgcttcgtatcaaaaactgaaagctttttggtttttcaggcaaggaaggaaaggcgttacaaacttgaatgtacccagaaggcacatattttaatggtggtttatttttaaattaggtccaagttctagcatggcttaaaaggcacaattagaatagatggaggtaggaaatactccgataaaatgattttttgtcaaatagtatttgtatatagatggatggcttctatgaacaagtttagagtcagaatagaagtatgaaaaagaccatccttgtgtcttggccagtagtagagtaacacttgaatattgaatattgtggtttttttcatgctgttgtagctactaatcaaggataaaagttttatctgaacttgtctttcattagcttctaagagcaagctcatgaaagcaattcagatttactagctattattgatgatagttaagtccatcacatctaaaatgtctgtcactaatagaaatggcactacatttatgtccttgactagttttatgagaagaaacatggctaaatgtaaaaaaaaaaaaaaaaaaaaaagtaattttttcactgattctagtgctaccattttttttctattatcttctttatagagtatttgtagttggctagaaataggaatcttaaaaatcaaagaatattacaactagaaataccttaaaactctggtccaaaaatctttattctttctatataaaccagagaagttaattaacttggtgaagattacatagctagtaaatctgagacaccatcacaggttaggcttagctcagaattgtttcattacttcatgttgcatttctcatttgaggtattttatgattgatttctgggtctttttggaaagtttctcttatattcttgaggaaattgatgttttcatgtgaattttactaacctattttacaattgcattgaacagggccaaaaaggtgacactggcccacctggacctcctggacttgtaagttttttttttttagtcttcgtttatcaaatttattaatgcattatcatttttgtgccttaatcgcatactccctactttttcttgatagaacacaaaatttcaagtcattatcaatttctactggcttaaaagtctttacatctaaaatcttcagtaatgttgacctcaaggtctttgtattgttctgcctatgcattacttctgcatggtaaaggtctaaaattatggcattgggttgttttgcctcatgattgccagatcatttctcaagcaaccagcaggtggtgcaagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaaataaatgtgggttaataaagagaaagattggggaaaggcattacacatgtttggaatgaaatatgcaaagacatagacaagaacgtgcaagttgaatgaaatggttagaatcagacagacttcactataataaaaatttattgtaagacgtagtaggagattaaataggtgagagaagtattggaagtgagaggtgacttacagttcaggattaaaagtagcagcacttatagtaaaaagtagtgagcaattttgagtccttaagcagaatagttaacacacacacacaaatggtttttgaggaagcatatcctaacaatagattggaattcaagggacaagatcagaggtgcttctattactctaagtgtgagttgataatatagctgtggcagcagaaatcaagggagcaaattggagagacgttttctgtaaagaattgtcaggcttaggagattggaatgaattgaatgtgaattataggagaagagacatcaaaaatacttttagttttatatgcttcgggctcaggaacatggtaatgttgttacttgtattggacattttctaatcagttggaggatgggagtgatacaaaatgtgactcataaactatgtgaaaatgatgacattgtaatcatatgtagctcccataatgttttcaggagaacaaggcttttcttctttgcatttctttattttttttttctttggtaataaaggtaattcctagacctgggactggtataactataggagaaaaaggaaacattgggttgcctgggttgcctggagaaaaaggagagcgaggatttcctggaatacagggtccacctggccttcctggacctccaggtaaatgagattgcatttatggccttgttcttatagcatccttactaatccatgtatactttttatcacattagttccatggtcagcatggaagtaggagacacaagtcctttttaattgacagatacttcccaactcttactataccttctctcaccatattactcacttgtactttaaaaaagcccaagtgaatagtgtcctttaatcctaagattcctatttctacattttattttttattgatacataattgtacatatttatgggatacatgtgatattttaatacatgagtccaatgtataatgattaaatcaaggtaactagaatatccattacctcaagtatttatcttttctttatgttgggaacattcaaaatcttctcttctagctgttttgaaatatacagtaagttgttgttaactgctgtgaatctactgtgctaccaaacactgaaacttattgcttctatctaactgtatgtttgtacccattaaccaacctttcttcatttcccccgacccttcccagcccctggtaaccatcattctactctccacctccatgagatcaactttttttttttaacctcctacgtaagaatgagaacatgcatttgtatttgcctttctgtgcctggtttatttcacttaacgtaatgtccttcaggctcatccatgttgctgcaaatgatagaactccgttcttttatggccaaataatattccattgtgtatttataccacatttcctttatctgttcatccactgatgaacattcaggttgatttcatatcttggctattgtgaatattgctacaataaacatggaagtgcagatatctctttgaattactaatttattttcttttgaatatatacccagacgtgagattgttggaacatatggtagttctatttttagttttttgaagaacctccatactttttttcataatggttgcattaatttacattcccaccaacagtgtgtgagagttccctcttctctgcatccttgcagcatctgttattttttgtctttttgatgatagccatattaactggggtatattttattattaataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaatttgaaaggactaaacactgattaaaagacagtgactaaaataaaattgaaattaaaaatacctatatatagtgcacagtagacatatctaaagcaaagtgacagatacaatctgaaaataatgcagtatatattgggcaaatgctatacataaaaaagctggtttagcaattctaatatagtatgaaatataattaaattcaaaacttgaaactataaaaattctagaagaaaatgcaggaaaaacttttctggacattgacctaggtaaagatttatgactaagacttcaaaagtaaatgtaaccaaaacaacaatagacaattgggacttaattaaactaaagagcttctgcacagcaaaagaaacaatcagtggagtaaatagcctacagaatgggtgaaaataattgtaaactgtgcatctggcaaaggactaatatccagaatctattaatataaggaacttagacaaatcaataagagaaaaaaataaccccattaaaaactgggcaaaagacatgaacagaacacttcttaaaataagacatatatgtggccaacaaacatgaaaaaatgcttaacatcactaatcagcaaataaatgcaaagtaaaaccacaatgagatactaacacattagaatggctattattaaaaagtcataaaataacagatttgggcaagaaataatttcagttattcagagaccatctgattatctaccagaaagctttaaaaaatccattgacaaattcccagaacttaaagagaatatgtgtgcaagatggccagatctgagtagcatacttaatttgccttcctcttcaccagcaaacgtacaagagaaaaaaatacacttcacaatagtaatagtattaaaattcacagtagaataaccccaacaatacatgtgtaagacttctttgcagaattttgtaaattattattaaataatataaaattactaaatagagaaataaatttaattattacttgatgtgaaaaaccaatataataaacagttgattctaccaaaaaataatctttaacttcaaattaatcccattcagaatcccaaccagtttttgaaaatgaaactgaaaaatttatttagaaaagtaaatttgtagatggttttaaaaatgaacaaagatgagcgtattttccttagcagttttgaaaacattataaagtcatagtaactaaaaagtgtgttaatggtgcatgaatcaccagtgtaacagaagaatgtccggaaacagagccatgtttatatggtaactttgaaatacctttttatcttgctaatgactttccggtatttttgagattataagaacagattgtcaaaggatggggttactagtaatttccaaaagtagtaaacctactttaaattattatttcctaccctcaaactgttacttacattctttgaaacttttcaacctttttttcagacttttgagtctcatagaaaaaaaataacataaccagaattatatgttaaaggaagatcttatcattatctaatgtctcaatgagaactaaagtaacatctctaagatgaaatcattttgatcacttttttgaatcttaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtaagctatatttttctcctattaagttctatttttgtttttgtttattttgtttataagtaactctagctaaaggttggcctcatttgttgcgtttctgatatctaagaaattctaccactgcttctgctttttgggttttggtagttcttggatgtttacatttgctcttcatatagtatttatcagcaatgttatattttccttttgcttataggtacttttatttcttcagagaataggtctttttctggcttgtcaggctttcttttgtttaatcttctggatatttcacaattagcttgctatcctttctttatcttactcaggtgatgagatatgtgaaccaggccctccaggccccccaggatctccaggtgataaaggactccaaggagaacaaggagtgaaaggtttgatctccaaacatattcattccttcattttcttcattctttcaaatcatcagcaaaatcccctgtatcctccatcacaccttagccactgactcccatggtcataccccaagaccatctcattaccaatagtgttatacttacatgaccttggtttcatgcatcccattttttggatcgctctcttctttctagcttactacctctagtaacctgactccagcaatactccaaccccactgagacctagcaactttgactaatgcttaactttttgatgtcctttcttccctcttaaccttgcttaagttccattatcaatcactgtaatcaattccattcataaatccatgattcctttgcccttctctcacttcattgcactcacttggaacaaaagcataatccaaattttcatgttttctgagcctacactttctcttctcttttcaagttttaacagttcctcccctattcttaccttgcttcctacttcactgaccaattaaagcaataacaagagaactttcactgattgctaccaccatatttacttacctacttgcacctgtgcccatatagtctcccttcttgcatattactgttactgctcctatctaaagccagttcttctatttatacaatagattccatttcctcttatttccccaaggattttttttccagcaatttttgcctctccgacatcaccaatttttccctctctattcagtcattccaaggagcatacaaatatgcttttttcacctatctaaaaaaatgtaatcctacattccctgccagctgtttctctatttttctattctcatttgcaacaaaacttcctaagaattttctcctcattacctctagatactctcctcttgttttctcttaaacatactccaatcaagatttcatcccctcttcccccaactccccactgcctaccactccacaaatgctggtcagtcaccagcagtctatatcctactaatccaaatgtcaggtctgtcctttttttgcttgctttttgccttctttaaacatttgcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattcttgtacgtgtattttttttgtaggacataaacactaatttttattggggatatatctggaaattgaattgctgggttataggttaggtgtaggttttgtttcatagatattaccaaaccatgttccaaagtgattttcatttgcgtttgcctaatgacttgattatgaactatttccttacagtttttatattctcttttgtaaagtgcctgtctttatctttaatttgattattggatatatgtattaaaactatcttctgttttgttaacttttgtttaacaaaagttgctaattaaatgaaatcaaattaattaatttcctattttatcgttagtactttttatgcactgttttagaaatctttacttatctcagaggcctgatgatattcctctgtgttttcttctagacactttattgttttacctttcacgttttgatctttcttcaattaatttttgtgtatagtttggagtagggatcaaagttcatttttcccatatggatgtccagttgactcagtactatagaacaaaagatcatcaattaccccaatgaattgcattagcactttttgtagatcacatgaccatatgtgtgtaggtctgtttctgactgctctattctgttctgttgtttcattagtctctctttgcaccaatacgatactatcttaattactgtggctttattgtaagtgttggatattctaggttctttgcattattttgtgtgcatcttagaattatctatccaacttttaagtttaaaatgctccaaggttgagtccttgttcttcttttctatataaactcatttattcagtcttgtgactgttaataccacctaattgcccatgacttccaaatttatgcctcctatccagatataactcttttcctctagatttgtgtatccatttgcctagtcaacattttgaacttgacatcctgatcaaattgaagtcttgatttctgccacctcctccccatagttgctgcactcacatcttcagcttcttacttaaaaagcaggccactttagccttctagttgctcatgctgaaaaccttggagtcatccttgattcccctcttcttttgtatttcatatatgatccatgagaacatctcattggctctactttcagatatgtctataatctaaccggttctgatcattttcattgcagtcactttgaaatgagctaccaccatctctctcctagatcattgcaacagtagccacttaagtggttaccctgtttccatcattgcctttagaggctattaacatagcagctagagtcatcccttaaaaacttaagttataacatgttgcttttctttttaaaattttctactagattctcatttcactcacagtaaaaaccacagcctttatatttcttatatgcctatatgccattcgttataaactgtcaactttctgaccttgttcccctccctcattctgctctagcaatctggtctgcttgctgttccttgtatataccaaacatggctattctttctgcttgggatgttctacactcttatgcacatgtcatgtcctttaagttttatcatataacaacttctcaatcaagtctatcctgactaccctatttaaaattgcaaccccccacccttccctggcatactcaataccacttatgtagttctattttttcctataaaaataatatattttaaagcatattaaatatttaatgtatatttaatttttttagacagggtcttgctctgttgcccaatctggagtgcagtggtgcaatcacagctcactgcagcctcaatctcctaaggctcaagcaatcctcccactttagcctcctgggtagctggcaagtacaggcatgcaccaccatgcctggctaatgtttttattttttctgtagagatggggtttcgccatgttggccaggctggtcttgaactcctcatctcaagctatctgcctgcctcgggctcccaaagtgctgggattacaggcatgagctactgcagtctgcctatacttaatattctattaaaatatttcatatatacattttgataattcatttcctttattgattattatccctttcccctggtagagtgtgaggcatgtagacatgaatttttatccatgacttttcttttgctcaccaatgtaacacaagcatctggaacagttcttggcacacagtaagcactcagtaatttatttgtcataaattgattcaggatataggcttctccaatcacaccattaagtggaaatgctgtcccttagtgctaacatttttagaacctatctatagaaggtatatgtacccctttcagtaaaatttgtttgttattatgatttcactaggtgacaaaggtgacacttgcttcaactgcattggaactggtatttcagggcctccaggtcaacctggtttgccaggtctcccaggtcctccaggtaaattatgcctcagggtaaccttctaaatattttttggctagattttgttgagcttatacttttagaatgttaccagtttctcattttataactagtcactcatatctataaagaattaagtatgaaatgcctccatttgttatcaaattaattatgctcttgtttctaatacctgaagctaccaatatattctattaaagcattttgacaatataatttcaggaaatatatcttccccattttccatatggagaagaaaatcacttatacagagtcagacttctttcttccagaatactgggagaaaagttcataatgcctagcccctgagtgtagtttccagtggcagagattccagtcactggggatgtatcacatgttgttgttcaggaataggggttctattggagtttggcaatcaactgccagtattcctctctctctatatataacacatctatccccctttccagtcaaaactatatgtgatatctgtcagaccctcaactgtttcatttaactgccccttaggtatcccagtattctcttgaaattacactttatgtttgagtcagggctgagaatagacaccagatctcttacctttctgtctagtgagtctactaaggacaccaattcatttggaggttgggaatactttcaacaaatcttgtagacattattggacattaataatctagccttgtacctctagtctcatggttctcaaacttgagagtgcatcacctggagggcttattgaagcccagaatgctgagcctcactctcaaagtttctgattcagtagacctggatgaaggctcaagaattagcatttctaattagtagccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctcttggtttccctggacagaaaggggaaaaaggacaagctggtgcaactggtcccaaaggattaccagtaagttttgagtatattataaaacaaaaagaagtagaaggaaggcattttacacattgattttcaattattcatatatatacacacatatacaatttaatttttccattaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtaagtttactgtgttttgttttaaacttggtgcttaaaaacagaaatttattatgttttggctactcatggcttcctttcccgagaggtgtgtttccctggccgtttatatttgaactcttcagagcatcttagcaagggatcacaatggtttttataagggggtttctttttaaatcttttctaactgtttcattgttactgttaattttgctctttttaagtacatgatacataatgcaaagtttaataaatagttataacagaagcacacaggtagctaccacacacatcaaaaaatagaatgttaccagcatcctagaaacccctaaccttttctccctgtcatttcctaatcacaatccccttcctcctgtctgctgtcttgacttttacatagttttcttccattacccctctgttttatgacctctgtatgcatttttaaacagagtattttaattttgtttctttttgaacttcatgttaaaggaatcatagggtaagtgttttttatattaacttttcgtgtggctatagtgtattcatttttattgctatatagtatttcattgtatgtatgtttatgtgtgtgtgtgtgtgtgtgttacagttgattgatccattctatggttaatggttaattgggttatttacagttcaggtctattatgaataatgcttctgtttacagtcatatagatagatagctaggtagatagatagatccctatatctccttgtgttcatgtgctcacacttctctagggcaagagttggcacactacagaactacagtccatggaccacatccagcctaccacctgttataaataaaagttttatgtgaacacttccacaaccattcacttttgtctgtggttgtttttgcactacaactgaagagttgagtagttgctacagagactggatggtccacaaagcctaaagtatttactctggtcctttacacaaaaggcttaccaatacctgggctagggtatgtatttaagattagcattttcaaagcataggataagtgcatcttccacttgactggataattacaaactctatccagaccaattgtaccaatttttactaccacaagcagtgttgaatattttatgttgatttacatccttggaaacaatttgtattgtcggacttttacacttttgccaatctgttgagtgtgatattttgcatttctctgattaaagtttagcaccttttcatgtgtttattggtcatttgaatttgcttttgtgaaatgcctaatcaagtactttgaccaattttatattggattatttctttttttattgatttagaggagttctttatatattctgtgcattagttcttagttacctatgtattttgcgaaaagaaatctttacctactgtggcttgccatttttactctttgtttggtgtcttcaatgagcagaaaacaactttcacatcatcaaaattatcaatcttttctctcatggttagtgctttttgtgtcatgtttaggaaatcttttttttcttgagccaatttcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggctgagaaatcccacagtaggccacctgtaagttgaagaactagggaagccagtagcttggctcagtcctagtctgaatgcctgagaacctgagtggctgcttagtacaagtcccagagtctgaaagccagagaacctggagttgtgatgtccaagggtaggagaggatgggtgtaccagtttcaaaagagagagagcagagaattcacctttttttctgcctttttgttgtatccggtccctcagctgattggatggtacccacacacattgggtgagggtggatcatccttattcgtttcactgattcaaatgtcagtttctttcggaaacagcctcacagacatatctagaaataatgctttaccagcgatctcagtatctcttaatctagtcatgttgaaacctaaaattaaccattatacatcttgaatcatggaagtccttaaggctgtcatatcctttttctttttgaaattctatccttctgttttatatatttcttgaatatatagtggaagattgtttttcttgtgaatttttgttagtttacattttcaaaagattgctgataattttcttttttgtttttaattaaaaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagatgtgtagccaagtaatgttttatgctaaataatattttcttgatttattgaaatttttagggcttatgcttcagttctgctttattcctcacagaatttattctcacaaatggcaagagcacacagtggtctgaggacagttcttaaatatatctttactcatttatacaaaatgctttcaaaagtatcaggtttgattttatgtgtgtatgtatctataatatctgcagttatttttagatcatttccaaaattatatggtaggccctttgtcatactacatccagatataagcagaagaaaagttcttgggcatttttgtgtgggattcattccttacaatttagttctatcttattatataatagccctcattttcttcagaaaagcatatgttccacatacattagctctatgtgaaaataaaaggaatgtaagatgattgagaggattgtaaggcttaatcctaagtagtagaatgtcattgtgcttttgacatcttactgttgtcactaagcatgagtagaatgtgggtttgggaatttgaatatctttcttaaagtgcctttcctttggtggttaaaaaatgacttatcattttacaggctttcctggaattccaggacctccaggagcacctgggacacctggaagaattggtctagaaggccctcctgggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaaaaaaaaaacctaatttctgtacctacttttgaatgcccagttctttgattagagaatacaggcataccttggagatattgcaggtttagttccagaccaccacaataaagtgaatatcaaaataaagtgaatcacacaactttttttgtttcccactacatataaaggttatgtttacactatactgtagtctttaaagtgtgcgatagcattaggtctaaaaaaaaccatatgcataccttaattaaaaatactttattgctaaaaaattttagcaatcatctaagcttgcagcaagttataatctttatgctgggggagggttttgactcaatattgatggctgcccactgatcagggtgatggttgctgaaggttgggtggctgtggccatttttttaaataagacaacaatgaagtttgccacatcaattgactcttcctttcagaaaagatttctctgcagcatgtggtgctgtttgatggtattttacccacagtagaacctctttcaaaattggagtgagtcttctcagaccctgctgctgctttatcaactaagtttatataatattctaagtcctttagtgtcatttcaacactgttcccagcatcttcaccagggtagattccatctctagaaatcacttttgctcataagaagcaactgctcatctgttctacttttattataagattgcagcaattcattcacatcttcattctctacttataattgttgttctcttgctacttccaccatatttgcagttacttactccattgaagtcttgaaaccctcaaagtcatctgtgagagttagaattaacttcttccaaactcctgttaatattgatgttttgacctcttctaatgaatcctgaattttcttcatgacatctagaatgaaacccttttcagaaggtttccaatttgttttgccagatccataagaagaatcactatttatgacagctatacattacacaatgtgtttcttaaataataagacttgaaaattaaaagcactctttgatccatgggctgcagaatgggtattgtgttagcagccatgaaaagaacattcatctctttgtacatcaccatcagagctcttgggtgactaggtgcattgtaaatgagcagtaaaattttgaaaggaatcttttcttctgaggagtaggtctcaacagtgggcttaaaatagccagtacactatgctttaaatacatctgctgtcatccaggctttattgttccacttatagagcacaggcagagtagatataccataattcgtaaggccctagaatttttagaatggtacataagcattggtttcaacttaaagtcagcagctgcattagtccctaaaaatagagtcagcctgccttttgaagctttgaaaccagtaatttacttatcttctctagctatgaaagtcctatgagcattttattccaatagaaggctgtttcatcaacatggaaaatctgttgtttagtgtagtcactttcatcaatgatcttagctagaacttgctgcagcttctatatcaaaacttgctgcttcaccttgcacttttatgatgtggagacagcttcttcccttaaacctcacgaaccagcttctgctagcttccaacttttcttctgcagcttcttcacctctcagtcttcagataattgaagttagggccttgctctggattaggtttttgcttaagggaatgttatggctggtttgatcttctgtccagatcactcaaactttctccatatcagcaatagggctgttttactttcttctcattcgtgtgttcactggagtagcacttttaatttccttaaataacttttccttcacattcacaacttggctaactgtttagtgcaagagacctagccttcaacctaccttagcttttgacatgccttcctcactaagtttaattatttccagcttttgattttaagtgagagacatgtgactctttctttcacttgaacacttagaggccattgttgtgttattaattggcctaatttcaatattgttatgtctcaaggaatagaaagacctgtggagagggagagagatgcggggaaaatggctgatcagtggagcagtcagacatttacaacatttttttattaagttcaccatcttatacaggcacagtttatggtaccccaaaacaattatgtggtaacatcagtgatcacatatcaccataacagatataataataattaaaaagtttggaatattgtgacaattaccaaaatgtgacacagagacaaaaagtgagcacatgctataggaaaaattgcgctgatagacctgctcaatgtagggttgccacataccttcaatttgtaaaaagtgcagtgtctgcacagcacaacaaaatgatgcacaataaaataaggtatgcctgtacgatggtctgctccctctgtgcatctctatagagtcatcatcccatgtcatctctgttcatgcctgtgtgatgattggttgaaatggtgttgaatatcatttccagaccttgtatactgttgttctctgtcccaattccattacagatacataatgcaaatcactgcaattgacttagtaatactaataataaataatactgtgtttgagttacttttcattccttttattatttcttatctaatgttaagctttcctgagtcaaccttcagcaaagagctgctgtggcatgtaattatcgtgactatttttatatattttatctctgcgtcattgatttaaacctcctgtgttttgtaattattacttatttttcatgggaaaaacagttaacccgtgacaccagttctcatgagaaaaccacttctctattggttgattctctttattatgaacattttcaaatgaaaataaaagtaaaatgaataatacaatgagctttcacatatccatcacccagattcaaaattattatgattttataacatttgcttcatctagtcctttttactttgcttaaatattttacccaaatctcaacacagtatcatttcacttataaatgcatcagcactcatctctaaataaattgacattttatacaaaaaccacaatgttgttatcatacttagtaaaattaaaaataattgtttagtattatctaatactcagcctataatcatatttccctacaagggtagtctgttctttaatctcatgctctctcagttttttttttttatcctgaaaccagtccaaatcatctaatttgttttactaaaccctgtttccaatccttccatatgttttctccaacataccaattactttttatttaattatcttctcctctccccccatggaaggaaaagtattgtcttgtattttcggcattaaattctctgtggcaaacaataaggacagaaaagtcatgggagtttttgttgtgttttgtcatgtgtatgctcaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtatggaggctgtcactgcatctcaacttgcttttaacttttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattttattatgtgactgtatcatggatacctgggttgtgtcaagtttttggctactatgagtgaagctgttaaagacattttttacaattcttttttatggatatgtgatttcattttgcttcagtaaacaactaagagcagatttgttggatcataagtggatgcttagttgtactagaaactactagacctttttccaaaatggtgataccattttaaatttacaccaaagtggttcagaaatttgcattgttccacattttctcaaagtttggaatgttggtaggtgtgtggtagcatcatattgtgattttaatttacgtttccctgatgactaatgatgttgagttcttttttatgtacttgtgagctacttacatattcaaatattttgtctattttgaaagatggtttgtttctcactttattattaagttggaagtgttatttctatgtcctgcatactggccctttcctagatatatgtttattagcattttagccctggctggctgacctgttcatttccttactgtattttgatggataaaagttttaattttattgaagtttcatttatcaattttttcttatatgattataattttctgtgtcttgtctaagaaacatttgcctgccccaaagttgccaaggtattctatgttttattttataagctttatagttttagtttctatgtttaaaactattacacatgtcaaataatttttgttcagcatcatttgtttaaaataatcccctctctattggattactttgggatctgtgtcagatcaaataataatatatgtgttgatctacttctgtgctgtcaatcctgttttatttatttattttgctgtcattaagccagtaccacactgtttatattactgtagctttatagtaagactcgaagtcaggtaatgtaacccaccaactttattcttaaaaaaaaaaaaaacacatttctttggctatattaggtcctttgcctttactctcagagtggtttaaattgtatgtctcttactgtgagtgagattggccatccttttatgtgttaagggccatatttttttttcttgttaactgccaatatcctttacccacttctctgttgtttcttctactcccttgattttgagttatctaataatgagaaggaatagaattagtaaagctgacttgcattttttttcctttgatttggaaggaacccgacttccctcgtcaatgttttggctcctagtgagtaatctgaacagggccatgcttctggaacatgttggattgatttctattaaagcagtaagacagcccaatccaattttaaccaggctagattgtattctgccagcaaaagccccagactagctcaatacaaactcttcttagataagctcttaaaaaaatacctttctgtttttgactaaacaattcaggccagctgtaaactgtaacactcaaagttacaagttgtgtttcccaccagttatctcccctagctgtagacctgtagcaacaaaaattgcagataaagatatttgaaatatgtggcaaacagtcttcctgtggaagttacccacttactgtattttgtttgtatatattcttgagacacagtggtagtgaagaaatgcattgaaggctatttaaacatgaatttaacaggtatttgcctaatctttggaaggaaattaggatatggcattcccatatcctcacaggagtaattctcaattattaaaagccgagtacagttctttaggtgctagaaaaataagtgtttgggatattctgccatgtaactccttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaaagagaaaaaaagatgattttggaagcattcagtttacctcatatattacttttgttcagggccttatctaaggtacctggagaggttttatatagatggtgacagttgaatttagacttaagggaaaggtgttccgggcagcaagaataacatccaaaggtattattgtgacaaatattgtgtgcttggaaatgttgaaagaaatacaaaagtatataatttatgctaacaacaaatctatatcaaacaaatatgacaaacaactgcatgcccatacatttgacaacttagattaaatggactaatttcttgaaagacataaattgttgaagctcactaaagaagaaataggcaatccaggaatctatttttttaaaaattgagttgtagttagaaacccaccaacaaagaaaactacaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcacaaaatttaactcccaatggatcacagacctaaatgtaaaacctaacattatcaaacttctggaacagaagcaggcaaactttttctgcaaagagctagagagtaaatattttagtctttatgggctacatatatggtctctgtcacatattcttttttaaacaaccctctaaaaatgtaaaaaccattcttagcatgtaggcagcacaaaaagaggcctataggccatatttagccatgggaagtactttgtcatcccttgttttagatgaagaagcataagagaaaactctgtgatcagatgttaggcaaaaacttgttagaataccaaaaagacaattcataaaagaaaaattggatatattggactttattaaaattaactgtattttcatatcatatatctgacaaaggacttataagcagaatatataatgaactctcaaaactcaataagaaaacaaacaaccaacttttaaaatatagttggaaaaatgagcaaacaatttgagtagataccttaccaaagaagacacccaaatgtctaataagcacatgtaaagatgctcagtataatttatcatctgggaaatgcaagttaaaaccacaatgggataccacttcataaatattagaattggccttttttcaaaaaggataactgacaataagtgctgctaaggatgcagagtaactcgaactctcatacattgctagttaatacacagaatggtgcagccactttgaaaaacagtttgacaatttcttatatagttaaacattgtctttgcacatgacacagcaattctactcccaagaaaaatgtgaagcttcacatagaaacccgtagaacagtgttcatagcagcttaattcataatcaccaataattgtaaacaccccaaatgtgcctcaaattgcaaaaagattaacaaaatgtacatattcatctgatagactaataaccagcagtaaaaagtaactactgatacacataacaacatgggtgaatctcaaatgcattgtattaagtgaaagaagacatattcaaaaggctacatactatatgattgcatttgtatgacattctgggaaagaaaaatctgtaagacataaaataaatcagtggttgccaggtaattgggatgtggggacgagttgactacagcgcacaggggcttttttgggtttatgaaaatgttctatgtcttgattttagtggtggttatatgactacatacctttgtcaaaactcatcaaagtgtacactaaaaagacagaattttagtacatgtaaaaattgtttaaagtgggagtgacagagggacagacagaagatggagagatggacagttaagtttctaatgtcaaagagatgttttactaatgaagggagaagcttgaacatgtttataagccatggccctgagttagtaaaaaggaaaatgttgaagttatctatcttaaaatataggtaacttgaaaatatattttaaacttatgaatatataactgtccacaatgagttacaagtagaaggaatatgtggtttgtaatcttttgtactttcttgtgaagttgatttaagtattgaagtagtgatcagcatatgttaaattataaggctgtaactattaatagattccctatcctttgctcttgatacttatgtgtacttttcttgctgaatgaatgcccagtttttcaagattcttgcttaatatgatatggttcccaaggactagtgactcaggtgttgcttttaatatttaaactgtatttatttcttaaaggtgatgttggaccaaatggacaacctggaccaatgggacctcctgggctgccaggaataggtgttcagggaccaccaggaccaccagggattcctgggccaataggtcaacctggtaagattagagtaaatgtgcattttgtagcactcataatatatacatttgttagctcatcaataaagtgaaacctacaaaacagtcttccagaagcagacttaaaaggcaatctatctatgtgtatgattttataaaagtggataagtacaagccacagcataaaagctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgttttttttttgttgttgttgttgtttttgttttgttttgttttgagacagagtttcactcttgttgcccaggctggagtgcaatgctgcagtctcagctcactgcaacctcctgggctcaaacgattctcctgcctcagcctccggagtagccaggattacatgcatgcaccaccacgcccggctaatttttgtatttttagtagagacagggtttcaccatgttgaccaggctggtctcgaactcctgacctcaggtgattcgcccgcctcggcctcccagagtgctgggattacaagagtgagccactgcgcccggcccctgctgttttacagaggtggataaaatgaacttatcactcctatggtgttttgtcatttgtttcagttccaaaaagtgcatgagtctttagaagcattttgaattcttaagtcacagctgagtgcgaataaaaaaaggaacaccattaatatgaatctaaacaaaatacaaatatgttaacacgtgtcacgctttttcagatttacctgataccttgtaatgttttattaatctaatgttctctctttctttctccctctgttatatgatatatctgacaaaggacttataaccagatataaatataatatatagataaatatatagatataaatataatatagatatagagatattgatttataaagtataaataggatgggcaggaagaaaagtaataatgctgaattaaacttcatctatttcttttgtaaatatatgtatagccatagaattcaagatattaatatgattcaacaaataaatgaaattaacaggaactagcatgaaaatttattgaattcactcttaatatagaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccatacaattcttgttattgtggggaaatttagcggaactttgggatttatattgacttcttcatcctggatcttaccaggatgtgtattcctgacagtattcatggaaaaaatctatgctatgggaggaagtatagtataatgtctgttattactactactaataataacgatgaagaaagaaatccttgcctagtgcatgcaagttgtttctccataatcatatgctaataatgattgatttatctatacccaacctgttgtagtataaaattaaattaatttttaaatttgaactaaactttaggagcttaaattccaaaaagattatttaaatcattaagtcagagataaacaattgaaaagctgacctttaccaaaaggtaatacttttgtgaatgtaaatattttattatgtcattattggcaaatacatttcatttatagaataagctatatgaacatctaagcaaatgcctaaaataagttttttcactcatttctaatatatgatagcagtgaatcgaggtctaataacttctatttgtagagttttatgttctaatttttaaatgcttagtttttttttccctaacctaatgaaactttttgcaacttacttctgcttgggtggcccaacttgctgctgaactgtaattccctgcctcttgaacatcaggtgtaccaggtactgtagttcttcctcaaaagccatatcttaaagtaaagctttaaacatggaaaacaaacatttctccagatttaagtctttggtttatttcccttattttatagaactgctctcttggagcacgtttcaaaagataaattatttatattgaaaacccaactattaaaaatctttgtgagctataatataacaatagatagtgatccatataaagctataatcatgttcactgttaggcatcatatcatctttcacaaatatgatataaaaatctctctctcctttttatagtcttttactgtaaaatggcagcattggaactatcgctactttgccaactgagtgtaattctctaatcttcaaagtggattttgtcagtttagggccatgctgaaatatgacataaaacagatcttaaaaccctagcatcttactctctacaaaaataatcaccactgagtcttcaacaataaatttagatcttattgttgaaaggagacttggaatgatcatctggctcaacccctagtttccaattggttatggcataatccccatttagcagatgaggatcaacattaagtgactcacgtaagtcgcacagctggtaggctttggagtgggaagttacatagtatttttagtgtaattcttttcccataaacatactcttttttaaccaccttgcttttgggggaaaatcagccttacagaaacttactaaggttaaatattttttgctgtgtcattttttttctgtaaaatcttggttggagaaacaaaagatgacaaaaaatactaatagtaacatattattaatgtattattaaaacaatgtgcaaaacaaaggtaaaatacaatttaagaagtccacttaagtgacttattcagtaatcaataattttgggagctcatagagatgtgtactaataatttataatacattagaacaatgcaaatgtaagtgtgttcaatagaccagtgtcaaataatctatcagtctgcaataggattaatacaaatgttgagaataagcatttagaaacttttatagcaatttgatagtgtaattgtatctgttgaatataataaccaaaaaggtaggcttttattttgcatctttggctttttattcagttttagtaattttcattgtattttataaaaaatattagtctgtgattaactaggaattaagaaaagattggccttttgccagaaataatttgagaagcactgtcttagagcaatctgcttgaaaatcctaaagcttgattgttcagttattttgtgtgcatgatgtcaaaagtatctctaactcactcttaggtctgttatctacagggttctatcacttgtttactagaaatataaccagatacatcttttaaaactgcttcagtacttattaatattgatattgtattaactaggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaatttgtttaaagttttctctgatttggattaaggaaattaaaactaatacgactctggtagataattcccatgttacacttttctagattgacgtgatcccttaaggatgagcattaaatatctatgactgcaggaagctcactttgctattttcactgcacatttttctctgtgagagttccagttatatattactgtataacaaacaaccccaaaacttaatgattttaaccaaccttttaattttgctgaagattttgcagctctagaattaagggatgacttgactggttcatttatctctaacccacgttgccccagctggagtgtttgggactgaaaggtctacttctaagatggcacttctctgacatctgggtgttcattagctcacatgtcatctcatcgtccatggtacctcttcgcatggcttaggctcctcacattatggtagtataaggctggttgctccccttccatggcagctggcttccaacagagagaatcccacaagagaaaagtgagtgtttcaggaactacaggtagaagcggcaagatttcttttctttcgctctctctctccctttttttctttctttttccctttctttctctttctttctcttttctttctttcttttctttctttctctcttctctctttctttctttccttttcttctttctttctttcctctctttctttctctctctccttccttccttctttttttttttttgagacagggtctcactctgtcacccagactggagtgcagtgggacatgatcacagcccactgcagcctcaaacccctgggctcaagccatcttcctgcctcagcctcctcccaagtagctgggactacaagcacataccaccacacacagctattttttttttctttttttctttgtagtgatggagtctcactatgttgcccaggctgctctcaaattcctgtcctcgagcaatcctcccacctcaacctcccaaagtgctaggattataggcatgagccactgtgactggcctgtaagacttcttttgatctaggcttgggagtcacacaatgtcatttagtcaagtgtgaggtacagaatcaaccctagttccaggtgagggttttatagtagattgtacatactgggacatatggttcactggggggccatctttagagattagctaccagactgagtctccttattcatgggtatcagcagtagtgggcactatggtcaaaaagtctaaaacttaacagtgccttacgtccaaccctcaatagttttctggttgacatcttaaaacttactttttatgttccctaagtcaaagaaaggcaaacattacttattgatattcttcaaaggtaccaaaggtgaaatgggtatgatgggacctccaggcccaccaggacctttgggaattcctggcaggagtggtgtacctggtcttaaaggtaataatcaaggtttgctgccagacgtatgtgagagggaaaattaaatatagctttatgtcagtacagaatatttttgttgactgttttaaaatgagcaatggttacttgtgtttctatgtaacatggcatttaaataggtcttgttttcaatttggttacgtgcttagtttggataccatgatacatggtaaatgcttagctcaaaataacaaaatataaggattaagcattaatttttttgtttgtcttttgagacggagtctcgctctgttgcccaggctggagtgcaatggtgcgatctcagctcactccaaattccatctcctgggttcacactattctcctgcctcagcctcccaagtagctgggagtacaggcgcctgccaccacgcccggctaatatttttttgtatttttaatagagaaggattttcaccatgttagcaaggatggtctcgatctcctgacctcgtgatctgcccacctcagcctcccaaagtgctgggattacaggcttgagccaccgtgcccgtctggattaagcattaatttttttatagtcggcctctatcgttgtcaaggaattccagatggagggattgttatctgagtataaaaatgtgtatgcactcaagtaattcatagagtacatccaaggtgcataaatgttttgagtggccagtggcctactcaactatgaaacatatcaataatctttatatgcattaatctttgatggataaaattgatatattgtgttttcacacacattgattttaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtgagtgaatgaatttatttatgaatatttttcctgatatatctgaagtttaatttttaaatagcatgaaaagtgacttataatacagaattcaccaacaaaggcacttaaatgcatcaaattttggtaacaaatattaattttcacttcattcatactgtttcaccagtcaacttttgtttgagtattttctttatagtttacctatcacgagctttacctaaccactagtgaggttttaaaatagacttaggcagtcaactactagctttctaaaaagtaatacaggaaaaggatatatagccacaattacttgaaaaacaaatttcagtgtttaggaaatttgctagtcctttcatttttttctccttgataccagataaggacgaatggtacattgctgtactgcagtgttttgatatccatatcatacttggctttcaaatacagttcaccgttattctactttggcagaataaacaagtattggactatgaacagccaagttcagcccgaggggaagtcactgaaagtagatctagggaacaattgtgtccatatagttattttattagaaacaaatacagcgtaaaatattacgtggggttttcaataaaaaaaaaaccttttttatagaagtataacatgttcataacaaaacatcataaaatatggataagcataaatcattatataaagcacttggcacccaatctatatagaatagcctttcaagcaatatggaatgttaaaactagctatatctgtgtatctgcagcttatagtaaagtttgtggctctttgtacgttctatccatcaatattgtcagttcatgtgtatgtgtatgtgtatgtgagtgtacacagatgttaacagtttccctatgagcaggatttggtgggatttttcctcaaaaaagaattaaaaatattaatgcagtgttgtatatagtcaagaaagaggcagggtcacctaattttttatggaatgactttcttggcttaccccttgcaaggcttcttttctgtttcaattatgcttcctgtataataggggcagtaaactatacttgacctctactataggcttattaaatatagtcagaatctaagagataacctagagattatctgtccttattccttatttcttcatttccattgtaagaaaatgaggcccaaaataggaaagtgatttcactactgagtgctctgaatttcttgatggtaggtaactaaaaagtgaaggattttcgtgtgagtccagtgctaatagctcatactatatcagaatatcaccagttcctctaattcacttatagtttaacacttgagtagcttgctttgccaaagttatttcatggatgaataatatcatcctaacttgcctcttctactcattcttggaaggtatacctggagtttcagggccaaaaggttatcagggtttgcctggagacccagggcaacctggactgagtggacaacctggattaccaggaccaccaggtaagtgtgataggccatttgtagcaattgcttagctgacactgaattctggataaataattatgtgtttgtcatgtttgaagatgctgtggatttgatcatggtaataagcttgggtagctactgaaatatggagctcactttcggcaaaaatattgccctttggctctagttttagcagtccagattttataggatattttgccttgattattcagtttcttctttttgtggcagcagggtatacacagaatcagaaatgtgatccaaataaggtgttgtgttttgttacatacattgcaaaatatataaatgagacaattatctcatgaaggcctgaagaattcatcttgtcctgcttttttttctttctgcctttagacaagtcagtcattaaaccatgtaaaacagatggctattgattctatttttttaaatttctaggcatgaaaatttcacaaattctcttggtagtcagttacagcattaatcactcttagagtcgacatttttttaaatcctactaaaactctttcttgtttcttcttcagccactttcttttagtttgtttcctaaggaaataaagagcagcagtccccattcttacaaagtcccttaagttcagttatttgcgctagactccatactacatggccttgatatagttgggaagagaaactcccttcctatctctccctcacatcttctgcattctcttttccaagttagaagtcattgtaaaggaaaaaaataaaataaaaaaagtttaaggcaatactgtggtcctaggaaaaaacccagatgacatcacagagctcaagcacctatgtgctaggaaaaatgtacaaacagagcagccatgcctgttcaggtcactgcccagtatctgtccaccacctctaatctctccctggcctaatgtactaaactatatcataacaggttaccaccttttctctttctgatctcatataatcacgctctacatgagaagcccatctctgaatcttttaaaaaacagacttattatattggatttatctgtgaaaatacattaagggtagttgtacacatacagcaaatagcacttcaggtgattggaattgttttagggaaagaaacaaggtgttctggtaactttttaatttttttttaaagttatattaggagacctctattactatggttatattgtaatatgttcccaaggagatgttttatgttgggttctatctgtggaccttaatcatatattcagatttaatccatctaatcccatgtttgcattttaatgactatccattcccatgaaaccagacaaccccaatattgctacattgtcttaattttaccaatttgacctttctaggtcccaaaggtaaccctggtctccctggacagccaggtcttataggacctcctggacttaaaggaaccatcggtgatatgggttttccaggtgagtgatgaaaatcttccaaatatttagtcccattaatgaaaggtggttcaatatctctttttttgtcagaaaagaggctggtgttgatagaatcagactgaaacgatatctgaggtaatcagtgggtagtgttctcttgttacacaaatatttaaaatgggaattaagggacaaaattgtagaaaccttaaaagttataattcacaaacatcttttctccagctatacccccttttatttaaacttcctttaaaagtaggcttttatataattgtgtttgtgaggctcattattatctaactcagagtttgcggagctttttaaaaatctttttgctttgtcatatgcatcttagataatccacaagtaaagcatattttgtaaaatattatatatcacatattttcaacagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaagggtaagagtgaaaatcttcttcatgccccatcctctttttaccattcctttcctcatagaggcccactgtcaatagttgatatataaatttgaattccttgttctatacatttatatatatgcatatagagtttggggttttttctacacattgtgtatatgtagaatcatggtatgcatgctactctgtaccttgctttatcacttacccctttttatttcttttttcaatatatcttagacaattttctttgtcgtcatacattatatctgtggacatatatgtagttatttatactgtatagtttcataaaagtgtaattgttggatcaaaggataagtgcatttaattttttggctttttaaaacacttataataatgtaacatatgaacttgattttaaaatacaaccagtatgaaaagatgtaaaataaaaagtctcctttttacatgtttgcaaaccccaaatccccagttcttcttctccagggtaaccacttttagtagtttctctcatattcttcaagaaaggttttctaaatgcatttatatgcatgcatatatggtatttcatcaattttaatactcattttttacatccaaaatatctaatattggaatgcatcttattatgatggaaagcatattacaattaaaattgtaaatatttttccccaattattgatacatgaaatgatgctggaccttccaaatgtagatgttttctcatattttaattaatatatacaaaattatactatacatctgctctgtacctagctgtcatcacatagtaaatcttgacaaactttctttatcagcctataaatgtatgccttattattttttataattatatagtatttttatgggggttcactataaataatttaacctattatgaatatgaaaattatttctaggttcatgattacaaacatattttgcactgaagattcttatccatattcttacatacatatcttaagaatctttggtaaatatcaccatagaataaattctgagcagttgctagaacccagcatatatgtgcctttttaatatctatatttactgccaaattttccaattaagtaactctacacctttatactttcatgattagtataagtgattttctcctcattctacagatattgggtgttatcaatttaaaaaattttaccaatctaatgggtgaaaagtagtgtatcattattgtttatatttgaattttcctgattacaagtggggtttcagatgtttttaactctttcgtaaattgtctatttatactctttgcctcactgttttacgagaggacttggttatgtatttcatactgatttgtaaaagtacattataaatgtgaagatgcatccactgtctgttatatttgttgcaaatattttctcccagtcagttgtttgtcttatagcatgtttactgtgcatttcgttatgtagatgtttgaaatttttacataggcaaattatgtactcatttatttattcattcacaaaatatctgttgagtatgtatgatttaccaggtactgttttaggtgctggagatacagcctgaacaaaacagacaaacttttactgccttcaaggagcttatatttagtcaaggagtcatacaataaacaaaataaataagtctgtattatgttagaatgtgataaatctcatgatgaaaagtaaagcaagacttgatgataggaatttctggaaattgttatattttgaaataggttactaagggaaagtctctctgataagatagagcagtgaccacactgcagtaagagagtaagtcatacaaaaaccctgaggtgtgagcatacctgacatgtttgagaaacataaatgagtccagtgtgttaaacagaatgagtgagttgaaacaaagtaggagatgagattagattggtaatgggggaaagattatatagtgccttataggtcatcatagtaggggcttttactcctgagtgaatcggggagcaaatggaaagagttaacatgattgtacattaattttaagaactatcacagcacctgttttggaaacagatcatagaggagcaaggatggaaagcagggaaaccagttatggtgatatttaaataatgcaggctaatgatgttgatggcttggatcaagatagtggcaggggaagtgataagaaatgggcagattttgaatatataatatatgtcaagccaggaagatttgtgtatggaatatgagagagaggaatcaagaatgactccagtttttatcctgagcaaatagagtggagttgctatatgctgaaatacaaaaactttgaaaaaagcaggtttagtgagaaagatcaggagcatagttttttattttatttatttatttatttgttttattatactttaagttccagggtacatgtgcacaacgtgcaggtttgttacatatgtatacatgtgccgtattggtttgttgcacccattaactcatcatttacattaggtatttctcctaatgctatccctcccccattcccccaccccatgacagggtgtgtgatgtcccccgccctgtgtccaagtgttctcattgttcaattcccacctatgagtgagaacatgcggtgttcggttttctctccttgcgatagtttcctcagaatgatggtttccagcttcatccatgtccctacaaaggacatgagctcatcttttttatggctgcatagtattccatggtgtatatgtgccacattttctcaatccagtgtatcatggatggacatttgggttggttccaagtctttgctactgtgaatagtgccacaataaatatacatgtgcatgtgtctttatagcagcatgatttataatcctttgggtatatacccagtaatgggatggctgggtctaatggtatttctagttctagatccttgaggaatcaccacactgtcttccacaatggttgaactagtttacactcccaccaacagtgtaaaagcattcctatttatccacatcctctccagcacctgttgtttcctgacttcttaatgatcaccattctaactggtgtgagatggtatctcattgtggttttgatttgcatttctctgatggccagtgatgatgagcattttttcatgtatgtgttggctgcataaatgtcttttgagaagtgtctgttcatatcctttgcccacattttgatggggttgtttgattttttcttgtaaatttgtttaagttctttgtagattctggatattagccctttgtcagatgagtagattgcaaaaattttctcccattctgtgggttgcctgttcactctgatggtagtttcttttgctgtgcagaagctctttagtttaattagatcccatttgtctattttggcttttgttgccattgcttttggtgttttagtcatgaagcccttgcccatgcctatgtcctgaatggtattgcctaagttttcttctagggtttttatggttttatgttcaacatttaagtcttaatccatcttgaattaatttttgtataaggtgtgaggaagggatccagtttcagctttctacttatgactagccagttctcccagcatcatttattaaataggaaatactttctccatttcttgttttggtcaggtttgtcaaagatcagatggttgtagatgtgtggtgttatctctgaggcctctgttctgttccattggtctacatctctgttttggtacgagtaccatgctgttttggttactgtagccttgtagtagagtttgaagtcaggtagcatgatgcctccagctttgttcttttggcttaggattatcttgacaatgtgggctcttttttggttccatgtgaactttaaaatagttttttccaattctgtgaagaaagtcattggtagcttgatggggatggcattgaatctataaattaccttgggcagaatggccattttcacgatattgattcttcctatccatgagcatggaatgttcttctatttgtttgtgtcctctttcatttcgttgagcagtggtttgtagttctccttgaagaagtccttcacatcccttataagttgtattcctaggtattttattctttttgaagcaattgtgaatgggagttcactcattatttggctctctgcttgtctgttattggtgtataagaatgcttatgatacatctctagaactcttcaccccaatcaacagaatatacattcctctcagcaccacattgcacttattccaaaattgaacacatagttggaagtaaagcactcctcagcaaatgtaaaagaacagaaatcataacaaactgtctctcacaccacagtgcaatcaaattagaatttaggattaagaaactcactcaaaaccgcatgactacatggaaactgaacaacctgctcctaaatgactactgggtacataatgaaattaaggcagaaataaagattttctttgaaatcaatgaaaagaaagacaacattccagaatctctgggacacatttaaagcagtgtgtagagggaaatttatagcactaaatgcccacaagagaaagcaagaaagatctaaaatcgacaccctaacatcaattaaaagaaccagagaagcaagagcaaacaaattcaaaagctagcagaaggcaggaaataactaagatcagagcagaactgaagaaaatagagacacaaaaaacccttcaaaacatcaatgaatccaggagctggctttttgaaaacatcaacaacattgatagaccgctagcaagactagtaaagaagaaaagagagaagaatcaaatcgacaaaataaaaaatgataaaaggaatatcatcaccgatcccacagaaatacaaactaccatcagagaatactataaacacctctatgcaaataaactagaaaatctaggaagaaatggataaattcctcgacacatagactccccccaagactaaaccaggaagaagttgaatctctgaataggccaataacaggctctgaaattgaggcaataattaatagcctaccacccaaaagaagtccaggaccagatggattcacagccgaattctaccagagatacaaagaggagctggtaccattccttctgaaactattccaatccatagaaaaagagggaatcctccctaactcattttatgaggccggcatcatcctgatatcaaagcctggcagagacacaacaaaaaaaagagaattttagaccaatatccctgatgaacatcgatgcaaaaatcctcaataaaatactggcaaactgaatccagcagcagatcaaaaagcttatccaccaagatcaagttggcttcatccctgggatgcaaggctggttcaacatatgcaaataaataaacgtaatccatcacataaacaaaaccaaagacaaaaaccacatgattatctcaatagatggagaaaacaccttcgacaaaattcaacagcccttcatgctaaaaactcaataaactaggtattgatggaacgtatctcaaaataataagagctatttatgacaaacccacagccagtatcatactgaatgggcaaaaactggaagcattccctttgaaaactggcacaagacaggaatgccctctctcactactcctgttcaacatagtgttggaagttctggccagggcaatcaggcaggcgaaagaaataaagggtattcagttaggaaaagaggaagtcaaattgtccctgtttgcagatgacatgattgtatatttagaaaaccccaccgtctcagccccaaatctccttaagctgataagtaacttcagcaaagtctcaggagcatagttttttgattgtcaatattttgttgctgaaataggaaattcatcaattgagggggagagagaggaagaggtaaggaaggcttgaggcctgtcacatagattttaggattttttggaaaaaaagtcttctacttatgaagacttctatatcctgagattataaaaatagatttatatatttcttacaggattttcatggtttttttctgtacatttgcattttaatgcacctgagtatttctgtatgttgtatgaggtgagaaactaactttattttttttcccaaataaatatccagttgactgagcctcatttgttacaaactcaattctttattcactgatataaaattgtatttaaattttttttccaaatttgttcatgaatttttttttctggaatgagtgaattttaacattttactaatggaatcaaaattaccataataaattgtctctacatttttaatgggtgatagcagaaaaatatgttttaattggtaaatgtccaaagtatattcaactctacaagcaagaggttagcttttagttcttctgtgtgacctacaagtatatttcagtaagcaaattttacactaaatttagaaacttaacaaagatgatattgtggaaataatgtaaagtagtctgttgtttctttcagatggcattattataccttaaaatagtgacatgttgaaaaaataaaagtttttttagctcagttctattaggtacaggtgatctttgcttttgcacaaatttcagttatcattacttaacaccgatccacaacaacattgtttaaattttagttgctatgatatattaactcttccatttataaatcatcatctaaataagagatgtgcattacaatcagtggacagtaatttcacttctttcaaattctgtcactaattagtaaccatgcatctgttcagttcctgcactgacagcaaagcatttagttgtgtcacctccttgtctcccagtgataaagcaatgtgacattttacaaaaatggataatcaaaagagaaaattagccaacaaagaagaaagtgcaacaaaaaaaaaaaaaaaggaaagtgatagcactggaagtaaggtttgaatctaaagtaaatggggttatagaattaatagccaaccatagaattgtagacactgccaccatttgagagactctagatatgcagctaaggaacttagtgaaggcaaacttatcaacattaatgaggaaaggagcactgatgaaaaggatgaagatgtcacagaggaagtgttgccatcacaaatttcacattaaaggaactcttggagatattttacaagtttgaaagtataaaggttaacatgctggaagctgatctcagtttagaaacagtgagacaatttctgtgccaaggcatagaaaagatgtgtgctctgtattgtaagttatacgagaagaagggagacactgttcaaattactcttggtaacttttttacaatgaaataaatcactttatttttcaatgtttctaatgtttaaattagcatttaccaaataaatattggatttactattttttatttctttatacatgtgtatctgacattaaaacatattttaatgttttgataacatttttaaaggtcatagaataattacattttcccccattgattattaagatcactttacatgattttggtttgcagtttcatttttccagttccacactaccacgtgaaacaaagagtacccatattataaaggaagagaagaagaacagttttaggaaatataatggtatgattgagggaaaacaagcataagacaaatttctgtaattactgagttgttaagaaataggaatagtggtaaaatatcagataggtagtttgttttatggatgtcactgtttatgaaacagcagctctgttagtcaaaaagcatgattaataaagtatactgaaaaccccagacaaggagtcagtaggcagaaatttgagtcctgggtttgtgtacatgaccttgataagtcacttaattcttcagtgtcttcagtaccttgtccataaaaagtgggagaaaaaaaatcctactttttgtagttattgtgaggtttcaatgagattaaaacatgcttcataaaaaagaaaaaaaaggaaaaggaatgaaacactttgtaaattataaagcattctatacatagtatttctttttatctaaaatgaaagggctggagtagagggtgtctaagatatctggaattctcaaatataatgactctatggaactatatgaatctgtaatgctcttttaatatagtgtaattgttctaaccttcataactcctttttaaaatctaatcatactacagattcatccctttcataatcccagatggcttttatgctgaaattgacaagtgtatcctaaaattcatatggaagtgcaaggaacccagaatagtcaaagaaatcttgagaagaacagatttggaggactcactcttctggatttcaaaacttactacaactatgataccagcactgggtagacatagagactgatggaatagatagagtccagaaatacccatacatttttggtcaactgattttcaacgtaggtaccaaaacaatttaaagggagttaaggatagtcttttcaacaaatgatgctggaacatggatgcagctggaggctactatctatcctaagcaaattaatgcagaagcagaaaaccaaatagcacatgttctcacttaaagtttggaggtaagtattgggtatacacagatgcaaagatgggacaataaattctgggtattcccaaaaggggtaaggagtgggggaagtgttgacaaacctatggagtactatgttcactacttgggcaatgggaacattagaagcccaaacatcaacatcacataatatacccatgtaacacacctgcatacataacccctggatctaaaataaaaaacaaaacaaaaatcaaatcatgctgggaaaagaggatacctgtctgcaaaagaatgaatctggacccctatctcatactgtatacaaatattaactccaactggattactgacctaaatataagaactaaaccataaacatattaggataaaagatgactaaattcttgtgaccttgcattaggtaatggtttcttagctatgacactaaaagcacaaacaactaaaggaaaaataaattgggctatattaaaattcattaggtaatggtttcttagctatgacactaaaagcacaaacaactaaagaaaaaataaatggggctttattaaaatttaatgtgttttctgttgcaaatgataccatcaagaaagtgaaaagacagctcacgagatgaaagaaaatatttgcaaatcatatatgagataaaggatttgtatacagaatatataaagaattcttataattcaacggaaagcaaataactcagtttttaaaagtgcacaaagtgaattggacctaacaaacatatacaaaatattctatccaagaaaaatgcagaatatacatttttgcaactgcacatggaacattctccagaatagacaatatattagagcacaaagtaagtcttcatacacttaaaaagattaaaaccacacagcatatattttttaatcatgatggagtgaaattagaaatcaatggcagaaagtaaactggaaaatctactaatgcatgtaaattaaacaagacgctcttaaccaatgaggcaaagaagaaatcacgagggtagttagaaaatgtaatgtctttttttttttttttttttttttgacagagtcttattctgttacccaggttggagtgcagtggcgtgattgtggctcactgcaacctctgccttccaggctcaagcaattctcatgcctcagcctcctgagtagctgggattacagatacgcaccaccatgcttagctaattttttgtagagatggggttttgccatgttggacagttggtcttgaactcctgacctcaagcaatccaccctccttggcctcccgaagtgctgggattacaggcatgagccaccatgtctggcagaaaatataatgagacaaatgaaaatgaaaccacaacataccaaaacgtacaggatgtagtgaaagcaatgctaaatgggaaattaatagctgtaaatacttacattagagaagaaacatctcaaatcaaaaacctaactttacatcttaaagaactagaaaaagaaaaactaaatccaaaactagcagaaagaaagaaataataaagattagagcagagataaataaaatacagaactaaaaaaatcatagatgaagtcaacaaaactaaaagttgtttcttcaaaaagataacaaaatagaaaaagttttagctagcttgactacaagaaaaagagagaagactcaactaaaatcagaaataaaagaggagacattactaccaatcttacagaactaaaaatatatgagactgctatgaacaggtgtttgctaacaaattagataacctggatgaaatgggcaaattcctagaaagacacaatctaccaagactgaatcatagaagtagattatatgaatagacctaaagtgagtaagaagattgactcagtaatcaaaaaccttccaataaagaaaagctcaggaccagatggctacactggtgaattctaccaatctttttttttttttttgagacagggtctcgctatgttgcccatgctggatggagtgcagtggtgcagttacggctcactgcagccttgtccttgtgggctcaagtgatcttcagcctcccaaatattttccaaacaattaaagaaggattaacagcatttgttttcaaggtcttccaaaaaaattgaagaggagggaacacttccaaactcattatattatacctggattaccctgataccaaatccagacaaagacactacaataaaagaaagctacagaccaaaatcccttatgaatattgatgcaaaaaatccttaacaaaatactagcatactgaattcaacagcatattaaaaggattatatgccatggtcaagtgagattttttcctgggatgcaaggatagttcagcatacaaaaatcattagtgtaatacaccatcacactaacagaatgaaggagaaatcccacatgatcacttaattaatgcaaaaaaaagcatttgacaaaattcaacactgtttcatgattaaaaaaacacaccacaagctaggaatagaagcgaactatctacttattataaaggtcatatatgaaaaaacccacagctaacaatggtaaaagtctgaatgcttttcctctaagaccaagaagaagttaaggattcttaattttactacttcctttcaacatagtactggaattcctagccagaccaattaggcaagaaaaagaaataaaagtcatcttaattggaatggaagaagtaaaattatctttgttcagagatgatataatgctatgtagaaaactctacaaagataccatatatgcggaaaataggtagaactaataaacaaattcagcaaagattcaggataaaaaatcaacacacagcagtcagttttgaatgttttgatgcatcaacaatgaacattccaaaaaggaaattaagaaaattaaatttacagttgcatcaaaaagaataaaatacttaagaataaacctaaccaagaaggtggaagacttgtgctctgaagactacaaaatattgctaaaaggaattaaagaagacagaaataaatggaagatttaatactgttaaaatgtccatactacccaaagcaatacacagattcaatgcaacgcctatcaaaactccaatggcatttttttttccagaaacgaaaaacttagtctaattcacaaggaaatctcaagggaccccaactagccaaaacaattctaaaaaagaaccaggttggaggactcataataattttttattagaaaacatattacaaagttatagtaatcaaagcggtgtggtgctgacataaagacagcaaatagaccaatgtaatagatagaccagagataaaatctctggtctgtagttgaatgatctttgacaagggtgctcaatggggaaaggcgttcaacaaatgcatgctgggtaaaatgaatgtccatatgcagaagaatggagttgaaccattttcttacatcatatataaaattaattcaaaaaagaatgaagacctaaatgtaagacctaaaactataaaactcttagaagaaaacatgggacaacatgcctcatgacattagatttttttcaatgatttcttggatatgacaccgaaatcacaggcaacaaaagaaaaaatagattaattggacaacatcaaaatgttaagcttttgtgcatccaagaacactactaatagagtgaaaaggcaactcatgggatggaagaaaatatttgtaaattgtatatctggtaaaagattaatttccagaattttaaaaagaactcctacaagtcaataacaaaagccatcaaacaacccaattcagaaataagcaaatgacttgaatagacctttcttcaaagatgatatacaaatggcaaattagtacatgaaaagatggtcaacatcactaatcattagggaaatgcagtcaattctacagtgagataacacttcatacccattaagaaggctattatataaaaaacagtaaataacaagtgttggtgaggatgtggagaagttggaactctcctgtattgctagtaggaatgtaaaattgtgcagccactatggaaaacattatggcagttcttcaaaagtaaacacagaattatcatatgatctagcaatttcacttctggagacacatctaacataattgaaaacaaaaatgggacctcaaagagatgtttttgtagccatgcttctagcaacattattcacaagtcacaaggtggaagcatcccaaatgtccattgatagaggaatgtgtaataaaatgtggtatgcacacacaatagatattttttgaccttaaaatggaataatattctgatacatactacaatatggattaactttgaagccgttatgctaagtgaaataagccagttataaaaagacaaatattacatgaccccagttacataaggtacctagaacagtcaatttcatagagacagaaggtagaatggtaattgctcagggttgggggaggggaaaataaggagatattggccaaagggtacaaacatttagttagttataagatgaataaactctagggatcaaatgtacagcatgggcactatagtttaaaatattgtgttgtatacttgaaatttgttgagagtagatcttaattgctttcaccacacactgaaaaaaaaattgtaactcggtgaagtgctagatgtgttaactaatttcattgtggatatgagtataaggtttccgtttgggttgataaaaaaaattctggagatatatggtggtgatggttgcaaaaagtgtgaatgttgtttatgccacaggactatacccttaaaaataattaaaatggtaagatttatgttttgtatattttgatactctaaaaagccacataaaatgaaaatattaattagcttgatttaatcatttcacaatgtatacatgtatcataacatcacatcatactctataaatgtatatagtttttatcagttaaaaataaaatatttttaagtgaaaaaatgaacaaaggaattgaatagctatttctctaagaaagatgtacaaatggccagtatgtacatgaaaaggtgtttaacctcattagtcattatgaaaatgcaaatcaaaaccacattgagataccacttcacacttacttgagtaggcataataaagagagaaaataacaaatgttggcaaggatgtgaagaaattagaacccttttgcattgccagtgggaatgtaaaatgatgcagctgctgtgaaaaaatatttgacagtgcctcaaaaagttaaataaagagttatcatatggctcagcaattccactcctaggtattttcccaagagaaatgaagctgtatttctgcacagaaacttgtacttgaatactcacagcagccaaaagtgaagaaaacccaaatcacaagaatggctaaacaaaatgtgctatcccagagaaaattgaggagagtgaggatcatcatggtggacgggagacaggactggattacagctccaactcggacagacagagcagcatacagaggtacgcattgtgaatttagttccagatcaactgcaacaacaaaccagtaatcacaagaggatgcacagaccctctgaaggaagtggacttctcttgcaggacccaggagacaccccaaatactgtgagtgccccaaatatagaagtggaaagtggagatccttctctcccaaatacacaccgccactggagaaactggaggtctgtttgtgggagaagtttctgaccttacctggagctgagtccatttagagagccaagtgaaatacaggggtagaggaagcagcaggaaaggccctgggggcttgctgggtcaccaagcaggccattcctgcctggcaccacagggatccatcgggagggcagccagaggagtggaggaaagcaccacagggagaaggaagcctccagctgaactttgtaacaatttgaaccaggcgagaagcctcctggccagaactcgggggagggcatgaatccagtgtgcagactccacagatgggggaagaaccaagcccttttcttttgcagcttggtggcaggtagcctgcggcaagttctcaagccctgctcacccaccacctggaaacagacttggggctgttaataggggcacagtgggagtaagatcggccctttgatttgtgtgggagttgggtgaggcctgtgactgctggttttcccccacttctctgacaatctgcatgactcagcagaggcacccataatcctcctaggtacacaaccccattgatctgggaacctcacctccatcccccacagcagccacaataagacctgcccaaggagggtctgagctcagaggtccctagccctgcccccacctgatgagcctttcctatccaccctagtagctgaaaacaaagggcatataatcttgagatttctagggccccacctaccactggttcctctccatactaccacagctgatgctttctggaaagtgccacctcctggcaggaagccaaccagccccaaaatagagcattaaaccaccaaagataagaaccctcacagagtacatttcaccccctgccacctccactggaagaggtgctcgtacccatggctgagagaccatagacagttcacatcacaggactttgtgcagacaattctcagtagcagctgagagctgggtagactttctgggtggctaaaccaagaagagagacaataatcactgcagtgcccctcacaggaagccacatccataggaaaagggggagagtactacatcaagggaacatcccatgggacaaagggatcagaaaaacagacttcagccctagacctaccctgtgacaaagcctacccaaatgagaaggaaccagaaaaccaactctggtaatatgaaaaaacaaggctctttaacactccccctctccaaaaaaaaaaaaaaaaaaaaagtcacactagttcaccagcaatggatccaaaccaagaagaaatccctgatttacctgaaaaagaattcaggaggttacttattaagctaatcaaggaggcaccagagaaaggtgaagcccaatgtaaggaaatccaaaatatgatacaacaattggatggagaaatattaaaggaaatagatagcataaataaaaacaatcaaaacttcaggaaacaatgaacacacttatagaaatgcaaaatgctctggaaagtctcagcaatagaattgaacaagtagaagaaagaaattcagagctcaaagaataagaaaatataaacaaagcctccaagaagtctaagattatgttaaacaaccaaacctaagaataatcggtgtttctgaggaagaagagaaatctaaaagtttggaaaacatatttggggaataattaaggaaaacttccccagccttgctagagacctagacatccaaatacaagaagcacaaagaacacctgggaaattcatcacaaatcgatcattgcctagggacatcgtcatcaggttatctaaagataagatgaaggaaagaatcttaagagctgtgaggcaaaagcaccaggtaacctataaaggaaaacctgtcagatcaacagcagaattctcagcagaaaccctacaagcttgaagggattggggccctatcttcagcctcctcaaacaaaacaattatcagccaagaattttgtatccagtgaaactaagcatcatatattaaggaaagatacagttgttttcgcacaaacaaatgctgagagaattcgccactaccaagccaccacaacaagaactgaggaaaggagctctaaaacttgaaacaaatcctggaaacacataaaaacagaacctctttaaagcataaatcacataggacctacaaaacaaaactacaagttaaaaggcaaaaataaaaaccccaaaataccaaggtacgcaggcaacaaatagcatgatgaatgcaatggtacctcacatctgaatgctaacattgagtgtaaatggcctaaatgctccacttaaaagatatagaactacagaatggataagaactcaccaaccaatgatctgctgccttcaggagactcacctaacacataaggactcacataaacttaaaggagtggaaaaaagcctttcatgcaaatagacaccaaaagcgagcaagagtagctattgttctatcagacaaaataaactttaaagcaacaacagttaaaagagacaaagagggacattctataatgctaaagggccttgtccaacaggaaaatatcacaatcctaaatatatatgcacctaacactggagttcccaaatttataaaacaattactaatagacctaagaaatgagatagacagcaacacaataatactgaggaacttcaatcctctactgacagcactagacaggtcatcaaaacagaaagtcaacaaagaaacaatagatttaaactataccttggaacaaatggacttaacagatatatacagaacattccatccaacaaccacagaatacacattctattcaaaagcccacgaactttctccaagatagaccatatgataggccataaaagaagcctcaataaatttaagaacattgaaatcatgtcaagcactctcagaccacagtggaataaaactggaaatcaaatccaaaaggaatctgcaaatacatggaatttaaacaacttcctctcgggccgggcatggtggctcacgcctgtaatcccagcactttgagaggccagtttgggcagatcacctgaggtcaggagtttgagactagcctggccaacatggtgaaaccttatgtctactaaaattacaaaaaatagctggggatggtggcaggcacctgtaatcccagctactcaggaggccaaggcaggagaatcacttgaacccgggaggcggaggttgcagtgagccgagattatgccactgcactccagcctgggtgacagaacaagactccgtctccaaacaacaacaacaacaacaaaaaaaaaaaaaaaaaagaaagcaaagaaaagaaacatgctcctaaatgagcattgggtcaaaaatgaaatcaagatgaaaattaaaaaattgtttgaactgaacgataataatgatataacctatcaaagcctttgggatacagcaaaggtggtgcaaagaggaaagttcttagccctaaatgcctacatcaaaaagacgaaaagagcacaaactgacattccaaggtcacacctcaaggaactagagaatcaagaacaaatcaaacccaaacccagcagaagaaaggaagtcaccaagatcagggcagaactaaatgaaattgaaacaaaaaagaattgcaaaagataaatgaaacaaatagctgcttcttcaaaaacataaataaaattggtagaccattaccaagattaagaaaagaagagagaaaatccaaagaacatcattaagaaatgacacaggagatattacaactgacaccactgaaataaaaaagattattcaaggctactatgaacacctttatgtacataaactagaaaacctagaagagatggctaaattcctggaaaaataaaaccctcccatctttttttttttttacaattagtattaaaatgggaagcatatctagctcccagatcttggttacttttttttaaaattattattattatactttaagctttagggtacatgtgcacaatgtgcaggtttgttacatatgtatacatgtgccatgttggtgtgctgcacccattaactcgtcatttagcattaggtatatctcctaatgctctccttcccccctcccccgaccccacaacagtccctgatgtgtgatgttccccttcctgtgtccatgtgttctcactgttcaactcccacccatgaatgagaacatgcggtgtttggttttttgtccttgcgatagtttgctgagaatggtagtctccagcttcatccatgtccctacaaaggacatgaactcatcatttttaatggctgcatagtattccatggtgtatatgtgccacattttcttaatccagtctatcattgttggacatttgagttggttccaagtctttgctattgtgaatagtgccacaataaatatacatgtgcatgtgtctttatagcagcatgatttataatcctttggtatatacccagtaatgggatggctgggtctaatggtatttctagttctagaaccctgaggaattgccacactgacttccacaatggttgaactagtttacagtcccacctacagtgtaaaagtgttcgtatttctccacatcctctccagcacctgttgtttcctgattttttaatgatcgccattctaactggtgtgagatggtatctcattgtggttttgatttgcatttctctgatggccagtgaggataagcattttttcatgtgttttttggctgcataaatgtcttcttttgagaagtgtctgttcatatactttgcccactttttgatggggttgtttgtttttttcttgtaaatttgtttgagttcattgtagattctggatattagccctttgtcagatgagtagattgcaaaaattttctcccattctgtaggttgcctgttcactctgatagtagtttcttttgctgtgcagaagctctgtagtttaattagatcccatttgtcaattttggcttttgttgtcattgcttttggtgttttagacatgaagtccttgcccatgcctgtgtcctgaacagtattgcctaggttttcttctagggtttttatggttttacgtctaacatttaagtctttaatccatcttgaattaatttttgtataacgtgtaaggaaggtatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggtgactgtagccttgtagtatagtttgaagtcaggtagcgtgatgcctccatctttgttcttttggcttaggactgacttggtgatgcaggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttcttccatttgtttgtatgctcttttatttcattgagcagtggtttgtagttctccttgaagaggtccttcacatcccttgtaagttggattcctaggtattttattctctttgaagcaattgtgaatgggtcttcactcatgatttggctctctgtttgtctgttattggtgtataagaatgcttgtgatttttgcacatcgattttgtatcctgagactttgctgaagttgcttatcagcttaaggagatttggggctgagacgatggggttttctagatatacaatcctgtcatctgcaaatagggacaatttgacttcctcttgtcctaattgaataccctttattttcttctcctgcctgattgccctggacagaacttccaacactaagttgaataggagtggtgagagagggcatccctgtcttgtgccagttttcaaagggaatgcttccagtttttgcccattaagtatgatattggctgtgagtttgtcatagatagctcttattattttgagatacatcccatcaatacctaatttattgagagtttttagcatgaaggttgttgaattttgtcaaaggccttttctgcatctattgagataatcatgtggtttttgtctttggttctgtttatatgctggattacgtttattgatttgcgaatgttgaaccagccttgcatcccagggatgaagcccacttgatcatggtggataagctttttgatgtgttgctggatttggtttgccagtattttattgaggatttttgcatcaatgttcatcaaggatattggtctaaaattctctttttttgttgtgtctctaccaggctttggtatcaggatgatgctggcctcataaaatgagttagggaggattccctctttttctattgattggaataatttcagaaggaatggtgccagctcctccttgtacctctgaaaaccctcccatcttaaatcaggaagaattagataccctgaacagaccaacaacaagcagcaagcttgaaatggtaattaaaaaattaccaacaaaaaaaagtctaggaccagatgaattcacaacagaattctgccagacattcaaagaagaattggcaccagtacttttgacactattccacaagacagagaaagaaggagccctccctaattcattttaggaggccagcatcagcctaataccgagaccaaaaaagaaaactgcagactgatatccttgattaacatcgatgctaagatccttgacaaaataccagttaactgaatccaacagcgtatcaaaaagataatccaccatgatcaggtgggtttcataccaaggatgcagtgatggtttaacataggtaagtcaacaaatgtgatacaccacataaacagaattaaaaacaaaagtcacacgatcatttctatagatgcagaaaaaaaacattcaacaaaatccagcatcactttacaattaaaactctcagcgaagtcagcatacaagggacatacctcaatgtaataaaagctatctatgacaaacccacagccaacatagtactgaatggggaaaagttgaaagctttccctctgagaactggaacaagacaaggatgcccactctcaccactcctcttcaacatagtactggaagtcctagctagaacaatcagacaagagaaagaaaaaaagaacatccaaatcggtaaagaggaagtcaaactgtcactgtttgctgacaatatgatcgtttacctcaaaaaccctaaatactcctccagaaagctgctagaactgataaaagaattcaacaaagtttctggatacaagattaatgtacacaaatcagtagctcttctttacaccaacagtgaccaagcagagaatcaaatcaagaactcaaccccttttacaatagctgcaaaaaataaaataaaataaaataaaatacttgggaatagacctaaccaaggagacgaaagacctctctacaaggaagactacaaaacactgctgaaagaaatcatagacgacacaaacaaatggaaacacatcccatgctcatggatgggtagaatcaatattgtgaaaatgaccatactgccaaaagcagtctacaaatttgacacaatccccatcaacataccaccgtcattcttcacagaattagaaaagacaattctaaacttcatttggaaccaaaaaagtgcctgcatagccaaagcaagactaaacaaaaagaacaaatctggaggcatcacactacctgagttcaaactatactgttaaggccatagtcaccaaaacagcatggtactggtataaaaataggcacatagaccgatggaacagaatagataacccagaaatgaacccaaatgcttacagccaacggatcttagataaagcaaacaaaaacataaaatggggaaatgacacccttttcaacaaatggtgctcagttaattggctagtcacatgtaggagaatgaaactggattctcatctctcaccttatacaaaaatcaactcaagacggattaaggacttaaatctaagacctgaaactataaaaaatctagaagatatcattggaaaaatccttccagacattggcttaggcagagattttatgaccaagagcccaaacacaaatgcaataaaaacaagataaataattgggacttaattaaactaacgagcttttgcacagcaaaaggagcagtcagcagagtaaacagacaatccacagactgggagaaaatcttcacaatctgtacatctgacgaaggacgaatatccagactctacaacgaactcaaacaaatcagtaagaaaaaaaaacaaaaaacaaagaaacaatcccatctaaaagtaggctaaggacatgaatagacaattctcaaaagaagatatacaaatggccaaaaaacatatgaaaaaaaatgctcaacatcactaatgatcagggaactgcaaatcaaaaccgcaatgcaataccactttactcctgcaataatggccataatcaaaagatcaaaaaataggagatcttggtgtggatgcggtgatcagggaacacttctacactgctggtgggaatgtaaactagtacagctactctcgaaaagagtgtggagattccttaaagaactaaaagtagaactaccatttgatccagcaatcccactactgggtatctactcagaggaaaataagtcattatacaaaaaaaagataattgcacacgcatgtttatagcaacacaatttgcagttgcaaaattatggaaccaacccaaatgcccatcaatcaaagaactgataagctgtggtatatatacatatatacaatggaattctactcggccattaaaaggaataaattaatggcatttgcagcgacccggatgacattggagactattattctaagtgaagtaactcaggaatggaaaaccgaacattgtatgctctccctgatatgtgggagctaagctatgaggacgcaaaggcataagaatgatacaagggactttggggacttgtggggaagggtgggagtggggcaagggataaaagactgcaaatacggcacagtgtatactgcttgggtgatgggtgcaccaaaatctcacaaatcaccactaaagaacttactcatgtaaccaactaccacctgtaccccaataacttatggaaaaattaaaaaaaacaagcaaacaaaaaccaaagtgtgctatcccatacactggaatatcatttgacaattttaaaaaatgatgtactgatacatggtgtaaaatggatgaaccttgaaaacattatgctaagtgaaataagcaaggcacaaaatagccacatatcatatgatttcatttatatgaaatgtccagaataggcaaatctgtacaaagagaaggcagattaggttttgctacggcttggagggagtgagaatgagaaatgactgctaatgtgtacagtttcttttagggggaaatggaaaattttctaaaattagattgtgatgatggttgtacaatcctatgaagatactgaaaacattgaattgtacactttaagtggatgaattgtacggtatataaattatatctcaataaagttattttaaaacaatgcacattatagaaaatctacaaagtttctgctaataacatgtaatgtttttagttgtctttaaattactatctttattttaggatgtttttagttctagaatcctgagatttgatgaacaaatgggtgtgattttccccacaattaactttgggcacattttaagtaattgtatgtgctgtgattactagaactacacatgctgtgctagtatggaatagcatgatttatgaatcatattttttctttaatatttctttagtattttgagccacctgtaggctcattgagctgatgtttggagcaatttgctattatgcctatcttgcatggtaaagggtagtatagagctcattatcttttaagtttagttcatattctttttctctaagttcatcattaccttagacatactactattgaatttcatgtggcagctttggcctgctcaggcagccttgagccattatttatcagtttgttactgttagcttaacatttcactactgggaagagctaaataacatgcaaatttgaaggtcttattgtataattccttttctagataattaaaatgttaatggttgctcaatggatataaagcttcagttatgcaagatgagtaagttttacagatctgttatacaatatggtgcctacagttgacagtacagtattgttcaccttaaaatatgttaagaggatagatttcatgttaagtgctcttaccacaaccccccgacacaagaacatgaagaaatttttggaggtgatggatatgtgtagtactttgattgtgcttatggtatcatgggtatatgcatatatccaaactcataagtatgtatgcattatgtgcagttttatatataaattaataaagctttaaaaaagtatctctgcatgcacttttaaatttccctctgttaatattctgggtctaaaatagaacctatttatggttttgttcatggtctttaatctccaaatacagataaggttgtaaaaacattaacaattatgtgggaaccacaacttccaactgatggtctactcttgtaatattcttcttgcataaagcaagatatgatgtttactctttctcctcaaatattttccttttgttgtctttgtttcccccagtggcaatgcttctctagttttacagtggaatgcaagaacaaaagtgattagcttttttaccaatagatgtcttctgttctgtaaaatggggcaagcctgtaagtttattctgaattttgggttatagtatggaatggaggagaagatgctattactaggacatagtagagattggctatgatccaaataccattacattacaatttgaatcttaacaacaaagaagatatcaaattgactcctttttctacgtgatacaacacagtgaccttgaaagcagttctaatttcaggcttgtctttcagtgttactatagtcattagatagtttcacaatggtaaatgtgacttattaggtatgagatatttcattttcagaattatatcaaagcttgacattagaacagatgtagatatttgcagctgtgtgtccgagtcattcaaatcgcttctacctagaagtgcaaatagatttgaattttcctttctcagagtgatttgtgtccagtttgtagattttctgagcactgtcttctttatctcttcttgctttccttttttgaaattcattgttttcaatgagtttgtgtgtgaataataaaaggctagataaagcttaagctagcaaatttcagtgtttttttcagaagccctaataaaatatttactttatttttaaaaggtacttggtttgaaggagtagggccataagagtgattacagaaacggtattgagggcaagtgctggctgaacttagagactgggcttacagtagtccccccttaccaagggggatacattccaagaccccccgttggatgcctgaacctgtggataatacctaaccttttatatactgtgtggttttttttttccatctggtaacagagacagctactaagtgactcatagacaggtagtgtttatagcatggatatgctggggaaaggagtagttcaggtttcgagagggatggaatgggacaacatgacattttatcatgctacacaaaatggcgtgcaattaaaaacataaattatttatttctggaattttcaatattttcagaacacaggtgactgaaaccatggatagcaaaaccatggataaggaagaatttctgtacttttagaatttaatgtcctttagtatcataaataatccagagtttgccttctgcctttcagatttaccactagcagaatagtggaatttttttcttgttttttattttggtatatacatttaattttttcatgaataacaaaaagaatcatgatagtttattcaaaggtttcccatgtaaacacctaagatgggaccaattcaatccaaaatttaattgtatacctattatgtgcctcaaaatgaactagatatttgatttacaaggttcagaaaaaatgtatatattcccagcccaagattcttaatttttttaaataataggatgtaaggaaaaagagactttagtttaaagagctattaccataatgcagaaacatgagtcaaaaatagatcttactcacctgcaagtgtatgtactaagtgaggaaggaagtattcagtaggtgatgttgaacactagcaccttattgtaaaggtcctgatcttcatgcgcagagcagcaagccctgcagtagagatttagtgttaaggtatatgttgccattgttattgggaaaaacttgttttaattgtgaaagtgggtatgaattcttctaaggctctattggaaaaaaccttaatgcaaatattcattgagcaaaaacggttatacatatgtgaattatctcttacccaaaataaactttcaatgtaattaaggagttaagactgcatatatgaagccattgtagacatgacagagtaagaacctaccctaacctcttggggtaaactctctttgcccaggaatgcttcatggaagaagtaggatttttcttttcttgttaagaggcagggctccctctgtcatccaggctggcctgtagtggcatgatcacggctcaatatagccttgacctcataggctgaagccatcctcccacctcagcctcctgagtagctgggactacaggcatgcaccactacgcccagctgatcttttttattttttgtagagacagagtctccctttgttgcccaggctggtcttaaactcctgggctcaagcaatcctccagccttggcttcccaaagtgctacagccacaacactcagccagaagtgggattttagatgcccactgaagaattgatagacttccttatgttacagtgaaaatcacctttttcagtagaacgtactatagcttttggttgacatgtgtactggaagcaatgaattgcattatggcacagtaggaatgataaacacaggttctgaagtcagactgtttgaatccaaattcggatttcatcacttactagctccatcactataacatgggaataataacagtatctttctaatagggttgttaaggattaatgagaataatacatctacatactgtgagaatagtatgggctatgtagtctgattggctacatagctgattgtagtctggttcaaatcccagttctgccacttacaaaaaccttaggcacttggcttctcaagattcagttttctcatttataaatggagataatgaagcctaactcacagaactgttgtgatgattaaatgaagcaatttacatcaagtacttactggagtgcctgacatataataaaagctctataaataatgttatgttcttatacaatctaagtcgtgtagagacttcagtattatctttttattcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacagagcagcttcttatttggcagacttatattttatttcccaatcagatactgactagcaacataatctcaaactatctctttaccttttctttgcccaaatttatttctgtataaaatgagaatgaatattactgactcagcaggacaatatcctgtggacagagagactgtttggtggagcatttttcaatctttgactgctagccacaaatcacttaagaagccttgctatttttgtaggtaataatatatacttccaagcctctgcctgcagctgattatcttagaaaggtatgcccaggcacaccgctggtagcggttggtagaacaatcatacagttccttcaaatggcaaggattgagccattcaagtaagagattagcactatagtcaattatgtagcctgaactagattattatagtacctacttgtttagggttgaatttattttttgcttgttttgaattacacagtggcatggatgaatgaacctttcctttttattgaagtgaagcatacatgtagtaaagtacacttaagactatagatgagtttttacctaagtacatatatgtctttgaattgaccatatgtatcaagatataaaatagtttcttcatcccacgaagtttacccatgcccctacgccccccaaccccgaggtgaccactactatgacttccattaccatcagttaattttgcatgttattgaaattcatataaatgaaatcatacagtgatccttgtatctggcttttttcagtcatcattatgtgtaaaagattcatttattttgttacacgtgtcagtagtttgttctttatcattgctatgcaatattacattgaagaatgtaccacagtcaattacacattcccctgttgatggacttttgggttgtttccagtttgggactattatttttaaaaatgctattaacattcttttacatatcttttgataaacatatacattgatttctcttagacaaaaacttagtagtagaaatactgaatcacagggtaggtgtacattgaactttagtagatgctgccaaacagttttccaacatggtttgtaaattagtttcaacagccatgtatgaaatatccagttctccaattgcccatgtcctcaccatcactgggcagtgtcggtcttaattttatctgttttgatgagtatgtagaagcatctaattgaggtttgaatttacatattcctaatgaataatagtattaatcatctttttattatactattggccatttggatagcatctttttgaagtttcttcttaagtacttttgttcattttttattgaattgtctgtcctttttcaaatagattcagagtagttctttatatactcaagatatgagtcctttgtcagatacatatattgcaaatctattctctgtgcctcagatttgcctttcctaatgctgttgtgtaatgaacaaaagttgttaattttaataaaatccagtgtatcaatctttcctttcatgaatagtgatttttttatccaattcaataaatatttgtctatttgaggttatggaaataatcttctaatttttataacatgtttcatgtttaaactttcatatttggcttatgagctatctcaaataaaaatatttttacagtgtgaggtaggggtcaaggttcattttttttccagcacagttatccaattgctccctacactattttttttttaaagaacctaaacgcatccaataaattacagtcacacctttgtaagaaagccaaatgactgtacatgtggtgggctatttccagactctgtgtactgttccaatggtttattttctattgctgctttaacacaacactgaattactgtaaatttatattaagccttgaaaaatggtgggtaagtactagaaatttgtttcagttttttaaagcttgtcttggctattctaatttttttgcaggggaaatcagtttatcaatttccatttaaagtatctgtagggatttttaagtttgcaataactctctaggtaaggtagaggagaattgatattttgacagtattcaaccttccaatgaaatgaacatgttatctctccatttatgtaggtattgagtttgatttaacaatatgctgcactttttgttttgtaaatcttgaacatattttattaaatttatctctggaaatttgatgctttctggtgacatttaaatcatattgcttttcccagttcatcttccagttgtttcttggaagtatatggaaataattgacctaggaatattgaaataatatatgagaaaattgccaatttcactttttaaaattctgagtttgtataattttttgttttataaaatatcaccttagatatttttatttcttctttttcatttctttataccttttatttctttttcatgcttaattgcaccagttaggacctgtagtgcagtgtttaatagaagtggttatagtcaacatcattatcttttttctaaactcagagggacaatgattgctatttttccattaaatgtaatgttagtgccagggttttggcacatatattttactaaattaaggaaatccctttctagtcatactataatgggaatttttataaagaatggatgcgagttttatcaaattctttttctgaatctacagagatgataattgttttttctcctttactcttgatataatgaattacactgattgatattttatgtaaaaataaccctgtattcttgggataaactccaagatggtcatactgtacacattatctttaagtattgttggactggatttgctgttttttaaaaaattatacatggccatgagagagattggcctacgattttcttttctcatagtgtccttgtcaatgttttagtatagggatttgctggccttatgagctgggaagtattccctccttctctattttttctttaaatgtttcatagaattcaccagttaaggaatctggatctgtagttttctttgtagaaacctttttaaattacagattaaaagtctttaacagttatattactattcagatgatttatttttatgtcagtttaaatacattgtgtttttcaaggaaattgaccatttcatctaaattgtcaaattcattggcagaaagttgttgataatatccttgttttgtccctttaatttctgcagaatgtgtactgaagtctgcattttaataatgttttgatataagtaattttatttctttattttgatcaagcctctgaggcattcattaagctttattaattgttaaaaattaactttcgtaagtgattttctctaccatttgttttctattccattgatttctgcttatatctgtattatttcctaccttctaccttctatggatttaatcttgctgttctttttctagcttctttacctggaagcttaaatcatagatttttcagctttgtcttttctaatagatgtatttaaaaacttaaatttccatctaaggagtgctcaaaccatatcccagaaattttgttcttttgcgtttttcctttgatcattcggtttaagatattttctaattttcctgttgatttctgtttttctccatagattatttagaattgtgttgctcaacttacaaatatttgggggcttcccagatatctttatgttattgatttttaatttgattctattgtggccagaatacatattttgtatgatttaactattaatacttattgagacttatcatatggccaaatttagggtttatctgggtgaattttccttgtacccttgaaaataatttgtattctgcaatttgtgtattgcattataaatgtccattaggtcaggtttgttggtagagttgttaaaatcttgtgtattcttaccaacttcttgcctaattgttttatcaattactgagaggtaggtgttaaaatttccattatgattgtagagttttctatttctccttttctctctgtcaattttttgctgtatgtcttttgagatatttttattaggtatatataaattcaggaaacgtatgtcttcttgaagagttgacctttttatcattatgtaaagaccctctttattttcataatactcttttctttggatttttctttgtctgatatcagtatagatacatcagattctttatacttagtacagtataactttttctatataatttttatttttacctgtctgtacatttaaaatatgttttttaggaataaaatgcattcatatcttgcttcttttcgagtccaacaatctttcccgtttatttggagtgtttagttgatttatatttaatgtatattgttatgtttggattttagtcttccacattgctatttgttttatgctcctcctttgtccctggtttcctgttctgtttgggttcatcagatatgctgtggtattccattctatctcctctattggcttttaagctctccctctttctactatttttaaatgattgctccaaagatttcagtgtgcactcataatttaccacattctgcattaaattaatattatgtgacttcacatataatgtaagattcttacaacagtgtaattttatttacatataatgttcttttgtgtgattgtgtttatatatttcagatgattattatataggtaataaattttacaattaattgctattactattgctttaaacagcttcttctaaataatttagcatgagaaacaaaaccaattttcatatttaccaacatatttacatttctactcttctaccctcctgtgcagcagacttctagttggtatcattccctaaagcctgacgttcttccaccgtcatttattgtaaaatgattttgctggtgacaaattctctcaccgttaatttatctgcaaatgtctttgttttagttccattttaaataaatttttcactggatatagaaatccctttttgatatttgttgctttcagcactttaaatatttcttccactgtcttttcgtctccatttttcctgataataacacatcaattatttttaatattttgctcctttatattatgtctggtttttctctggatgtatttgagattttctctctgtaattggttttcaatagtttctttttgttgtggttagttatggttgtatttattttgccctctattcattaatattcctggatctgtagggttgttattttttaataactttggaaaatctcagctatcttttcctcatatatagtcgtgtgtcacataacaacattttggtcaacaacaaaccacgtatatggtggtggtctcatatgattatcatggaactgaaaatttcctatcaccacgtgatgtcatagctgtagtaacattgtatcacatttataatgtatttttactgtaccttttctaggtttagttatacaaatacttaccattgtgctataattgcctacaggatgcagtacagttacatgctatgtaggtttgtagcttgggagcaataggctctgctatacggcctaaatgtataataggccataccatctaagtttgtgtaaatacactttatatgttcacacgatgacaaaatcgcccaacaactcatttcttaaaacatacccagttgttaagtgacacataactgtatttcttctgtcgtattttctcctcttcttttggagtgcatattagatcacttgatactgtatcacaggtcactgagggtctaggtatgttttcaatttttattctctctgagtttaatttggatggtttttattcactgccttcaaatttactgattttttgatgtgttcaatattctgttaatcgccacaaaaattttaatttccatttggttcttttaagagttatcatatttttccagaaattccctattttttactcattatatacatgtttgcctatagattctttaacatatttattatagctattttaaagatcttttcagcttattccaaattttcagataaccatgtgtctatttctattggtagttttgtttttcttgaataagcaccacatattcaagtttcttccaatctgctaatttttattgtatactaaatgatatggatagtatggtataaagattctggattctattaaatttcttgaagaatgctgaatattgttctacctggcagttcaattcctggtatcaacttgatcctgcagtgatggagttttagattttgttatagcagggctatttccaatgccctttgtcttacgtgtatcccttggacttggcatacgggctttattgttaatgtgtgggttttctggggtaattttatttaaaaaatttcatttagtatttcttttttttaagtttattattattatactttaagttttagggtacatgtgcacaatgtgcaggtttgttacatatgtatacatgtgccatgttggtgtgctgcacccattaactggtcagttagcgttaggtatatctcctaacgctatccctcccccctccccccaccccacaacagtccccagtgtgtgatgttccccttcctgtgtccatgtgttctcattgttcaattcccaccgatagactagattaagaaaatgtggcacatattcaccatggaatactatgcagccataaaaaatgatgagttcatgtcctttgtagggacatggatgaaactggaaaccatcattctcagcaaactatcgcaaggacaaaaaatcaacaccgcatgttctcatttagtgtttcttatagtgaagtctgttggcaacaaattgtcttagctgtcattcattagaaaacatttccattgtgctttcacttgttattgagttacatagtagacagaattctaccatctccaccccaagatttctggcccctggttatttagtaaaaaaccaatctccttaaagctggtaagcaacttcagcaaagtctcaggatacaaaatcagtgtgcaaaaatcacaagcattcctatacaccaataatagacaaacagagagccaaattatgagtgaactcccattcacaattgctacaaagagaataaaatacctaggaatacaacttacaagggatgtcaaggacttcttcaaagggaactacaaaccattcctcaaggaaataaggacacaaacaaatggaaaacattccatgctcatggatagaaagaatcaatatcatgaaaatggccatactgcccaaagtaatttatagattcaatggtattcccatcaagctaccactgactttcttcgcagaattagaaaaaaactgctttaaatttcatatggaaccaataaagagcccgcattgccaagacaatcctaagcaaaaagaacaaagctggttgcatcacgctacctaacttcaaactatactacaaggcttttatcacctagtgatatcatagccatagtaacattgctaaggagagaatccagctcagctgtgcccagaatattacctacagaaatggtgagataataaatgggtattgttttaagtcattaactttgtggtaatttgttacatagcaagagaaaactaatgcactatccttttgttcattatttaagtttttacttccctcctaaatatgcttgttagtatttattttagggtctttgaatagttgctttttgtattctgtcaagttttaaattataatcagtgagaaaaaaaggctgtagtgggcttattctatcttggcttgcctcagaagtgtttaggggtaaatttaagaaaatatttgcatggtatattcactgaaaactataaaacctgctatgttagacttttaaataccaaaataaatgaagagatagatcatacttatggaatggaagatcaaaattgtttggaagccattatccttagtaaactaattcaggaacagaaaaccaaacactgcatgttctcactgacatgtgggagctgaacaatgagaatacatggacacaggaaggggaacaacacacactgtggcctgtggagcagggtgtttgggtcagggggatggagagcatcaggaaaaatagctaaggcatgctgggcttaattcttaggtgatggtttgataggtacagcaaaccaccatgacacacgtttacctgtgtaacaaacctgcacatcctgcatacgtaccccagaacttaaaataaaaaaaaaaaagatgccagttgcctctaaagtcattcatagattcaaagtgattccagtttaacccaacaacctttatttggtaacagttgacaaatggattctaaaatgtgtatggaaatgaaagggacatagaatatccaaaacaatattgaaaacgaggccgggcgcagtggctcacccctgtaatcccagcactttgtgaggctgaggcgggcagatcacgaggtcaggagtttgagactggcctggccaatatggtgaaaccctgtctctactaaaattacagaaattagccgggcatggtggcatgcacctgtattcctagctactcgggaggctgaggcaagagaattgcttgaacccgggaggtggaggttgcagtgagccgtgatcgcgccaccgcaatccagcctgggcaacagagtgagactccattacaaaaagaaaaaaaatgtgtggtacttgataaggattgagaaatagatcaatgaaacagaatttggaggataaaaaagactaatatacaataaattgacttttgataaaggtatcaaataaattttttagagaaagcaaattcttttcaacaaatggccctgaaacatctagatattcgtatggggaaaaaacaaaacttaattcatacattacatcatacagaaaaaaaaatgtttttaattagatcttagtctgaacataaaagctaaaaccataatgcttttagaggaaaacatagatagatatttccgtgacttggcataggcagattttcttaggatacaaaaagcagtaactgtaaaagaaaaaaattgatagattagatttaaatttttaaactacttttatcagaaaacaccgctaggaaaatgaataggaaagccacagacaaggagaaaatatttgcaaaacataactgacaaattactgatatctaggatatgtaaaaaacttcaataactcaataataacaagatgtattatccaattttgaaaaatggagaaaactttgaatagatacttcacgaaagaagatatacaagtggccgataatcacatgaaaaggtgatcgatgtcgttagccatcagagaaatgcaaattaaaaccacaatgaggtagctccatatacccaccagaatgtctgttattacagcaactgatatcatcacaaaggttgtgcaaggatctggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataagaaaagtctgtagaaataagaaaagtctgtagaaatatacgccaataataaaaatgtttctggaaatttcagtcttaatatatgttttgcatatttgggtagatgtgtgtgtgcacacacacatctaccctccctcttttgtgcttactcttactgtgagcaccaaatagtagaaggactgaatgtacatacagacatgtatgtttatgttctgaaatgacgactggccattttatggagacttttctcaaaccatacacatatctcctgtaaagtcaaatagatatccttcccatgataccaacatggaaattattactttaatgtgccactgttacattgctcttaaaagtgtcagaggtagagaaaaaatgttgagaacaattttgctagacggtgattataaatattgggtagaatggtcttcggggacacatgacaaccattgaagagccatatctttcattagtctcaaaattagactcaaaatatttgttttagaaatttcctccagccatcttgaaactatttttgaagatactttatactttttttcctcacagctattggtgatgtatcattgctctgtcttaacacaaaggataccttttaggatgaaagctattattatttctacatttctatatatactctaataaatacttctgctaacaaatgcatatatttaataggaaggatggttttctgggtagatttgggatttggtaggagatagaaatgactcttgtgaattccattaattgccctaatgtatgtgaatagctaaccttataagcaagcttgtaactcggtattatttatcttctaattatactttactttcataggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtaggagaatggtctatttattagtccatgtatttcgttttgctggcaggttattcagtctttaagactttagaatttttccggtgcattggaggatgttaaaaaaaagactttaaaatttgtgatataacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatcttttttatattttaatcatcactgtggttattcgttcttactagtaatgaatgagtaatgagctcactgttgaaccttactttgaaatttgtcggtatgaagccattagtcacaaagatgtcctaaaaattacatttttaaagaaataataacaaaagtagttagaagaatgcacacctgatgagtgtttgtgacttctcaaattatttcataaactataaattaaaactgagttgtaaaccccattgctcttagaattgattgttcttagtctgagctcatagtaatgattatgatagcaatgacttttggcctttaaaaatacgccacagtgtgctgttttcattttagttttgtcactaagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttagctccttaactccaaagtagtaactgcatgaagtttgaaacttatatacctgtaccaaatgttttcaagtgtttgaatgtattttaagagcatatgtgccaattcaattcttacatagtggcttatctctttaagtttttaggaacttgtagaacccagtgtttctgtctattggaaagacccaaaattacctaactaggaaaactaatttaacatttaaaaattcatatatttgtgtcattttcagttgaaaatctgtagtaccgaaaacagccttacatattctacctttctttggagtctgtttcttatgtttaatttatatctgttaatgcaaacgaattgaactatccttcaaaaggacattctttttttaaacaataatatgtattatcagatcttgaaaatatgtaattcttaacttgccatatcttttgcaggttttcaaactatcccaccttcacattttgggttgtcacaaagttctcaattctactgctgttaaaaatggactaatagggccgggcaccatggctcatgactgtaatcccagcactttgggaggccaaggcgggtggatcacctgagatcaggagttcaagactcgcctgaccaatatagtgaaaccccatctctactaaaaatataaaaattatccaggcgtgttggtgtgcgcctgtagtcccagctactagggaggctgagaaaggagaattgcttgaacctgggaggtggaggttgcagtgagctgagattgcaccactgcaccgcagccagggcgagactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactcctaggattcattgctctagcacaatttattctctctgctaacatttggtgcttataaatcatagcaaaacttgtaagaaaagaaaattgtgtttttagtcaattaacactaaccaaggggtgctctatttgtaggcttttaatctttttatttaatgatccttcttttaatagtgaatagcctgtcttaatatgtgcattgaataataatagagtaaatatgatattttctgtggttcggggtgggatattgcatgccaaaacattttcaagtaccctttcactgataggcttcatatcttggaaaagttgaatctttatttttgtgttcaatgttgtacaaatatatattggctttttctccttaagtaacttattgcaagtactataataataatataataataataataataataataggccaggcatggtggctcacgcctgtaatcccagcactttgggaggccgaggtgggtggatcacctgaggtcaggaattcaagaccagcctggccaacatggtaacaccccgtttctactaaaaatatgaaaattagccaggcgtggtggtgggtgcctgtaatcacagctgctcgggaggctgagccaggagaatccctagaacccagaaggtggaggttgcagtgagctgagatcacaccattgcactccagcctgggcgacagagtgagactctgtccaaataataataataataataattcaataaatagtaataggaaagcctcctggtgaattatgaaaaaaatcagaatgtggcttcatgaaatgcttttcaaatacaagcaaaagtacagttggtaatggccatcgtatattcatgttttgatttttctattctgtcacccatgatctttatatttattgccaatgaggcctttaaagtcaactgtatcttcttgaagcagtctgagcatatcaagaaattggcacctggtgtttttattaaaagataacacaagccaagataaacttcagcattaatccaaaaatacccctttactaaaggaatttgaaggctgttggtgaaatggtactatctagccaactttaatgttttgagaagctaatttttggaaagccacagtagcagtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctgtgttgactggttgccagcctagggtgactatatgagttaaattgtttaaatgtaaaacaattgttgtactattgtaaatctccttcctctttctcatatgccagatagagtcatgttatattatgaaattacatagaaatacctgaaagattaaaaagatgctcatattttaagatttgtttttatcttcaattttactaataaagaaaataataataattttaaaaagtccttccatagcttctactatataccaggcactgtgctaagtaatttttacattgtatctcatttaatccttggaacaacctgctaaagtaggtgctattcttaattccattttatagaagaagaaattgaagccaaggagattaataatcttactgaagtcaaacagctaataactaatggagctgtatttgtaacccagcattctagctccaaagtcctgtgttcttaatcacagtgtcattctgccttgttagtattttgccattgattctgaatcttaagagtattggaaagggaactaaagtctgaattttattttaggttaaaaagacaaccctttgtccataagaatgaactctattctaaattcataacaagtgcctattatagttcctcaaaaaataatccctacatatcttcattttttgttgaaatcaataaaatttgaaatgaccagaggagagaaggtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaataaatgtaactacttacaaataaagcaatttgatcttaatcacaatgagacatggcttgaatttctgattgccctacagcagtgatgcttaaagtgtggtcctggaactagcagctttagcttccacaaagcacttgttagaatgcaaattattgggcctctcctaagtctcttttttctaaattatttattcttaagactggtcaagtgcagtaacgagaagggaggaaagagttgaacaaggagttcaatctataactgaacaatcaattgagataactcactaccttcagaccagtctcctcagtcttacggaatccaaaactcttggggtgggcccaggaatctgttttaacaagccctctagttgattctgatgcatgctccaatttgagaaaataccctacagtttctgtttaatttaactttaagtcaaactctttgttaagaattacagagccacacattgttaagccatgagtctttttctttagatgttattttattgaatttaatatataataaaatgtaaactaaaagagtctgcaaatcagtgttcataacaaaaagaatccagttcaatttatattagaaagggaatcagcataggtctagatattttaatgttgtgtgggttttattctgcaaactaataggaagatgactgatattttaaaagcctgacttttatgctactcttaacactatactgaaatgtcgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgtttgtattcaaaatgtgaattctaagctgcatcattttaattaacactcactagacaaggttctatgtgtggctcactggcgaattaaaaagacagtagaaggcaagtttcctatagtctcctaaagggactttgttgtattatagtcagagttcctgaaaagatacttcacctggagtctttggtatgcatatttggatttgagtagccttcatttcagtgaaagcaaatttatgcaaaggagacatgcatattagagcattgcatatagatgaatccacccatagagaagtaattatggtgaatagaggcatcttttaggctttgaaattagataaagttagggtcaaatgtcagctcccctgcacacttctgctttgtatctatgaggaaaacagacactgggtttctgtcttcacctataaaaagagaataataacatatccactcatgtgctttctatgttggtttgagtgacccagagcagagagtcacattcctctttatgggttctcaaaactgcctccattcggtcaagatgattgctggtggatttggcagtcaacacaatctggactgtcttttaattctgaagactgctttatggcagaaaaaaagtatttaaagtagtgatccttaaagcttttcaaaatctaatctttttccccatgccatcactattcttccagttacctagacttaaaaatttacttctgtttactcattctctactcactccctataaatatgcatatttccagaaacaattaagagtaagtttcacctgctatacccctttaccactaaatattttaatgcagatttcttaagattaaaaatattctcatgttttattataagatgacaataaaaagctatgggattgtttatattttataaaattcttaccaaatgtcttggctgcagcctgtaatcctagcaacttgagaggctggggcaggagggttgcttgaggccaggaatttgagacgagcctggacaacatagcaagaccctgtctctaaattttttttaattatataaccacagtacacttattaacttcagaaaatttaacatagatatacattaatttctatctttcatattccagttgggtccaatgacctaataatgttcttagcatttcttcttccagtacaggatccaggccaagtcatgttttgcatttaattgtcatatctctttagccttctttaatctgaaacagttcctaagtttattttctttttttcatgacctcgacatttttaagaaattgtaccaccacccccatttttaaatagaatattccttttttgcctgatgtttattcataattagattcaggttatgcatccccagctggaatactacatgagtggttctgtgtccttctcaggctaaccgataaggaggtccatgatgtctatctgcttctcatttgtggttttagttttaatcatccagtcaagttgttgctcagtttctccactgcatcattaggtttttccttgcaactaataaaactgtaggaaggcacattaagatagtgcaaatataccaatactcatcaaaaatttcccttagatttaacatctattaatgattttgcctcaaccagtctctagtgggatagtggcaaaatgatgttgtttcaactctagcactacctccacatatactagtcagtcctactgtaagcaagagccctcccttctctctggtttacctatgcatttcttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatagtgagatcctatctctatagaaaagaaagaaaaaacaaagaataaaataatagttacctttcattaagtacacaccacacaccagtcttctaagcacttaatattgtcagcaaaagacaatgagatctagaggagaaaaaggaagagctttattttctgtaaaaagtaatctgcggattgggaaggcacagctttctgtacaagcgaaagtgtgatctctgaagaacaaagggagggtttggcttaagtagggaaagttctcacccatgttctcaaccaggtccatttatgcaaatgaaggattcagacttatcagttctgattgattgaaatacttgagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcctctgggacaagatagccattttctgatttgactgggtaaaggttgtagccctgttgctttgccataaaactgtatgtaccttctgtgcaggcatgaaaggacccagtggagtacctggatcagctggccctgagggggaaccgggacttattggtcctccaggtaagacttattcctgaagatagttatacctgatacttagatgctttaaagaatttgaaagttttcattctgtctttcagccagaccatcggaggctaagtccccaacaactgaggcaaaataaacaaggctctgcctttatttactaatctcttaaattctctattttagtaacataatattgatagcagaccttttaaagttaagataaatgcaggatcaacaaaaatgcttccttgacattagcttctatactaacttccccaaattcaattgaacagatcacaagagcaagtcacatatgaattttttataatattttcgatattaaaatagttctttttcctaagaggcttatagaggtttcttataaattgagaaataaggaatctgctaaattcccctactagatcaaagggtccctggacaagcacagcaagcaaaaactgcaaatgatgttggagtcagaatggatgtgtaagggaataaaattgtcttcccctgacaccagtgttcacagatttgaacacagatggatgagactttgtagtaactgagtaagattcaaggtttgaaaatagagatgatatgcttaatttttacactgaccctaagaaacttatttttcaattgaaaattatttttcaattttaagttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagcatagctgactggtgaatgtggacctgaggaaaataggaaagcacataataaggagatttgtcactatcagagaagcatacaagattgcttttatttgtgtttagagcagtggaaaactcagttaaattttccaagcactcactgtacttacttgttcagcaaattttcaatatgttgatttaaatcccttgaccatattgaaactattgtgaatatttccacatttgaaaatatcgcagtaggctgtaatttctttcataaagagcagcaaatataaatgaacagtttaagtgattgccatagacctttaagagtcatggtgaagtttcatattgagatgataaattgatattaggagcattaataggtgctcctgataatattgagtctggtatctgttagattttcaatttgtactcaacctacttccaaaaagaatttgagtcaacttgaaataaaaaatactttaacgttaaggtttctaaaatagaaatagaggatcatacattatatatgttaacaactctagattatataaatatgactaataaataaacataaagagtttgtatttcaaatatcagtggcaacacagcagagtggtaatacctatagccttcctagagtcaatgccctgacatttcattaatgctatatttctagggaaataacaagttagtgtcatcttcatcacaagtgtttctgtgaagtttccctaaaatgaaaatttatacacagactgtccaaaggcctgtatatacagaaaattattaaatgaactcaaaccaagaggctaaatcaggaagggaagccagtggtggattgaaaatgggcattttgaaaatacttctttagaatgccctgcctgttctctacacaaaaaggtatgcctgagaataattcccccagacggattcaaaggaaaatgtttttcagcaatgaagctggcagattgatggcaaccacacccttcctttctcattgatgaacaaaacagcaggctgaaaattgaccatggggttcagattcttttagtacaacaagagactaaataacatacagactctccaaataagcatattttatttgtctcctagcccatgatatctgacaatgcctttatagacactctataaatatcaaataaattaactagtcaaatgaggtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcctactgtgccttttgtttttgtttcagaaatcctgttgggttctagagtagccttggccaaagtgcctctctctattcttttggggcttccgaattgaaaaccatgtcaaaggcaactgaatatattcactatgatttttaaataaataatatttaaccttaaactaaaagcattaattagctcttgtgaggtacaattcttggcctaaagcagatcatttcaaaaaggccacatttacttttagttagattagttattaagggaacagtttccctgggctctttgcagtatagcagctgcttgagtgtgcagtgtttataattcctgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtatgacatttctgtacaaaatccagttcatttaaggtgttcccatgtatcttctctatactggggtggacagctaggttgatgggatgaggggactaaatcactctcaaggactcttccatccccatgaattcttttcctggaattctgactttggatgttgaagtcccattgtcttacctggggctgcattttgttgttgttgttgttgttgtgttgtttttttttttgatacggagcctcgctctgtcgcccaggctggagtgcaatggcgtggtctcagctcactgctacctctgcctcccaggttcaagcaattcttctgcctcagcctccgaagtagctgggaattacaggcgcccgccagcatgcctggctaatttttgtatttttagtagagacggggtttcaccatgttggccaggctggtctcgaaatgttgacctcgtgatctgcccacctctgcctcccaaagtgttgggattacaggcgtgagccaccgcacctggcagggctgcctattttaagactgactatcccctttgcctccataaagacatttaagaagatagtctgggctcccagtttctgggatctctatgatgagaagcttcctgagatctcattgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgtaagaaagaagacagagaagatggattaaatactaaagcttttctgtctgggagaaaagaaaaacatactgagaaccattagtctattaaagtcttataactatggggtatagagggcattgggagtatatgggatcactctctcttcgaaaatttggagactataacccagaattctgcatcattgtgggcagccacaggtgcaaccagatactccagatacttccatcattatgggccttccttttatttacctttcttttccttacgagactggatattttcagctctgtcccaaattaggcagtagaataggtttttttaaattactttataatgtacaaagcactttcatgtccattgtctaatttaatttacacaactatgattaagaaaaatgtatataaatattctgctttttcattttatacacaaagagactggctaataggttaaataacttacagttagaaagtgatggaggtaacacctgccaattctaaatccatttctttttaaattttcccatgttgttcactcttacatgactgtgagtcagtcaggtttttcttaacgagtttttgaaagggataaattagactaaatcaatgattttcaacctagggaattttttaagactcctagtcttatgccaaatccattgtataaaaattccaaataattctgataatacaggtttaagatctattggtcttttatcagtcatcttcagtctgagataagcatacccctttgaatatatgaagaatttccatgatgcacagaggcattattttttaaaaatcaaatttcaactcctcgacttttatatgtattttctcctaaagtcaatctgactttagcagatgtgctttgggcaatctcctttcccatgtctcctttgtctcctttcactgtcatgcattccccactttgtaagagtcatactcttgcacattgccttgaagtatgaaaacctctgacagacaaattcaaagggataattcaaaataacagctttgctaaagatacaattaccgttagatccagcaatcccattactggatatttacccaaaggaaaatagtatatcaaagagatagttacactgacatgtttattgtagcactattcacaatagcaaagatatggaatcaacctaagtatccaacaaaggatgaatggataaagaagatgtggtatatatacacaatggaatattattcagccatataaaaaatgaaatcatgtcatttgcagcaacatggttggaactggaagtcattatcttaagtgaaataagccaggcacaaaaaaaacaagtatcacatgttctcacgtatatatgggagctaaaaatttgaacacatggaggcagagagtggaaagacaggtagcagagacttggaagggtaagtgtggggaatggggaggatgaagagaagtgggttaagggatacaaacatacagtaagatagaaggaattaattccatatttgatagcagaagagaatgactatacttaaaaaatatattgtacatgagtgatggacaccctaaataccctgacttgatcactatggattatatacataaaaaaaatgttcatgtgccccataattttgcacaaataaaaaattaatggttttgttaaagtctccattaactcaagctctgtaattcacttttaatccaaccttctaagaaatacgtttctaataaaagtttttttgtaataattatataaaaatttataatacatatatttttatcagttgtgaattaataataacaatgacaggtcaaaataaaacatttaacacgtaaagtcttatagtcacaaagttttaaaaaggtatattcaatattaatttttgagaaatatgatagcatgatcaataaaaaactttcaaaaataaaaatatgttacattaggaaaaaactgtgtgagaaaagtggaatggaaatataatttttaaatgtagaaggaacaatgtataatttccaactgctaaagacaagtttatatattttctataatggttaatgttagatctcagatcattatattggatgcatttaaaagagtgatataaaagtttgttcttagatatcaatattcacaaaacaccataaatgaaaactggcaaggtagaaatgtggtttgcaaattcccagtccctgctattacaaagtggaataccgaagggtgggtgtggagctgagagacaatagctaaaatcttaatactggcacagtatcaatttaaacttacgatgaaatttagatatcaaaactttagatatgttaactttcaaaagtgtaagagagtgcatttttcatcattcttttgtgagtaaatgagaaaagaaaggcttgatcacaagtaaagataacctctcttgtccctactagctctgaatttcaaagattagtttctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattctcatttaagggtttgaatgagcaagacatacgtaatgtatgtacctcaggatacttcattctgttgatttttttcagtttaaatttatttttatgtgttgcttttgggttatcactacttggtatttttcttatggtccttgttatctatcataacatcatcagttgcccagatttccctcatcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 3617 - DNA, 257663 bp, human
gaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctgaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaatcgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccgtacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaaggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtagtagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttagcattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaaagattacttaccaaacccttttttgactttagcataaagtaggatgagaattaaaacgaaattaggatatatatgtttcaaatattatatcaattgttgaaagtaatacttctgaatgtcattcatttgctttgccattattaaaaaactaggtacaatttatgttttcaaatatttcatgtttttaagattttttaacacgccgaataacttccttaagaaaaatcttaaaaaattatatgtaatacagcacatccgtttttactataaactgtcagtatgaaacctgaaacttcttcatcagcaaagatgatacatttaacaattttaaataaccctaactttagatatagcaaacatttttttttctgatccaatgtttcttctctttagtcaactgttggattgaatataaagtaatagataataagaaaaaatgaggaaaatttgctctgcttgtaagcttacaatattatagccaattcttattccctcccctttctccttttcctttaggttaatgcaatatattgttattctctgtattttcttttggtattttctgtttttcacataatattctgtaaaactattcataaaataccttaggtccttctttctttctttctttgtttttgtttgttttttgttttttgttttttgagacagagtcttgctctgttgcccatgctggagtgcaatgtcacgatctcggctcactgcaacctctgcctcccgggttcaagtgattctcctgcctcagcctcctgagcagctgggattacaggcacgcaccacaatgcccagctaattgttttgtatttttagtagagatggggtttcaccatgttggtcaggctggtctcgaattcctgacctcttgatccgcctgcctcagcctctcaaagtgctgggattacaggtgcgagccaccgcgcccggccagatctttctaactaatggcatatgtcagattttatatagggcatatttttaaaataacttgaacaactattttgcattacagtggccatattttgtgataattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaagaactgaggtagataattttttttctttacttctaattgggatagatgaattgggataaaagttgaattgatatggatagttgatattgaagtaattggaaagtgaaggctaatgaactttttggcaatctggcatgtttcaaaatggcttttatagaaatcttttcaagaagtcatatcttgatggtatagttattctttgtttcttgttcctccatgctctttatttttaactccttctagggagaacgtggatttccaggcagtcccggttttcctggtttacagggtcctccagtaagttataaaatttgggattatgatgaacacaggaattaacaaaagaagcagaaatgtagtgagagagcccaatgcattcatgtggaacaaagtaatacattttaaagtaataaactagaggaaaatgtttcaaaaagaagttggtaatatagctttctcctgggcaaaagcaaggattttgtatgtatataaatgtcacctctaagtatcctaaggtatatcctattcagaaatgacgctacagcagtctactcattttatactctatttagaaagcattctgtaattggcgtgtttctctctcatacatataaaataatcccttttctttttaataatagggaccccctgggatcccaggtatgaaggtaagcatctcattctggggaacaaatgttttgaataaaatattaggaaagctggcaacttcaataggataatgactcaaacttctgtcttaaaatcgatgtttctagaagttgtgcaggtgtaaacttacaagctctccttaagtagtctcctgtgttcccatggctttaagtaccttgtatgtgctgatacacttgaaaatgtgtatatcagacttgagtttctttgctgacactttaagtcttcatcttcttacactttgatacagttaaccacttactctctgtagaattacttttttccctggcctctgtgacactatcctttcctgatttttcttctacacctctggttaatttgcagtcttctatgtaaggtcattattttatgtccatcaagcatcaggtcacagtctgtactccttccctgcaatgcccagaaatattactaatgcccatattattgattactatctagttactaaataccaaatgagacttttcttctgagttagctatgtgtattcatcagcctctctgacatctccacatgttccaagttaatccacccacaaaataaacccgctcctccctgtggctcctcatatctcaaatttgcatctttatatgttatgtacacttttacacgatctcaaaacctgggagttaatatttatatcttccattccttcacccaccacctcattcaattccatcactaaacactaagtgtgcctgtaaaaggcaccttaaattcatccacttttcttcattcccactgttaccacgttaatcataatgtctcatctggattactgcaataacctcttacgtagtctctagtctctttttttcaccactactccgcccttacctcccatcctgttttattctttacaaagcaaccaagaatgacattttaaaagtgttcattgataatttaatatgcttataaaccttcaagggctttctactgtgtatctaaggtaaagtccatagtttgtttgtaagaactgcatgctctggtccttgcctacattgacagccttatcttaaaccactaaacttatcccttagctcactgaccacatcagtctgcatttagttattgggatgtgccaaacgttttgcttttagggtcttttgtatatatggtttactttgcctaatattcttcctcctatctttgcctggatgactccttattatccttcaggtcttaacctgaatgttaccttcacagattgcccttctttgactacccaagctaattttctccactagtttttttttttcaattattgtaccatgttatttttcttcatagcccttaatattcacagcccttgatattgtcatcttatatttttacatattagggtctgtattttcccattatattgttagctttatgagaacagaggccttgtttatcttctccattactgattacccagaacctaccacaattgttggcaaatacttaatatttactacatattttttaatgagtaactgaaggtactacactcttaataaatctactgttcttcagtgtactctggccacttcctcattttcctttaaaaggtaaacttatcatttttattactgagatggcctaatcttttagtacatctctgttacaaattgaatcttcagatcatttttctggttttgctggttttcatgtataataactgtgtcttagaacttccattgatggcttcttttagggtgaaccaggtagtataattatgtcatcactgccaggaccaaagggtaatccaggatatccaggtcctcctggaatacaagtaagtatccagtgattttctttttttgctatattgattaaaccagaagattacaacaatccctcaacctttagtactctctgtttttgtcataaaaattatcatcagatgtttactagacattacatgtactttctacctgaaaataaaagcaatctggaccagggagaattttaacaacatcggcttcattcttttgcctttctatccagtgttttggggattggcagcagaaatagggttctatattcttattcttgtactgtggagagcagtagggtcttttgtacatttacaaaagacctaattaaaaataaaaattatggaagtcccattgaatatattaagatatatcatttgtaacactatcagttatgcataatatatgaacatattttgaaggctgaaggaatacagtttatgcatggtgaacatcaaatgtaatcttaagaaaaaaattttagcctacagaaaacatgcatagagagagcagtaacttttgagtatagattaggaggtcaatttcttagggtttatatttcatgataatcgaatcctttgccaaaaatgaaaaatcaaaacttcctggtagtttatcactaagatacaagattggggacttttttcattagctaccttgtcattccttacttgatatcacccatccatagtttttaaaattcactcaatcttgccctttatattttataaattgttatgaagtaatatttgaaaatacaacagaatacatgcaaaatatatgtatgttatgaagcataactataaagtgaacaacatttaagagctagaaaattacaaataattttgaatcaacctgtgtcccccttggtaatcaaatccttctgcattcccccaagacatagctaccatctgtgccttaaaaatagctttattatatatgcatatatttctaagcaatagaatatttagctttgctttataaaataatgtaatatttatgtagttttctgcaacttactttttctacttgatatgctaagattcatccatattattggatatggctttagttcactctgtttcactttcatataactttccatttgtggacatactaccatttggtgttttttgttttatgtggtgtttgttgttgttgttgttgttttgagatagcatcttgcactcttgcccagaccggagtgcagtggcatgatcatggctcactgcagtcttaacctcctgggcttaagcaatcctcccacctcagcttcctgagtagctgggaccataggtgcacatcaccacacctggctactttttgaaaattttcgtggagacaagttctcaccatgttgccaaggctggtctcaaacatctgagctcaagtgatcctcctgcttaggcctccaaaagtatgaggattacaggtgtaagcctctgtgcccagcctacaattttttcattacaaaaaaaaatccatgatttatatctaagtatagaattgctagattgtaggccaaattttcagtttttaacatgccaaattattccataacacttgtatcattctcttataatttatcccagttcctctcatttccctctgtctttaatcttatctattttaaaattagagaagctatcttgaaagtagtagcctttcccttctcattggtagcataaaagccctaactaaatgcatacctttatcactttgttttgtaaattttccttattatttgtcttatgtttatttaccactttaaaccacaagttttcttataattacttaatccttttatccctttgcattttaaaatttcacttataatattgctgaatgataaaattgtagagcagaattccaatgacgactgaagtttaaatgaagtctaaatttcatccatttagttctttgtaagatacaattagggggccgggcacagtggctcacgcctgtaatcctggcactttgggaggccaagtcatgagatcaagaccagcctggccaacatggtgaaaccccgtctctactaaaaatacgataattagccggacctggtggcaggtgcctgtaatctcagctactcaggaggctgaggcaggagaattgcttgaacccaggaggcggaggtcgcagtgagttgagatcatgccattgcactccagcctgggcgacacaagtgagactttgtgtaaaaaaagaaaaaatacaataaggggcttgtttttcttttttttcatcattttctttactcactttataacagggcctacctggtcccactggtataccagggccaattggtcccccaggaccaccaggtttgatggtaagctctcttctttaatttaatttccccccctttcctttctgacttctttcaggaatattaatattatttataatacttgaaaacataatgcattctcaacattcataatttataattttcttatgtaaaggtgactttacaatgatatggtgaataatatgcattctaagtaatggctccattttatagatggaaaaatgaggtatataaaaggaaagatttacaatgaaatattttgttggttgctcttgatgtatcagtgttgaagtcaattctggccatttcagaaagtcttttaaggcagttttctaatcacttgatgaaacatgtttcttcaaactgcaattgtttgtttaagaagagcaaaagcagggcttcataaaaaatattggctctcatttcctaggcgcctgggacaaaacagtagaattggtgaggggagtgatcactatgcaattggtcacaggtttttgtaccccaaaaacttctacagatcctgaatgtgcaaccggttctcttactttactagctctgtagtcactcttattttctatcctagtaaattctaagtatttttacttctgcaatacttagatttcattcaagtcatgttttggacttacagctttgctgttgccctcttaaaagggcaagaaaattgtatttcagtagaagtaatttctcatgtgccactctatctctcatctaccatatatttaagtgacagttttcattatacctttataggttgtacatttttgtttgtgacaattggtcctgcacttttgagtgaaggaaataatgtttgataactgctagaagaatctaccagaaaagattgtgatttctgctttcctgtaactttttgggggaagatgagaaaacccttttgtttgttttagttgtagacttcatgcaaagcatgaaactatggactttcgcactttttcctaattctgctgttggaacattggtgccccttgagtatattgttacaccttgaatttcctcaaccattgtggccacttaaccgattcactttacgtttctggatattccttgaattaacgctaattcaacaggtgaagccaaatcttagaaatgccaccaagaggccaggtgctgtggctcatgcctgtaatcccggcactttgggaggctaaggtgggtggatcacctgaggttgggagtttgagatcagcctgaccaatatggagaaaccccatctctactaaaaatacaaaaaattagccaggcatgatggcacatgcctgtaatcccagctactcgggaggctgagacaggaaaatcgcttgaacccaggaggcggaggttgtggtgagccgagatcgttccattgcactccagcctgggcaacaagagggaaactccttctcaaaaaaaaaaaaaaaaaaaagaaagaaagaaagaaagaaatgccaccaagatacaatatataaataaataggcccattgaggttaagaggcaacatacttgagcagaaaggtgcctatttaattttttaaaccttgaaacattctcagatacacaaagtcatattgtataaaaatcaaactggattttaaaaaataaacacatgctttttagaacttgagagttaattagagttaattgctttatggtacctaagtttacctataattctgatgtgaaaaatttgatgggtctgttgagattaacttttgaattgatttttgacaatggggctacctctctacctctgcccatcccagcttttttctcttgcccatttctattttgtcatcagaggtactcacattcatctagctcattttaatcaattaaaatgtgtgtctctgactaaaatgaaaacaaacaagaaaatactattttgatgggctttttcacaccttactctttctgaaactaaataacttttaaaattaacttattaatataacattttattttctcttttgtcttctcttcttagggccctcctggtccaccaggacttccaggacctaaggtaattttctttttctttatatcttttatttggtgtggattccttttcttactgtcagtgagatttttaaatggaaacttctctctccaggggaatatgggcttaaatttccagggacccaaaggtgaaaaagtgagtaaagaaagagagctggttattcagccctcagctttctctttttgtagtcatttgaactgtctttttctttctcttgcttcttgaagttatcttatcttacatgttatattactgtctgtggagattatgaagtatcaccactgtcttattttatcttgcaaacagggtgagcaaggtcttcagggcccacctgggccacctgggcagatcagtgaacagaaaagaccaattgatgtagagtttcagaaaggagatcaggtgagtaagtagggaggaagtcaatgaaaatcttgctatggatatgttaattagtttgatggtggtaatcacatcacaatgtatatgtatatcaaaacatcacattgtttacaccttagatatatacagtttttaatttgtcagttatacctcaataaagctgaaaaaaataaaatgataaaaagttaaaaataatatttctatgtaagtggaattccattaaaatgcattataagctgaaatgtggttatatataagggtatttttttttaaataacaaggatttgagattattaattttttttttttttttgagactaagtcttgctcttgtcacccaggctggagtgcaatggcatgatcttggctcactgcaacctccgcctcccaggttcaagcgattctcctgcctcagcttcccaagtagctgggattacaggtgcccaccaccacaccctgctaattattgtatttttagtagagacggggtttcaccatgttggccagactggtctcgaactcctgacctcgtgatctgcccgcctcggcctcccaaagtgttgggatttcaggcataagccaccatgcctggccaagatcattaaattttcaaaataactttatcaagatacagtctacatacatataatccacccatttaaagtgtacaattcaattttttttttagtgcattcacagggtagtgaaactatcagtgcaatctaactttagaaaattctgaggcttcctcaaaaaaatctccatacctatgttagttgtactccttatttctccccaaattgaccagccctaggtaatcactaatctacttcttggctctgtaaatttttctattctgaatatttcatataaatggaatcatacaatatgtggtcttctgtgtctggcttcttttacttagcatagtgttttcatgttaaatcactttgcagcacatatcagtgcttcattcctttttatggctgaataatatttcattgtgtaaatagtctacattttgtttatccatttattcatcagttgatgggcatttgggttatttccatttttggctatttgaagaatccattcatgtataaaattaggttatggtaagtcagaatgatgacagtgttccctacatttcactgatatgcaaggagaaagataatgttactctataaacctttgttgtgtttagaaataattatctgataccctgcttttgctagagtagatgagggaaattagatatatttttaaagcatactggcccacactttaacaaacagaatgtgtgcatttttgtttcacttaaatgtgaataagaaagttaagaataaaggaaaagttgtattgaaactctatcatcaatatgaatttggccatttaattatctcccaaaatatatgtatgccgtgtgaccccaaaatctctttgttttaggtattcttgctttttataaaatattttataagaataaaaaattgtcattattttcattttaagtgttgccttgttatttacctcaaatcttggcttgtatatagacaaaaaattaactgaaatgagcaaagatagctctagttaattttgcctagaagatttcaactttaagttagaaacaccctattatctttggttgtactacatgagtattcagttcagtttaatttttttagggggagatttatttttattttattttattatttaaaaaagtcaacctttattttagatacagggggtacatgtacaggtttgtcacataggtatattgtgtgatgctgaggtttggggtacagatcccatcagccaggtagtgaacatagtactcagaagttagttttacaagtattacctgcctccctctactcttagtagtccccagtgtctattgttgccatctttatgtccttgtgtccccaatgtttagttctcagttataagtgagaacatgtggtatttgattttttgttcatgcattaattcacttaggattatagcctccagctctaaccatgttgctccaacatagatgtagctgtggttcagtttattaaaaatgctcctagctagctctagtgcttagaatgaaaatgcatgttccagtattaacattgatttcctttcccctactactgcatagggacttcctggtgaccgagggcctcctggacctccagggatacgtggtcctccagtaagtacctaaagtgctttagcatcatttaatgtaaattggtattggtacacagtatcccatgaaccattgtgaaactatttttatgtgtacagggtcccccaggtggtgagaaaggtgagaagggtgagcaaggagagccaggcaaaagagtaagtgatgtaactgctaatattctttgcaaaaaaattctaaatgtgtgtgtgtgtgattttattctttcttcctacatcttccattgtttcaaaatatcactactgacattataatgttgatgtctaaaaagtctacttaatatagtccaagccaggaataaagcttgttatattctttaactttatgcttcctaactaacaaatgtatgttgttgccctatcatttctttgtatcctatagggtaaaccaggcaaagatggagaaaatggccaaccaggaattcctgtaagtagctaaggttctttccccctgcaaaactggagacatttatgtgttggtataacataaggtggcagagaagcagtatgacaaaaattgtggggtctggaaatagtttaaatgaattgaaattatccagtctttgtcttttgaatataattttcaatttttaaaaaattttgtgagtacatagtaggtgtatatatttatttatgaggtacatgagatgttttgatacatgtatgtaatgtgaaataaggacatcacagagaatggggtattcatcccctcaagcatttatcctttgcattacaaacaatccagttacaccaaatataaatttgaggttcctctattttttaaagtcagatttattgagatataatttacataaagtaaaaggaactatttttagtttacagttctgtgtttgacaaacacatacagttgtgtcaccaccaccataatcaagaacacttccatcaccttcaaaagttccctcatgctcttttttagttatcccctccctattcccctatcccaacccccttataacgactgatcttttgtcaatctctttaattttgcctattcccaaatgtcagatacattggatcatattgtatgtagcctttcgaatcaggatcctttcacataacataatacattgaattgtgtatcagttcatttttttattgctgagtagtatttgatagtttgaatataccatggtttgtttgtccatttacacattgaaggatattttggttatttctgtgttttggccattatgaataaaacttttatattcatataaaaatatttatatgaatataaatattcccatacagtttttttgtgtgtgtgtgaacatgttttttcagtaaaagttttgacaggtaattcttctacttactaccaaaaaggggcatgggaaataaaatatgtaagtccaagaacattatttcaagcagcttcagtatcaagagtatccgcagtaggcaagagtttttcaaagacagagagaatatttgatgaaatttgtaagttattctaagggaaaaggataattcttaacaagacaggttagaattactaaattcagataaattggtttcaggatattttactaaacaggcaatcctcaacttacaatctctagttcaaaaatattttatattataaaatatcaagaggtaaattcagggcctcagttcctggcttcttttggaacaattggtctttgtcttgattcaggcagctgtgatattcaacaattgcctcttagtgttttcaacaaattggggttgcggggtggggaggctgttctcttgttctctgtttgcactgggagaacccaagttgggtcaaataaaggcagccttgcaaatagccttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagctttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggtaagaattttaatactttgaagtgactggtttagtctagctaaaataatccttttcttctcccaggcttgagttataaatggaaaaagtctacataactagcttttatattcaaaatatgccttctttattcatcttttgctcatttttcttttataccacacttgctaaattttattccattgccataaatcacagtccatgttgcagaaatacattaagcattgtttaactttagcatttccactgtgaaaagtcattgcctttactttgagcatgtatcggcaaaacttctttttttccacaaagagaattcagcactattttagtgaggtcctcttactaaaaaggcttataactgtgaatgtagaacgtcgccactaaacatttccattctgtatgcaattattgtctgtaagtctgtggctaattctttgttgttttttcccccctactgggccaatgcagtctgactgaggtcatttatttagttacctatttttcaagtgactttgaaagattgtatgaagcatacaattaccagatttttagcagggcacaaaataaccagtcctccaatccctcttgtttttaattgcttcgtatcaaaaactgaaagctttttggtttttcaggcaaggaaggaaaggcgttacaaacttgaatgtacccagaaggcacatattttaatggtggtttatttttaaattaggtccaagttctagcatggcttaaaaggcacaattagaatagatggaggtaggaaatactccgataaaatgattttttgtcaaatagtatttgtatatagatggatggcttctatgaacaagtttagagtcagaatagaagtatgaaaaagaccatccttgtgtcttggccagtagtagagtaacacttgaatattgaatattgtggtttttttcatgctgttgtagctactaatcaaggataaaagttttatctgaacttgtctttcattagcttctaagagcaagctcatgaaagcaattcagatttactagctattattgatgatagttaagtccatcacatctaaaatgtctgtcactaatagaaatggcactacatttatgtccttgactagttttatgagaagaaacatggctaaatgtaaaaaaaaaaaaaaaaaaaaaagtaattttttcactgattctagtgctaccattttttttctattatcttctttatagagtatttgtagttggctagaaataggaatcttaaaaatcaaagaatattacaactagaaataccttaaaactctggtccaaaaatctttattctttctatataaaccagagaagttaattaacttggtgaagattacatagctagtaaatctgagacaccatcacaggttaggcttagctcagaattgtttcattacttcatgttgcatttctcatttgaggtattttatgattgatttctgggtctttttggaaagtttctcttatattcttgaggaaattgatgttttcatgtgaattttactaacctattttacaattgcattgaacagggccaaaaaggtgacactggcccacctggacctcctggacttgtaagttttttttttttagtcttcgtttatcaaatttattaatgcattatcatttttgtgccttaatcgcatactccctactttttcttgatagaacacaaaatttcaagtcattatcaatttctactggcttaaaagtctttacatctaaaatcttcagtaatgttgacctcaaggtctttgtattgttctgcctatgcattacttctgcatggtaaaggtctaaaattatggcattgggttgttttgcctcatgattgccagatcatttctcaagcaaccagcaggtggtgcaagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaaataaatgtgggttaataaagagaaagattggggaaaggcattacacatgtttggaatgaaatatgcaaagacatagacaagaacgtgcaagttgaatgaaatggttagaatcagacagacttcactataataaaaatttattgtaagacgtagtaggagattaaataggtgagagaagtattggaagtgagaggtgacttacagttcaggattaaaagtagcagcacttatagtaaaaagtagtgagcaattttgagtccttaagcagaatagttaacacacacacacaaatggtttttgaggaagcatatcctaacaatagattggaattcaagggacaagatcagaggtgcttctattactctaagtgtgagttgataatatagctgtggcagcagaaatcaagggagcaaattggagagacgttttctgtaaagaattgtcaggcttaggagattggaatgaattgaatgtgaattataggagaagagacatcaaaaatacttttagttttatatgcttcgggctcaggaacatggtaatgttgttacttgtattggacattttctaatcagttggaggatgggagtgatacaaaatgtgactcataaactatgtgaaaatgatgacattgtaatcatatgtagctcccataatgttttcaggagaacaaggcttttcttctttgcatttctttattttttttttctttggtaataaaggtaattcctagacctgggactggtataactataggagaaaaaggaaacattgggttgcctgggttgcctggagaaaaaggagagcgaggatttcctggaatacagggtccacctggccttcctggacctccaggtaaatgagattgcatttatggccttgttcttatagcatccttactaatccatgtatactttttatcacattagttccatggtcagcatggaagtaggagacacaagtcctttttaattgacagatacttcccaactcttactataccttctctcaccatattactcacttgtactttaaaaaagcccaagtgaatagtgtcctttaatcctaagattcctatttctacattttattttttattgatacataattgtacatatttatgggatacatgtgatattttaatacatgagtccaatgtataatgattaaatcaaggtaactagaatatccattacctcaagtatttatcttttctttatgttgggaacattcaaaatcttctcttctagctgttttgaaatatacagtaagttgttgttaactgctgtgaatctactgtgctaccaaacactgaaacttattgcttctatctaactgtatgtttgtacccattaaccaacctttcttcatttcccccgacccttcccagcccctggtaaccatcattctactctccacctccatgagatcaactttttttttttaacctcctacgtaagaatgagaacatgcatttgtatttgcctttctgtgcctggtttatttcacttaacgtaatgtccttcaggctcatccatgttgctgcaaatgatagaactccgttcttttatggccaaataatattccattgtgtatttataccacatttcctttatctgttcatccactgatgaacattcaggttgatttcatatcttggctattgtgaatattgctacaataaacatggaagtgcagatatctctttgaattactaatttattttcttttgaatatatacccagacgtgagattgttggaacatatggtagttctatttttagttttttgaagaacctccatactttttttcataatggttgcattaatttacattcccaccaacagtgtgtgagagttccctcttctctgcatccttgcagcatctgttattttttgtctttttgatgatagccatattaactggggtatattttattattaataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaatttgaaaggactaaacactgattaaaagacagtgactaaaataaaattgaaattaaaaatacctatatatagtgcacagtagacatatctaaagcaaagtgacagatacaatctgaaaataatgcagtatatattgggcaaatgctatacataaaaaagctggtttagcaattctaatatagtatgaaatataattaaattcaaaacttgaaactataaaaattctagaagaaaatgcaggaaaaacttttctggacattgacctaggtaaagatttatgactaagacttcaaaagtaaatgtaaccaaaacaacaatagacaattgggacttaattaaactaaagagcttctgcacagcaaaagaaacaatcagtggagtaaatagcctacagaatgggtgaaaataattgtaaactgtgcatctggcaaaggactaatatccagaatctattaatataaggaacttagacaaatcaataagagaaaaaaataaccccattaaaaactgggcaaaagacatgaacagaacacttcttaaaataagacatatatgtggccaacaaacatgaaaaaatgcttaacatcactaatcagcaaataaatgcaaagtaaaaccacaatgagatactaacacattagaatggctattattaaaaagtcataaaataacagatttgggcaagaaataatttcagttattcagagaccatctgattatctaccagaaagctttaaaaaatccattgacaaattcccagaacttaaagagaatatgtgtgcaagatggccagatctgagtagcatacttaatttgccttcctcttcaccagcaaacgtacaagagaaaaaaatacacttcacaatagtaatagtattaaaattcacagtagaataaccccaacaatacatgtgtaagacttctttgcagaattttgtaaattattattaaataatataaaattactaaatagagaaataaatttaattattacttgatgtgaaaaaccaatataataaacagttgattctaccaaaaaataatctttaacttcaaattaatcccattcagaatcccaaccagtttttgaaaatgaaactgaaaaatttatttagaaaagtaaatttgtagatggttttaaaaatgaacaaagatgagcgtattttccttagcagttttgaaaacattataaagtcatagtaactaaaaagtgtgttaatggtgcatgaatcaccagtgtaacagaagaatgtccggaaacagagccatgtttatatggtaactttgaaatacctttttatcttgctaatgactttccggtatttttgagattataagaacagattgtcaaaggatggggttactagtaatttccaaaagtagtaaacctactttaaattattatttcctaccctcaaactgttacttacattctttgaaacttttcaacctttttttcagacttttgagtctcatagaaaaaaaataacataaccagaattatatgttaaaggaagatcttatcattatctaatgtctcaatgagaactaaagtaacatctctaagatgaaatcattttgatcacttttttgaatcttaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtaagctatatttttctcctattaagttctatttttgtttttgtttattttgtttataagtaactctagctaaaggttggcctcatttgttgcgtttctgatatctaagaaattctaccactgcttctgctttttgggttttggtagttcttggatgtttacatttgctcttcatatagtatttatcagcaatgttatattttccttttgcttataggtacttttatttcttcagagaataggtctttttctggcttgtcaggctttcttttgtttaatcttctggatatttcacaattagcttgctatcctttctttatcttactcaggtgatgagatatgtgaaccaggccctccaggccccccaggatctccaggtgataaaggactccaaggagaacaaggagtgaaaggtttgatctccaaacatattcattccttcattttcttcattctttcaaatcatcagcaaaatcccctgtatcctccatcacaccttagccactgactcccatggtcataccccaagaccatctcattaccaatagtgttatacttacatgaccttggtttcatgcatcccattttttggatcgctctcttctttctagcttactacctctagtaacctgactccagcaatactccaaccccactgagacctagcaactttgactaatgcttaactttttgatgtcctttcttccctcttaaccttgcttaagttccattatcaatcactgtaatcaattccattcataaatccatgattcctttgcccttctctcacttcattgcactcacttggaacaaaagcataatccaaattttcatgttttctgagcctacactttctcttctcttttcaagttttaacagttcctcccctattcttaccttgcttcctacttcactgaccaattaaagcaataacaagagaactttcactgattgctaccaccatatttacttacctacttgcacctgtgcccatatagtctcccttcttgcatattactgttactgctcctatctaaagccagttcttctatttatacaatagattccatttcctcttatttccccaaggattttttttccagcaatttttgcctctccgacatcaccaatttttccctctctattcagtcattccaaggagcatacaaatatgcttttttcacctatctaaaaaaatgtaatcctacattccctgccagctgtttctctatttttctattctcatttgcaacaaaacttcctaagaattttctcctcattacctctagatactctcctcttgttttctcttaaacatactccaatcaagatttcatcccctcttcccccaactccccactgcctaccactccacaaatgctggtcagtcaccagcagtctatatcctactaatccaaatgtcaggtctgtcctttttttgcttgctttttgccttctttaaacatttgcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattcttgtacgtgtattttttttgtaggacataaacactaatttttattggggatatatctggaaattgaattgctgggttataggttaggtgtaggttttgtttcatagatattaccaaaccatgttccaaagtgattttcatttgcgtttgcctaatgacttgattatgaactatttccttacagtttttatattctcttttgtaaagtgcctgtctttatctttaatttgattattggatatatgtattaaaactatcttctgttttgttaacttttgtttaacaaaagttgctaattaaatgaaatcaaattaattaatttcctattttatcgttagtactttttatgcactgttttagaaatctttacttatctcagaggcctgatgatattcctctgtgttttcttctagacactttattgttttacctttcacgttttgatctttcttcaattaatttttgtgtatagtttggagtagggatcaaagttcatttttcccatatggatgtccagttgactcagtactatagaacaaaagatcatcaattaccccaatgaattgcattagcactttttgtagatcacatgaccatatgtgtgtaggtctgtttctgactgctctattctgttctgttgtttcattagtctctctttgcaccaatacgatactatcttaattactgtggctttattgtaagtgttggatattctaggttctttgcattattttgtgtgcatcttagaattatctatccaacttttaagtttaaaatgctccaaggttgagtccttgttcttcttttctatataaactcatttattcagtcttgtgactgttaataccacctaattgcccatgacttccaaatttatgcctcctatccagatataactcttttcctctagatttgtgtatccatttgcctagtcaacattttgaacttgacatcctgatcaaattgaagtcttgatttctgccacctcctccccatagttgctgcactcacatcttcagcttcttacttaaaaagcaggccactttagccttctagttgctcatgctgaaaaccttggagtcatccttgattcccctcttcttttgtatttcatatatgatccatgagaacatctcattggctctactttcagatatgtctataatctaaccggttctgatcattttcattgcagtcactttgaaatgagctaccaccatctctctcctagatcattgcaacagtagccacttaagtggttaccctgtttccatcattgcctttagaggctattaacatagcagctagagtcatcccttaaaaacttaagttataacatgttgcttttctttttaaaattttctactagattctcatttcactcacagtaaaaaccacagcctttatatttcttatatgcctatatgccattcgttataaactgtcaactttctgaccttgttcccctccctcattctgctctagcaatctggtctgcttgctgttccttgtatataccaaacatggctattctttctgcttgggatgttctacactcttatgcacatgtcatgtcctttaagttttatcatataacaacttctcaatcaagtctatcctgactaccctatttaaaattgcaaccccccacccttccctggcatactcaataccacttatgtagttctattttttcctataaaaataatatattttaaagcatattaaatatttaatgtatatttaatttttttagacagggtcttgctctgttgcccaatctggagtgcagtggtgcaatcacagctcactgcagcctcaatctcctaaggctcaagcaatcctcccactttagcctcctgggtagctggcaagtacaggcatgcaccaccatgcctggctaatgtttttattttttctgtagagatggggtttcgccatgttggccaggctggtcttgaactcctcatctcaagctatctgcctgcctcgggctcccaaagtgctgggattacaggcatgagctactgcagtctgcctatacttaatattctattaaaatatttcatatatacattttgataattcatttcctttattgattattatccctttcccctggtagagtgtgaggcatgtagacatgaatttttatccatgacttttcttttgctcaccaatgtaacacaagcatctggaacagttcttggcacacagtaagcactcagtaatttatttgtcataaattgattcaggatataggcttctccaatcacaccattaagtggaaatgctgtcccttagtgctaacatttttagaacctatctatagaaggtatatgtacccctttcagtaaaatttgtttgttattatgatttcactaggtgacaaaggtgacacttgcttcaactgcattggaactggtatttcagggcctccaggtcaacctggtttgccaggtctcccaggtcctccaggtaaattatgcctcagggtaaccttctaaatattttttggctagattttgttgagcttatacttttagaatgttaccagtttctcattttataactagtcactcatatctataaagaattaagtatgaaatgcctccatttgttatcaaattaattatgctcttgtttctaatacctgaagctaccaatatattctattaaagcattttgacaatataatttcaggaaatatatcttccccattttccatatggagaagaaaatcacttatacagagtcagacttctttcttccagaatactgggagaaaagttcataatgcctagcccctgagtgtagtttccagtggcagagattccagtcactggggatgtatcacatgttgttgttcaggaataggggttctattggagtttggcaatcaactgccagtattcctctctctctatatataacacatctatccccctttccagtcaaaactatatgtgatatctgtcagaccctcaactgtttcatttaactgccccttaggtatcccagtattctcttgaaattacactttatgtttgagtcagggctgagaatagacaccagatctcttacctttctgtctagtgagtctactaaggacaccaattcatttggaggttgggaatactttcaacaaatcttgtagacattattggacattaataatctagccttgtacctctagtctcatggttctcaaacttgagagtgcatcacctggagggcttattgaagcccagaatgctgagcctcactctcaaagtttctgattcagtagacctggatgaaggctcaagaattagcatttctaattagtagccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctcttggtttccctggacagaaaggggaaaaaggacaagctggtgcaactggtcccaaaggattaccagtaagttttgagtatattataaaacaaaaagaagtagaaggaaggcattttacacattgattttcaattattcatatatatacacacatatacaatttaatttttccattaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtaagtttactgtgttttgttttaaacttggtgcttaaaaacagaaatttattatgttttggctactcatggcttcctttcccgagaggtgtgtttccctggccgtttatatttgaactcttcagagcatcttagcaagggatcacaatggtttttataagggggtttctttttaaatcttttctaactgtttcattgttactgttaattttgctctttttaagtacatgatacataatgcaaagtttaataaatagttataacagaagcacacaggtagctaccacacacatcaaaaaatagaatgttaccagcatcctagaaacccctaaccttttctccctgtcatttcctaatcacaatccccttcctcctgtctgctgtcttgacttttacatagttttcttccattacccctctgttttatgacctctgtatgcatttttaaacagagtattttaattttgtttctttttgaacttcatgttaaaggaatcatagggtaagtgttttttatattaacttttcgtgtggctatagtgtattcatttttattgctatatagtatttcattgtatgtatgtttatgtgtgtgtgtgtgtgtgtgttacagttgattgatccattctatggttaatggttaattgggttatttacagttcaggtctattatgaataatgcttctgtttacagtcatatagatagatagctaggtagatagatagatccctatatctccttgtgttcatgtgctcacacttctctagggcaagagttggcacactacagaactacagtccatggaccacatccagcctaccacctgttataaataaaagttttatgtgaacacttccacaaccattcacttttgtctgtggttgtttttgcactacaactgaagagttgagtagttgctacagagactggatggtccacaaagcctaaagtatttactctggtcctttacacaaaaggcttaccaatacctgggctagggtatgtatttaagattagcattttcaaagcataggataagtgcatcttccacttgactggataattacaaactctatccagaccaattgtaccaatttttactaccacaagcagtgttgaatattttatgttgatttacatccttggaaacaatttgtattgtcggacttttacacttttgccaatctgttgagtgtgatattttgcatttctctgattaaagtttagcaccttttcatgtgtttattggtcatttgaatttgcttttgtgaaatgcctaatcaagtactttgaccaattttatattggattatttctttttttattgatttagaggagttctttatatattctgtgcattagttcttagttacctatgtattttgcgaaaagaaatctttacctactgtggcttgccatttttactctttgtttggtgtcttcaatgagcagaaaacaactttcacatcatcaaaattatcaatcttttctctcatggttagtgctttttgtgtcatgtttaggaaatcttttttttcttgagccaatttcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggctgagaaatcccacagtaggccacctgtaagttgaagaactagggaagccagtagcttggctcagtcctagtctgaatgcctgagaacctgagtggctgcttagtacaagtcccagagtctgaaagccagagaacctggagttgtgatgtccaagggtaggagaggatgggtgtaccagtttcaaaagagagagagcagagaattcacctttttttctgcctttttgttgtatccggtccctcagctgattggatggtacccacacacattgggtgagggtggatcatccttattcgtttcactgattcaaatgtcagtttctttcggaaacagcctcacagacatatctagaaataatgctttaccagcgatctcagtatctcttaatctagtcatgttgaaacctaaaattaaccattatacatcttgaatcatggaagtccttaaggctgtcatatcctttttctttttgaaattctatccttctgttttatatatttcttgaatatatagtggaagattgtttttcttgtgaatttttgttagtttacattttcaaaagattgctgataattttcttttttgtttttaattaaaaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagatgtgtagccaagtaatgttttatgctaaataatattttcttgatttattgaaatttttagggcttatgcttcagttctgctttattcctcacagaatttattctcacaaatggcaagagcacacagtggtctgaggacagttcttaaatatatctttactcatttatacaaaatgctttcaaaagtatcaggtttgattttatgtgtgtatgtatctataatatctgcagttatttttagatcatttccaaaattatatggtaggccctttgtcatactacatccagatataagcagaagaaaagttcttgggcatttttgtgtgggattcattccttacaatttagttctatcttattatataatagccctcattttcttcagaaaagcatatgttccacatacattagctctatgtgaaaataaaaggaatgtaagatgattgagaggattgtaaggcttaatcctaagtagtagaatgtcattgtgcttttgacatcttactgttgtcactaagcatgagtagaatgtgggtttgggaatttgaatatctttcttaaagtgcctttcctttggtggttaaaaaatgacttatcattttacaggctttcctggaattccaggacctccaggagcacctgggacacctggaagaattggtctagaaggccctcctgggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaaaaaaaaaacctaatttctgtacctacttttgaatgcccagttctttgattagagaatacaggcataccttggagatattgcaggtttagttccagaccaccacaataaagtgaatatcaaaataaagtgaatcacacaactttttttgtttcccactacatataaaggttatgtttacactatactgtagtctttaaagtgtgcgatagcattaggtctaaaaaaaaccatatgcataccttaattaaaaatactttattgctaaaaaattttagcaatcatctaagcttgcagcaagttataatctttatgctgggggagggttttgactcaatattgatggctgcccactgatcagggtgatggttgctgaaggttgggtggctgtggccatttttttaaataagacaacaatgaagtttgccacatcaattgactcttcctttcagaaaagatttctctgcagcatgtggtgctgtttgatggtattttacccacagtagaacctctttcaaaattggagtgagtcttctcagaccctgctgctgctttatcaactaagtttatataatattctaagtcctttagtgtcatttcaacactgttcccagcatcttcaccagggtagattccatctctagaaatcacttttgctcataagaagcaactgctcatctgttctacttttattataagattgcagcaattcattcacatcttcattctctacttataattgttgttctcttgctacttccaccatatttgcagttacttactccattgaagtcttgaaaccctcaaagtcatctgtgagagttagaattaacttcttccaaactcctgttaatattgatgttttgacctcttctaatgaatcctgaattttcttcatgacatctagaatgaaacccttttcagaaggtttccaatttgttttgccagatccataagaagaatcactatttatgacagctatacattacacaatgtgtttcttaaataataagacttgaaaattaaaagcactctttgatccatgggctgcagaatgggtattgtgttagcagccatgaaaagaacattcatctctttgtacatcaccatcagagctcttgggtgactaggtgcattgtaaatgagcagtaaaattttgaaaggaatcttttcttctgaggagtaggtctcaacagtgggcttaaaatagccagtacactatgctttaaatacatctgctgtcatccaggctttattgttccacttatagagcacaggcagagtagatataccataattcgtaaggccctagaatttttagaatggtacataagcattggtttcaacttaaagtcagcagctgcattagtccctaaaaatagagtcagcctgccttttgaagctttgaaaccagtaatttacttatcttctctagctatgaaagtcctatgagcattttattccaatagaaggctgtttcatcaacatggaaaatctgttgtttagtgtagtcactttcatcaatgatcttagctagaacttgctgcagcttctatatcaaaacttgctgcttcaccttgcacttttatgatgtggagacagcttcttcccttaaacctcacgaaccagcttctgctagcttccaacttttcttctgcagcttcttcacctctcagtcttcagataattgaagttagggccttgctctggattaggtttttgcttaagggaatgttatggctggtttgatcttctgtccagatcactcaaactttctccatatcagcaatagggctgttttactttcttctcattcgtgtgttcactggagtagcacttttaatttccttaaataacttttccttcacattcacaacttggctaactgtttagtgcaagagacctagccttcaacctaccttagcttttgacatgccttcctcactaagtttaattatttccagcttttgattttaagtgagagacatgtgactctttctttcacttgaacacttagaggccattgttgtgttattaattggcctaatttcaatattgttatgtctcaaggaatagaaagacctgtggagagggagagagatgcggggaaaatggctgatcagtggagcagtcagacatttacaacatttttttattaagttcaccatcttatacaggcacagtttatggtaccccaaaacaattatgtggtaacatcagtgatcacatatcaccataacagatataataataattaaaaagtttggaatattgtgacaattaccaaaatgtgacacagagacaaaaagtgagcacatgctataggaaaaattgcgctgatagacctgctcaatgtagggttgccacataccttcaatttgtaaaaagtgcagtgtctgcacagcacaacaaaatgatgcacaataaaataaggtatgcctgtacgatggtctgctccctctgtgcatctctatagagtcatcatcccatgtcatctctgttcatgcctgtgtgatgattggttgaaatggtgttgaatatcatttccagaccttgtatactgttgttctctgtcccaattccattacagatacataatgcaaatcactgcaattgacttagtaatactaataataaataatactgtgtttgagttacttttcattccttttattatttcttatctaatgttaagctttcctgagtcaaccttcagcaaagagctgctgtggcatgtaattatcgtgactatttttatatattttatctctgcgtcattgatttaaacctcctgtgttttgtaattattacttatttttcatgggaaaaacagttaacccgtgacaccagttctcatgagaaaaccacttctctattggttgattctctttattatgaacattttcaaatgaaaataaaagtaaaatgaataatacaatgagctttcacatatccatcacccagattcaaaattattatgattttataacatttgcttcatctagtcctttttactttgcttaaatattttacccaaatctcaacacagtatcatttcacttataaatgcatcagcactcatctctaaataaattgacattttatacaaaaaccacaatgttgttatcatacttagtaaaattaaaaataattgtttagtattatctaatactcagcctataatcatatttccctacaagggtagtctgttctttaatctcatgctctctcagttttttttttttatcctgaaaccagtccaaatcatctaatttgttttactaaaccctgtttccaatccttccatatgttttctccaacataccaattactttttatttaattatcttctcctctccccccatggaaggaaaagtattgtcttgtattttcggcattaaattctctgtggcaaacaataaggacagaaaagtcatgggagtttttgttgtgttttgtcatgtgtatgctcaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtatggaggctgtcactgcatctcaacttgcttttaacttttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattttattatgtgactgtatcatggatacctgggttgtgtcaagtttttggctactatgagtgaagctgttaaagacattttttacaattcttttttatggatatgtgatttcattttgcttcagtaaacaactaagagcagatttgttggatcataagtggatgcttagttgtactagaaactactagacctttttccaaaatggtgataccattttaaatttacaccaaagtggttcagaaatttgcattgttccacattttctcaaagtttggaatgttggtaggtgtgtggtagcatcatattgtgattttaatttacgtttccctgatgactaatgatgttgagttcttttttatgtacttgtgagctacttacatattcaaatattttgtctattttgaaagatggtttgtttctcactttattattaagttggaagtgttatttctatgtcctgcatactggccctttcctagatatatgtttattagcattttagccctggctggctgacctgttcatttccttactgtattttgatggataaaagttttaattttattgaagtttcatttatcaattttttcttatatgattataattttctgtgtcttgtctaagaaacatttgcctgccccaaagttgccaaggtattctatgttttattttataagctttatagttttagtttctatgtttaaaactattacacatgtcaaataatttttgttcagcatcatttgtttaaaataatcccctctctattggattactttgggatctgtgtcagatcaaataataatatatgtgttgatctacttctgtgctgtcaatcctgttttatttatttattttgctgtcattaagccagtaccacactgtttatattactgtagctttatagtaagactcgaagtcaggtaatgtaacccaccaactttattcttaaaaaaaaaaaaaacacatttctttggctatattaggtcctttgcctttactctcagagtggtttaaattgtatgtctcttactgtgagtgagattggccatccttttatgtgttaagggccatatttttttttcttgttaactgccaatatcctttacccacttctctgttgtttcttctactcccttgattttgagttatctaataatgagaaggaatagaattagtaaagctgacttgcattttttttcctttgatttggaaggaacccgacttccctcgtcaatgttttggctcctagtgagtaatctgaacagggccatgcttctggaacatgttggattgatttctattaaagcagtaagacagcccaatccaattttaaccaggctagattgtattctgccagcaaaagccccagactagctcaatacaaactcttcttagataagctcttaaaaaaatacctttctgtttttgactaaacaattcaggccagctgtaaactgtaacactcaaagttacaagttgtgtttcccaccagttatctcccctagctgtagacctgtagcaacaaaaattgcagataaagatatttgaaatatgtggcaaacagtcttcctgtggaagttacccacttactgtattttgtttgtatatattcttgagacacagtggtagtgaagaaatgcattgaaggctatttaaacatgaatttaacaggtatttgcctaatctttggaaggaaattaggatatggcattcccatatcctcacaggagtaattctcaattattaaaagccgagtacagttctttaggtgctagaaaaataagtgtttgggatattctgccatgtaactccttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaaagagaaaaaaagatgattttggaagcattcagtttacctcatatattacttttgttcagggccttatctaaggtacctggagaggttttatatagatggtgacagttgaatttagacttaagggaaaggtgttccgggcagcaagaataacatccaaaggtattattgtgacaaatattgtgtgcttggaaatgttgaaagaaatacaaaagtatataatttatgctaacaacaaatctatatcaaacaaatatgacaaacaactgcatgcccatacatttgacaacttagattaaatggactaatttcttgaaagacataaattgttgaagctcactaaagaagaaataggcaatccaggaatctatttttttaaaaattgagttgtagttagaaacccaccaacaaagaaaactacaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcacaaaatttaactcccaatggatcacagacctaaatgtaaaacctaacattatcaaacttctggaacagaagcaggcaaactttttctgcaaagagctagagagtaaatattttagtctttatgggctacatatatggtctctgtcacatattcttttttaaacaaccctctaaaaatgtaaaaaccattcttagcatgtaggcagcacaaaaagaggcctataggccatatttagccatgggaagtactttgtcatcccttgttttagatgaagaagcataagagaaaactctgtgatcagatgttaggcaaaaacttgttagaataccaaaaagacaattcataaaagaaaaattggatatattggactttattaaaattaactgtattttcatatcatatatctgacaaaggacttataagcagaatatataatgaactctcaaaactcaataagaaaacaaacaaccaacttttaaaatatagttggaaaaatgagcaaacaatttgagtagataccttaccaaagaagacacccaaatgtctaataagcacatgtaaagatgctcagtataatttatcatctgggaaatgcaagttaaaaccacaatgggataccacttcataaatattagaattggccttttttcaaaaaggataactgacaataagtgctgctaaggatgcagagtaactcgaactctcatacattgctagttaatacacagaatggtgcagccactttgaaaaacagtttgacaatttcttatatagttaaacattgtctttgcacatgacacagcaattctactcccaagaaaaatgtgaagcttcacatagaaacccgtagaacagtgttcatagcagcttaattcataatcaccaataattgtaaacaccccaaatgtgcctcaaattgcaaaaagattaacaaaatgtacatattcatctgatagactaataaccagcagtaaaaagtaactactgatacacataacaacatgggtgaatctcaaatgcattgtattaagtgaaagaagacatattcaaaaggctacatactatatgattgcatttgtatgacattctgggaaagaaaaatctgtaagacataaaataaatcagtggttgccaggtaattgggatgtggggacgagttgactacagcgcacaggggcttttttgggtttatgaaaatgttctatgtcttgattttagtggtggttatatgactacatacctttgtcaaaactcatcaaagtgtacactaaaaagacagaattttagtacatgtaaaaattgtttaaagtgggagtgacagagggacagacagaagatggagagatggacagttaagtttctaatgtcaaagagatgttttactaatgaagggagaagcttgaacatgtttataagccatggccctgagttagtaaaaaggaaaatgttgaagttatctatcttaaaatataggtaacttgaaaatatattttaaacttatgaatatataactgtccacaatgagttacaagtagaaggaatatgtggtttgtaatcttttgtactttcttgtgaagttgatttaagtattgaagtagtgatcagcatatgttaaattataaggctgtaactattaatagattccctatcctttgctcttgatacttatgtgtacttttcttgctgaatgaatgcccagtttttcaagattcttgcttaatatgatatggttcccaaggactagtgactcaggtgttgcttttaatatttaaactgtatttatttcttaaaggtgatgttggaccaaatggacaacctggaccaatgggacctcctgggctgccaggaataggtgttcagggaccaccaggaccaccagggattcctgggccaataggtcaacctggtaagattagagtaaatgtgcattttgtagcactcataatatatacatttgttagctcatcaataaagtgaaacctacaaaacagtcttccagaagcagacttaaaaggcaatctatctatgtgtatgattttataaaagtggataagtacaagccacagcataaaagctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgttttttttttgttgttgttgttgtttttgttttgttttgttttgagacagagtttcactcttgttgcccaggctggagtgcaatgctgcagtctcagctcactgcaacctcctgggctcaaacgattctcctgcctcagcctccggagtagccaggattacatgcatgcaccaccacgcccggctaatttttgtatttttagtagagacagggtttcaccatgttgaccaggctggtctcgaactcctgacctcaggtgattcgcccgcctcggcctcccagagtgctgggattacaagagtgagccactgcgcccggcccctgctgttttacagaggtggataaaatgaacttatcactcctatggtgttttgtcatttgtttcagttccaaaaagtgcatgagtctttagaagcattttgaattcttaagtcacagctgagtgcgaataaaaaaaggaacaccattaatatgaatctaaacaaaatacaaatatgttaacacgtgtcacgctttttcagatttacctgataccttgtaatgttttattaatctaatgttctctctttctttctccctctgttatatgatatatctgacaaaggacttataaccagatataaatataatatatagataaatatatagatataaatataatatagatatagagatattgatttataaagtataaataggatgggcaggaagaaaagtaataatgctgaattaaacttcatctatttcttttgtaaatatatgtatagccatagaattcaagatattaatatgattcaacaaataaatgaaattaacaggaactagcatgaaaatttattgaattcactcttaatatagaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccatacaattcttgttattgtggggaaatttagcggaactttgggatttatattgacttcttcatcctggatcttaccaggatgtgtattcctgacagtattcatggaaaaaatctatgctatgggaggaagtatagtataatgtctgttattactactactaataataacgatgaagaaagaaatccttgcctagtgcatgcaagttgtttctccataatcatatgctaataatgattgatttatctatacccaacctgttgtagtataaaattaaattaatttttaaatttgaactaaactttaggagcttaaattccaaaaagattatttaaatcattaagtcagagataaacaattgaaaagctgacctttaccaaaaggtaatacttttgtgaatgtaaatattttattatgtcattattggcaaatacatttcatttatagaataagctatatgaacatctaagcaaatgcctaaaataagttttttcactcatttctaatatatgatagcagtgaatcgaggtctaataacttctatttgtagagttttatgttctaatttttaaatgcttagtttttttttccctaacctaatgaaactttttgcaacttacttctgcttgggtggcccaacttgctgctgaactgtaattccctgcctcttgaacatcaggtgtaccaggtactgtagttcttcctcaaaagccatatcttaaagtaaagctttaaacatggaaaacaaacatttctccagatttaagtctttggtttatttcccttattttatagaactgctctcttggagcacgtttcaaaagataaattatttatattgaaaacccaactattaaaaatctttgtgagctataatataacaatagatagtgatccatataaagctataatcatgttcactgttaggcatcatatcatctttcacaaatatgatataaaaatctctctctcctttttatagtcttttactgtaaaatggcagcattggaactatcgctactttgccaactgagtgtaattctctaatcttcaaagtggattttgtcagtttagggccatgctgaaatatgacataaaacagatcttaaaaccctagcatcttactctctacaaaaataatcaccactgagtcttcaacaataaatttagatcttattgttgaaaggagacttggaatgatcatctggctcaacccctagtttccaattggttatggcataatccccatttagcagatgaggatcaacattaagtgactcacgtaagtcgcacagctggtaggctttggagtgggaagttacatagtatttttagtgtaattcttttcccataaacatactcttttttaaccaccttgcttttgggggaaaatcagccttacagaaacttactaaggttaaatattttttgctgtgtcattttttttctgtaaaatcttggttggagaaacaaaagatgacaaaaaatactaatagtaacatattattaatgtattattaaaacaatgtgcaaaacaaaggtaaaatacaatttaagaagtccacttaagtgacttattcagtaatcaataattttgggagctcatagagatgtgtactaataatttataatacattagaacaatgcaaatgtaagtgtgttcaatagaccagtgtcaaataatctatcagtctgcaataggattaatacaaatgttgagaataagcatttagaaacttttatagcaatttgatagtgtaattgtatctgttgaatataataaccaaaaaggtaggcttttattttgcatctttggctttttattcagttttagtaattttcattgtattttataaaaaatattagtctgtgattaactaggaattaagaaaagattggccttttgccagaaataatttgagaagcactgtcttagagcaatctgcttgaaaatcctaaagcttgattgttcagttattttgtgtgcatgatgtcaaaagtatctctaactcactcttaggtctgttatctacagggttctatcacttgtttactagaaatataaccagatacatcttttaaaactgcttcagtacttattaatattgatattgtattaactaggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaatttgtttaaagttttctctgatttggattaaggaaattaaaactaatacgactctggtagataattcccatgttacacttttctagattgacgtgatcccttaaggatgagcattaaatatctatgactgcaggaagctcactttgctattttcactgcacatttttctctgtgagagttccagttatatattactgtataacaaacaaccccaaaacttaatgattttaaccaaccttttaattttgctgaagattttgcagctctagaattaagggatgacttgactggttcatttatctctaacccacgttgccccagctggagtgtttgggactgaaaggtctacttctaagatggcacttctctgacatctgggtgttcattagctcacatgtcatctcatcgtccatggtacctcttcgcatggcttaggctcctcacattatggtagtataaggctggttgctccccttccatggcagctggcttccaacagagagaatcccacaagagaaaagtgagtgtttcaggaactacaggtagaagcggcaagatttcttttctttcgctctctctctccctttttttctttctttttccctttctttctctttctttctcttttctttctttcttttctttctttctctcttctctctttctttctttccttttcttctttctttctttcctctctttctttctctctctccttccttccttctttttttttttttgagacagggtctcactctgtcacccagactggagtgcagtgggacatgatcacagcccactgcagcctcaaacccctgggctcaagccatcttcctgcctcagcctcctcccaagtagctgggactacaagcacataccaccacacacagctattttttttttctttttttctttgtagtgatggagtctcactatgttgcccaggctgctctcaaattcctgtcctcgagcaatcctcccacctcaacctcccaaagtgctaggattataggcatgagccactgtgactggcctgtaagacttcttttgatctaggcttgggagtcacacaatgtcatttagtcaagtgtgaggtacagaatcaaccctagttccaggtgagggttttatagtagattgtacatactgggacatatggttcactggggggccatctttagagattagctaccagactgagtctccttattcatgggtatcagcagtagtgggcactatggtcaaaaagtctaaaacttaacagtgccttacgtccaaccctcaatagttttctggttgacatcttaaaacttactttttatgttccctaagtcaaagaaaggcaaacattacttattgatattcttcaaaggtaccaaaggtgaaatgggtatgatgggacctccaggcccaccaggacctttgggaattcctggcaggagtggtgtacctggtcttaaaggtaataatcaaggtttgctgccagacgtatgtgagagggaaaattaaatatagctttatgtcagtacagaatatttttgttgactgttttaaaatgagcaatggttacttgtgtttctatgtaacatggcatttaaataggtcttgttttcaatttggttacgtgcttagtttggataccatgatacatggtaaatgcttagctcaaaataacaaaatataaggattaagcattaatttttttgtttgtcttttgagacggagtctcgctctgttgcccaggctggagtgcaatggtgcgatctcagctcactccaaattccatctcctgggttcacactattctcctgcctcagcctcccaagtagctgggagtacaggcgcctgccaccacgcccggctaatatttttttgtatttttaatagagaaggattttcaccatgttagcaaggatggtctcgatctcctgacctcgtgatctgcccacctcagcctcccaaagtgctgggattacaggcttgagccaccgtgcccgtctggattaagcattaatttttttatagtcggcctctatcgttgtcaaggaattccagatggagggattgttatctgagtataaaaatgtgtatgcactcaagtaattcatagagtacatccaaggtgcataaatgttttgagtggccagtggcctactcaactatgaaacatatcaataatctttatatgcattaatctttgatggataaaattgatatattgtgttttcacacacattgattttaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtgagtgaatgaatttatttatgaatatttttcctgatatatctgaagtttaatttttaaatagcatgaaaagtgacttataatacagaattcaccaacaaaggcacttaaatgcatcaaattttggtaacaaatattaattttcacttcattcatactgtttcaccagtcaacttttgtttgagtattttctttatagtttacctatcacgagctttacctaaccactagtgaggttttaaaatagacttaggcagtcaactactagctttctaaaaagtaatacaggaaaaggatatatagccacaattacttgaaaaacaaatttcagtgtttaggaaatttgctagtcctttcatttttttctccttgataccagataaggacgaatggtacattgctgtactgcagtgttttgatatccatatcatacttggctttcaaatacagttcaccgttattctactttggcagaataaacaagtattggactatgaacagccaagttcagcccgaggggaagtcactgaaagtagatctagggaacaattgtgtccatatagttattttattagaaacaaatacagcgtaaaatattacgtggggttttcaataaaaaaaaaaccttttttatagaagtataacatgttcataacaaaacatcataaaatatggataagcataaatcattatataaagcacttggcacccaatctatatagaatagcctttcaagcaatatggaatgttaaaactagctatatctgtgtatctgcagcttatagtaaagtttgtggctctttgtacgttctatccatcaatattgtcagttcatgtgtatgtgtatgtgtatgtgagtgtacacagatgttaacagtttccctatgagcaggatttggtgggatttttcctcaaaaaagaattaaaaatattaatgcagtgttgtatatagtcaagaaagaggcagggtcacctaattttttatggaatgactttcttggcttaccccttgcaaggcttcttttctgtttcaattatgcttcctgtataataggggcagtaaactatacttgacctctactataggcttattaaatatagtcagaatctaagagataacctagagattatctgtccttattccttatttcttcatttccattgtaagaaaatgaggcccaaaataggaaagtgatttcactactgagtgctctgaatttcttgatggtaggtaactaaaaagtgaaggattttcgtgtgagtccagtgctaatagctcatactatatcagaatatcaccagttcctctaattcacttatagtttaacacttgagtagcttgctttgccaaagttatttcatggatgaataatatcatcctaacttgcctcttctactcattcttggaaggtatacctggagtttcagggccaaaaggttatcagggtttgcctggagacccagggcaacctggactgagtggacaacctggattaccaggaccaccaggtaagtgtgataggccatttgtagcaattgcttagctgacactgaattctggataaataattatgtgtttgtcatgtttgaagatgctgtggatttgatcatggtaataagcttgggtagctactgaaatatggagctcactttcggcaaaaatattgccctttggctctagttttagcagtccagattttataggatattttgccttgattattcagtttcttctttttgtggcagcagggtatacacagaatcagaaatgtgatccaaataaggtgttgtgttttgttacatacattgcaaaatatataaatgagacaattatctcatgaaggcctgaagaattcatcttgtcctgcttttttttctttctgcctttagacaagtcagtcattaaaccatgtaaaacagatggctattgattctatttttttaaatttctaggcatgaaaatttcacaaattctcttggtagtcagttacagcattaatcactcttagagtcgacatttttttaaatcctactaaaactctttcttgtttcttcttcagccactttcttttagtttgtttcctaaggaaataaagagcagcagtccccattcttacaaagtcccttaagttcagttatttgcgctagactccatactacatggccttgatatagttgggaagagaaactcccttcctatctctccctcacatcttctgcattctcttttccaagttagaagtcattgtaaaggaaaaaaataaaataaaaaaagtttaaggcaatactgtggtcctaggaaaaaacccagatgacatcacagagctcaagcacctatgtgctaggaaaaatgtacaaacagagcagccatgcctgttcaggtcactgcccagtatctgtccaccacctctaatctctccctggcctaatgtactaaactatatcataacaggttaccaccttttctctttctgatctcatataatcacgctctacatgagaagcccatctctgaatcttttaaaaaacagacttattatattggatttatctgtgaaaatacattaagggtagttgtacacatacagcaaatagcacttcaggtgattggaattgttttagggaaagaaacaaggtgttctggtaactttttaatttttttttaaagttatattaggagacctctattactatggttatattgtaatatgttcccaaggagatgttttatgttgggttctatctgtggaccttaatcatatattcagatttaatccatctaatcccatgtttgcattttaatgactatccattcccatgaaaccagacaaccccaatattgctacattgtcttaattttaccaatttgacctttctaggtcccaaaggtaaccctggtctccctggacagccaggtcttataggacctcctggacttaaaggaaccatcggtgatatgggttttccaggtgagtgatgaaaatcttccaaatatttagtcccattaatgaaaggtggttcaatatctctttttttgtcagaaaagaggctggtgttgatagaatcagactgaaacgatatctgaggtaatcagtgggtagtgttctcttgttacacaaatatttaaaatgggaattaagggacaaaattgtagaaaccttaaaagttataattcacaaacatcttttctccagctatacccccttttatttaaacttcctttaaaagtaggcttttatataattgtgtttgtgaggctcattattatctaactcagagtttgcggagctttttaaaaatctttttgctttgtcatatgcatcttagataatccacaagtaaagcatattttgtaaaatattatatatcacatattttcaacagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaagggtaagagtgaaaatcttcttcatgccccatcctctttttaccattcctttcctcatagaggcccactgtcaatagttgatatataaatttgaattccttgttctatacatttatatatatgcatatagagtttggggttttttctacacattgtgtatatgtagaatcatggtatgcatgctactctgtaccttgctttatcacttacccctttttatttcttttttcaatatatcttagacaattttctttgtcgtcatacattatatctgtggacatatatgtagttatttatactgtatagtttcataaaagtgtaattgttggatcaaaggataagtgcatttaattttttggctttttaaaacacttataataatgtaacatatgaacttgattttaaaatacaaccagtatgaaaagatgtaaaataaaaagtctcctttttacatgtttgcaaaccccaaatccccagttcttcttctccagggtaaccacttttagtagtttctctcatattcttcaagaaaggttttctaaatgcatttatatgcatgcatatatggtatttcatcaattttaatactcattttttacatccaaaatatctaatattggaatgcatcttattatgatggaaagcatattacaattaaaattgtaaatatttttccccaattattgatacatgaaatgatgctggaccttccaaatgtagatgttttctcatattttaattaatatatacaaaattatactatacatctgctctgtacctagctgtcatcacatagtaaatcttgacaaactttctttatcagcctataaatgtatgccttattattttttataattatatagtatttttatgggggttcactataaataatttaacctattatgaatatgaaaattatttctaggttcatgattacaaacatattttgcactgaagattcttatccatattcttacatacatatcttaagaatctttggtaaatatcaccatagaataaattctgagcagttgctagaacccagcatatatgtgcctttttaatatctatatttactgccaaattttccaattaagtaactctacacctttatactttcatgattagtataagtgattttctcctcattctacagatattgggtgttatcaatttaaaaaattttaccaatctaatgggtgaaaagtagtgtatcattattgtttatatttgaattttcctgattacaagtggggtttcagatgtttttaactctttcgtaaattgtctatttatactctttgcctcactgttttacgagaggacttggttatgtatttcatactgatttgtaaaagtacattataaatgtgaagatgcatccactgtctgttatatttgttgcaaatattttctcccagtcagttgtttgtcttatagcatgtttactgtgcatttcgttatgtagatgtttgaaatttttacataggcaaattatgtactcatttatttattcattcacaaaatatctgttgagtatgtatgatttaccaggtactgttttaggtgctggagatacagcctgaacaaaacagacaaacttttactgccttcaaggagcttatatttagtcaaggagtcatacaataaacaaaataaataagtctgtattatgttagaatgtgataaatctcatgatgaaaagtaaagcaagacttgatgataggaatttctggaaattgttatattttgaaataggttactaagggaaagtctctctgataagatagagcagtgaccacactgcagtaagagagtaagtcatacaaaaaccctgaggtgtgagcatacctgacatgtttgagaaacataaatgagtccagtgtgttaaacagaatgagtgagttgaaacaaagtaggagatgagattagattggtaatgggggaaagattatatagtgccttataggtcatcatagtaggggcttttactcctgagtgaatcggggagcaaatggaaagagttaacatgattgtacattaattttaagaactatcacagcacctgttttggaaacagatcatagaggagcaaggatggaaagcagggaaaccagttatggtgatatttaaataatgcaggctaatgatgttgatggcttggatcaagatagtggcaggggaagtgataagaaatgggcagattttgaatatataatatatgtcaagccaggaagatttgtgtatggaatatgagagagaggaatcaagaatgactccagtttttatcctgagcaaatagagtggagttgctatatgctgaaatacaaaaactttgaaaaaagcaggtttagtgagaaagatcaggagcatagttttttattttatttatttatttatttgttttattatactttaagttccagggtacatgtgcacaacgtgcaggtttgttacatatgtatacatgtgccgtattggtttgttgcacccattaactcatcatttacattaggtatttctcctaatgctatccctcccccattcccccaccccatgacagggtgtgtgatgtcccccgccctgtgtccaagtgttctcattgttcaattcccacctatgagtgagaacatgcggtgttcggttttctctccttgcgatagtttcctcagaatgatggtttccagcttcatccatgtccctacaaaggacatgagctcatcttttttatggctgcatagtattccatggtgtatatgtgccacattttctcaatccagtgtatcatggatggacatttgggttggttccaagtctttgctactgtgaatagtgccacaataaatatacatgtgcatgtgtctttatagcagcatgatttataatcctttgggtatatacccagtaatgggatggctgggtctaatggtatttctagttctagatccttgaggaatcaccacactgtcttccacaatggttgaactagtttacactcccaccaacagtgtaaaagcattcctatttatccacatcctctccagcacctgttgtttcctgacttcttaatgatcaccattctaactggtgtgagatggtatctcattgtggttttgatttgcatttctctgatggccagtgatgatgagcattttttcatgtatgtgttggctgcataaatgtcttttgagaagtgtctgttcatatcctttgcccacattttgatggggttgtttgattttttcttgtaaatttgtttaagttctttgtagattctggatattagccctttgtcagatgagtagattgcaaaaattttctcccattctgtgggttgcctgttcactctgatggtagtttcttttgctgtgcagaagctctttagtttaattagatcccatttgtctattttggcttttgttgccattgcttttggtgttttagtcatgaagcccttgcccatgcctatgtcctgaatggtattgcctaagttttcttctagggtttttatggttttatgttcaacatttaagtcttaatccatcttgaattaatttttgtataaggtgtgaggaagggatccagtttcagctttctacttatgactagccagttctcccagcatcatttattaaataggaaatactttctccatttcttgttttggtcaggtttgtcaaagatcagatggttgtagatgtgtggtgttatctctgaggcctctgttctgttccattggtctacatctctgttttggtacgagtaccatgctgttttggttactgtagccttgtagtagagtttgaagtcaggtagcatgatgcctccagctttgttcttttggcttaggattatcttgacaatgtgggctcttttttggttccatgtgaactttaaaatagttttttccaattctgtgaagaaagtcattggtagcttgatggggatggcattgaatctataaattaccttgggcagaatggccattttcacgatattgattcttcctatccatgagcatggaatgttcttctatttgtttgtgtcctctttcatttcgttgagcagtggtttgtagttctccttgaagaagtccttcacatcccttataagttgtattcctaggtattttattctttttgaagcaattgtgaatgggagttcactcattatttggctctctgcttgtctgttattggtgtataagaatgcttatgatacatctctagaactcttcaccccaatcaacagaatatacattcctctcagcaccacattgcacttattccaaaattgaacacatagttggaagtaaagcactcctcagcaaatgtaaaagaacagaaatcataacaaactgtctctcacaccacagtgcaatcaaattagaatttaggattaagaaactcactcaaaaccgcatgactacatggaaactgaacaacctgctcctaaatgactactgggtacataatgaaattaaggcagaaataaagattttctttgaaatcaatgaaaagaaagacaacattccagaatctctgggacacatttaaagcagtgtgtagagggaaatttatagcactaaatgcccacaagagaaagcaagaaagatctaaaatcgacaccctaacatcaattaaaagaaccagagaagcaagagcaaacaaattcaaaagctagcagaaggcaggaaataactaagatcagagcagaactgaagaaaatagagacacaaaaaacccttcaaaacatcaatgaatccaggagctggctttttgaaaacatcaacaacattgatagaccgctagcaagactagtaaagaagaaaagagagaagaatcaaatcgacaaaataaaaaatgataaaaggaatatcatcaccgatcccacagaaatacaaactaccatcagagaatactataaacacctctatgcaaataaactagaaaatctaggaagaaatggataaattcctcgacacatagactccccccaagactaaaccaggaagaagttgaatctctgaataggccaataacaggctctgaaattgaggcaataattaatagcctaccacccaaaagaagtccaggaccagatggattcacagccgaattctaccagagatacaaagaggagctggtaccattccttctgaaactattccaatccatagaaaaagagggaatcctccctaactcattttatgaggccggcatcatcctgatatcaaagcctggcagagacacaacaaaaaaaagagaattttagaccaatatccctgatgaacatcgatgcaaaaatcctcaataaaatactggcaaactgaatccagcagcagatcaaaaagcttatccaccaagatcaagttggcttcatccctgggatgcaaggctggttcaacatatgcaaataaataaacgtaatccatcacataaacaaaaccaaagacaaaaaccacatgattatctcaatagatggagaaaacaccttcgacaaaattcaacagcccttcatgctaaaaactcaataaactaggtattgatggaacgtatctcaaaataataagagctatttatgacaaacccacagccagtatcatactgaatgggcaaaaactggaagcattccctttgaaaactggcacaagacaggaatgccctctctcactactcctgttcaacatagtgttggaagttctggccagggcaatcaggcaggcgaaagaaataaagggtattcagttaggaaaagaggaagtcaaattgtccctgtttgcagatgacatgattgtatatttagaaaaccccaccgtctcagccccaaatctccttaagctgataagtaacttcagcaaagtctcaggagcatagttttttgattgtcaatattttgttgctgaaataggaaattcatcaattgagggggagagagaggaagaggtaaggaaggcttgaggcctgtcacatagattttaggattttttggaaaaaaagtcttctacttatgaagacttctatatcctgagattataaaaatagatttatatatttcttacaggattttcatggtttttttctgtacatttgcattttaatgcacctgagtatttctgtatgttgtatgaggtgagaaactaactttattttttttcccaaataaatatccagttgactgagcctcatttgttacaaactcaattctttattcactgatataaaattgtatttaaattttttttccaaatttgttcatgaatttttttttctggaatgagtgaattttaacattttactaatggaatcaaaattaccataataaattgtctctacatttttaatgggtgatagcagaaaaatatgttttaattggtaaatgtccaaagtatattcaactctacaagcaagaggttagcttttagttcttctgtgtgacctacaagtatatttcagtaagcaaattttacactaaatttagaaacttaacaaagatgatattgtggaaataatgtaaagtagtctgttgtttctttcagatggcattattataccttaaaatagtgacatgttgaaaaaataaaagtttttttagctcagttctattaggtacaggtgatctttgcttttgcacaaatttcagttatcattacttaacaccgatccacaacaacattgtttaaattttagttgctatgatatattaactcttccatttataaatcatcatctaaataagagatgtgcattacaatcagtggacagtaatttcacttctttcaaattctgtcactaattagtaaccatgcatctgttcagttcctgcactgacagcaaagcatttagttgtgtcacctccttgtctcccagtgataaagcaatgtgacattttacaaaaatggataatcaaaagagaaaattagccaacaaagaagaaagtgcaacaaaaaaaaaaaaaaaggaaagtgatagcactggaagtaaggtttgaatctaaagtaaatggggttatagaattaatagccaaccatagaattgtagacactgccaccatttgagagactctagatatgcagctaaggaacttagtgaaggcaaacttatcaacattaatgaggaaaggagcactgatgaaaaggatgaagatgtcacagaggaagtgttgccatcacaaatttcacattaaaggaactcttggagatattttacaagtttgaaagtataaaggttaacatgctggaagctgatctcagtttagaaacagtgagacaatttctgtgccaaggcatagaaaagatgtgtgctctgtattgtaagttatacgagaagaagggagacactgttcaaattactcttggtaacttttttacaatgaaataaatcactttatttttcaatgtttctaatgtttaaattagcatttaccaaataaatattggatttactattttttatttctttatacatgtgtatctgacattaaaacatattttaatgttttgataacatttttaaaggtcatagaataattacattttcccccattgattattaagatcactttacatgattttggtttgcagtttcatttttccagttccacactaccacgtgaaacaaagagtacccatattataaaggaagagaagaagaacagttttaggaaatataatggtatgattgagggaaaacaagcataagacaaatttctgtaattactgagttgttaagaaataggaatagtggtaaaatatcagataggtagtttgttttatggatgtcactgtttatgaaacagcagctctgttagtcaaaaagcatgattaataaagtatactgaaaaccccagacaaggagtcagtaggcagaaatttgagtcctgggtttgtgtacatgaccttgataagtcacttaattcttcagtgtcttcagtaccttgtccataaaaagtgggagaaaaaaaatcctactttttgtagttattgtgaggtttcaatgagattaaaacatgcttcataaaaaagaaaaaaaaggaaaaggaatgaaacactttgtaaattataaagcattctatacatagtatttctttttatctaaaatgaaagggctggagtagagggtgtctaagatatctggaattctcaaatataatgactctatggaactatatgaatctgtaatgctcttttaatatagtgtaattgttctaaccttcataactcctttttaaaatctaatcatactacagattcatccctttcataatcccagatggcttttatgctgaaattgacaagtgtatcctaaaattcatatggaagtgcaaggaacccagaatagtcaaagaaatcttgagaagaacagatttggaggactcactcttctggatttcaaaacttactacaactatgataccagcactgggtagacatagagactgatggaatagatagagtccagaaatacccatacatttttggtcaactgattttcaacgtaggtaccaaaacaatttaaagggagttaaggatagtcttttcaacaaatgatgctggaacatggatgcagctggaggctactatctatcctaagcaaattaatgcagaagcagaaaaccaaatagcacatgttctcacttaaagtttggaggtaagtattgggtatacacagatgcaaagatgggacaataaattctgggtattcccaaaaggggtaaggagtgggggaagtgttgacaaacctatggagtactatgttcactacttgggcaatgggaacattagaagcccaaacatcaacatcacataatatacccatgtaacacacctgcatacataacccctggatctaaaataaaaaacaaaacaaaaatcaaatcatgctgggaaaagaggatacctgtctgcaaaagaatgaatctggacccctatctcatactgtatacaaatattaactccaactggattactgacctaaatataagaactaaaccataaacatattaggataaaagatgactaaattcttgtgaccttgcattaggtaatggtttcttagctatgacactaaaagcacaaacaactaaaggaaaaataaattgggctatattaaaattcattaggtaatggtttcttagctatgacactaaaagcacaaacaactaaagaaaaaataaatggggctttattaaaatttaatgtgttttctgttgcaaatgataccatcaagaaagtgaaaagacagctcacgagatgaaagaaaatatttgcaaatcatatatgagataaaggatttgtatacagaatatataaagaattcttataattcaacggaaagcaaataactcagtttttaaaagtgcacaaagtgaattggacctaacaaacatatacaaaatattctatccaagaaaaatgcagaatatacatttttgcaactgcacatggaacattctccagaatagacaatatattagagcacaaagtaagtcttcatacacttaaaaagattaaaaccacacagcatatattttttaatcatgatggagtgaaattagaaatcaatggcagaaagtaaactggaaaatctactaatgcatgtaaattaaacaagacgctcttaaccaatgaggcaaagaagaaatcacgagggtagttagaaaatgtaatgtctttttttttttttttttttttttgacagagtcttattctgttacccaggttggagtgcagtggcgtgattgtggctcactgcaacctctgccttccaggctcaagcaattctcatgcctcagcctcctgagtagctgggattacagatacgcaccaccatgcttagctaattttttgtagagatggggttttgccatgttggacagttggtcttgaactcctgacctcaagcaatccaccctccttggcctcccgaagtgctgggattacaggcatgagccaccatgtctggcagaaaatataatgagacaaatgaaaatgaaaccacaacataccaaaacgtacaggatgtagtgaaagcaatgctaaatgggaaattaatagctgtaaatacttacattagagaagaaacatctcaaatcaaaaacctaactttacatcttaaagaactagaaaaagaaaaactaaatccaaaactagcagaaagaaagaaataataaagattagagcagagataaataaaatacagaactaaaaaaatcatagatgaagtcaacaaaactaaaagttgtttcttcaaaaagataacaaaatagaaaaagttttagctagcttgactacaagaaaaagagagaagactcaactaaaatcagaaataaaagaggagacattactaccaatcttacagaactaaaaatatatgagactgctatgaacaggtgtttgctaacaaattagataacctggatgaaatgggcaaattcctagaaagacacaatctaccaagactgaatcatagaagtagattatatgaatagacctaaagtgagtaagaagattgactcagtaatcaaaaaccttccaataaagaaaagctcaggaccagatggctacactggtgaattctaccaatctttttttttttttttgagacagggtctcgctatgttgcccatgctggatggagtgcagtggtgcagttacggctcactgcagccttgtccttgtgggctcaagtgatcttcagcctcccaaatattttccaaacaattaaagaaggattaacagcatttgttttcaaggtcttccaaaaaaattgaagaggagggaacacttccaaactcattatattatacctggattaccctgataccaaatccagacaaagacactacaataaaagaaagctacagaccaaaatcccttatgaatattgatgcaaaaaatccttaacaaaatactagcatactgaattcaacagcatattaaaaggattatatgccatggtcaagtgagattttttcctgggatgcaaggatagttcagcatacaaaaatcattagtgtaatacaccatcacactaacagaatgaaggagaaatcccacatgatcacttaattaatgcaaaaaaaagcatttgacaaaattcaacactgtttcatgattaaaaaaacacaccacaagctaggaatagaagcgaactatctacttattataaaggtcatatatgaaaaaacccacagctaacaatggtaaaagtctgaatgcttttcctctaagaccaagaagaagttaaggattcttaattttactacttcctttcaacatagtactggaattcctagccagaccaattaggcaagaaaaagaaataaaagtcatcttaattggaatggaagaagtaaaattatctttgttcagagatgatataatgctatgtagaaaactctacaaagataccatatatgcggaaaataggtagaactaataaacaaattcagcaaagattcaggataaaaaatcaacacacagcagtcagttttgaatgttttgatgcatcaacaatgaacattccaaaaaggaaattaagaaaattaaatttacagttgcatcaaaaagaataaaatacttaagaataaacctaaccaagaaggtggaagacttgtgctctgaagactacaaaatattgctaaaaggaattaaagaagacagaaataaatggaagatttaatactgttaaaatgtccatactacccaaagcaatacacagattcaatgcaacgcctatcaaaactccaatggcatttttttttccagaaacgaaaaacttagtctaattcacaaggaaatctcaagggaccccaactagccaaaacaattctaaaaaagaaccaggttggaggactcataataattttttattagaaaacatattacaaagttatagtaatcaaagcggtgtggtgctgacataaagacagcaaatagaccaatgtaatagatagaccagagataaaatctctggtctgtagttgaatgatctttgacaagggtgctcaatggggaaaggcgttcaacaaatgcatgctgggtaaaatgaatgtccatatgcagaagaatggagttgaaccattttcttacatcatatataaaattaattcaaaaaagaatgaagacctaaatgtaagacctaaaactataaaactcttagaagaaaacatgggacaacatgcctcatgacattagatttttttcaatgatttcttggatatgacaccgaaatcacaggcaacaaaagaaaaaatagattaattggacaacatcaaaatgttaagcttttgtgcatccaagaacactactaatagagtgaaaaggcaactcatgggatggaagaaaatatttgtaaattgtatatctggtaaaagattaatttccagaattttaaaaagaactcctacaagtcaataacaaaagccatcaaacaacccaattcagaaataagcaaatgacttgaatagacctttcttcaaagatgatatacaaatggcaaattagtacatgaaaagatggtcaacatcactaatcattagggaaatgcagtcaattctacagtgagataacacttcatacccattaagaaggctattatataaaaaacagtaaataacaagtgttggtgaggatgtggagaagttggaactctcctgtattgctagtaggaatgtaaaattgtgcagccactatggaaaacattatggcagttcttcaaaagtaaacacagaattatcatatgatctagcaatttcacttctggagacacatctaacataattgaaaacaaaaatgggacctcaaagagatgtttttgtagccatgcttctagcaacattattcacaagtcacaaggtggaagcatcccaaatgtccattgatagaggaatgtgtaataaaatgtggtatgcacacacaatagatattttttgaccttaaaatggaataatattctgatacatactacaatatggattaactttgaagccgttatgctaagtgaaataagccagttataaaaagacaaatattacatgaccccagttacataaggtacctagaacagtcaatttcatagagacagaaggtagaatggtaattgctcagggttgggggaggggaaaataaggagatattggccaaagggtacaaacatttagttagttataagatgaataaactctagggatcaaatgtacagcatgggcactatagtttaaaatattgtgttgtatacttgaaatttgttgagagtagatcttaattgctttcaccacacactgaaaaaaaaattgtaactcggtgaagtgctagatgtgttaactaatttcattgtggatatgagtataaggtttccgtttgggttgataaaaaaaattctggagatatatggtggtgatggttgcaaaaagtgtgaatgttgtttatgccacaggactatacccttaaaaataattaaaatggtaagatttatgttttgtatattttgatactctaaaaagccacataaaatgaaaatattaattagcttgatttaatcatttcacaatgtatacatgtatcataacatcacatcatactctataaatgtatatagtttttatcagttaaaaataaaatatttttaagtgaaaaaatgaacaaaggaattgaatagctatttctctaagaaagatgtacaaatggccagtatgtacatgaaaaggtgtttaacctcattagtcattatgaaaatgcaaatcaaaaccacattgagataccacttcacacttacttgagtaggcataataaagagagaaaataacaaatgttggcaaggatgtgaagaaattagaacccttttgcattgccagtgggaatgtaaaatgatgcagctgctgtgaaaaaatatttgacagtgcctcaaaaagttaaataaagagttatcatatggctcagcaattccactcctaggtattttcccaagagaaatgaagctgtatttctgcacagaaacttgtacttgaatactcacagcagccaaaagtgaagaaaacccaaatcacaagaatggctaaacaaaatgtgctatcccagagaaaattgaggagagtgaggatcatcatggtggacgggagacaggactggattacagctccaactcggacagacagagcagcatacagaggtacgcattgtgaatttagttccagatcaactgcaacaacaaaccagtaatcacaagaggatgcacagaccctctgaaggaagtggacttctcttgcaggacccaggagacaccccaaatactgtgagtgccccaaatatagaagtggaaagtggagatccttctctcccaaatacacaccgccactggagaaactggaggtctgtttgtgggagaagtttctgaccttacctggagctgagtccatttagagagccaagtgaaatacaggggtagaggaagcagcaggaaaggccctgggggcttgctgggtcaccaagcaggccattcctgcctggcaccacagggatccatcgggagggcagccagaggagtggaggaaagcaccacagggagaaggaagcctccagctgaactttgtaacaatttgaaccaggcgagaagcctcctggccagaactcgggggagggcatgaatccagtgtgcagactccacagatgggggaagaaccaagcccttttcttttgcagcttggtggcaggtagcctgcggcaagttctcaagccctgctcacccaccacctggaaacagacttggggctgttaataggggcacagtgggagtaagatcggccctttgatttgtgtgggagttgggtgaggcctgtgactgctggttttcccccacttctctgacaatctgcatgactcagcagaggcacccataatcctcctaggtacacaaccccattgatctgggaacctcacctccatcccccacagcagccacaataagacctgcccaaggagggtctgagctcagaggtccctagccctgcccccacctgatgagcctttcctatccaccctagtagctgaaaacaaagggcatataatcttgagatttctagggccccacctaccactggttcctctccatactaccacagctgatgctttctggaaagtgccacctcctggcaggaagccaaccagccccaaaatagagcattaaaccaccaaagataagaaccctcacagagtacatttcaccccctgccacctccactggaagaggtgctcgtacccatggctgagagaccatagacagttcacatcacaggactttgtgcagacaattctcagtagcagctgagagctgggtagactttctgggtggctaaaccaagaagagagacaataatcactgcagtgcccctcacaggaagccacatccataggaaaagggggagagtactacatcaagggaacatcccatgggacaaagggatcagaaaaacagacttcagccctagacctaccctgtgacaaagcctacccaaatgagaaggaaccagaaaaccaactctggtaatatgaaaaaacaaggctctttaacactccccctctccaaaaaaaaaaaaaaaaaaaaagtcacactagttcaccagcaatggatccaaaccaagaagaaatccctgatttacctgaaaaagaattcaggaggttacttattaagctaatcaaggaggcaccagagaaaggtgaagcccaatgtaaggaaatccaaaatatgatacaacaattggatggagaaatattaaaggaaatagatagcataaataaaaacaatcaaaacttcaggaaacaatgaacacacttatagaaatgcaaaatgctctggaaagtctcagcaatagaattgaacaagtagaagaaagaaattcagagctcaaagaataagaaaatataaacaaagcctccaagaagtctaagattatgttaaacaaccaaacctaagaataatcggtgtttctgaggaagaagagaaatctaaaagtttggaaaacatatttggggaataattaaggaaaacttccccagccttgctagagacctagacatccaaatacaagaagcacaaagaacacctgggaaattcatcacaaatcgatcattgcctagggacatcgtcatcaggttatctaaagataagatgaaggaaagaatcttaagagctgtgaggcaaaagcaccaggtaacctataaaggaaaacctgtcagatcaacagcagaattctcagcagaaaccctacaagcttgaagggattggggccctatcttcagcctcctcaaacaaaacaattatcagccaagaattttgtatccagtgaaactaagcatcatatattaaggaaagatacagttgttttcgcacaaacaaatgctgagagaattcgccactaccaagccaccacaacaagaactgaggaaaggagctctaaaacttgaaacaaatcctggaaacacataaaaacagaacctctttaaagcataaatcacataggacctacaaaacaaaactacaagttaaaaggcaaaaataaaaaccccaaaataccaaggtacgcaggcaacaaatagcatgatgaatgcaatggtacctcacatctgaatgctaacattgagtgtaaatggcctaaatgctccacttaaaagatatagaactacagaatggataagaactcaccaaccaatgatctgctgccttcaggagactcacctaacacataaggactcacataaacttaaaggagtggaaaaaagcctttcatgcaaatagacaccaaaagcgagcaagagtagctattgttctatcagacaaaataaactttaaagcaacaacagttaaaagagacaaagagggacattctataatgctaaagggccttgtccaacaggaaaatatcacaatcctaaatatatatgcacctaacactggagttcccaaatttataaaacaattactaatagacctaagaaatgagatagacagcaacacaataatactgaggaacttcaatcctctactgacagcactagacaggtcatcaaaacagaaagtcaacaaagaaacaatagatttaaactataccttggaacaaatggacttaacagatatatacagaacattccatccaacaaccacagaatacacattctattcaaaagcccacgaactttctccaagatagaccatatgataggccataaaagaagcctcaataaatttaagaacattgaaatcatgtcaagcactctcagaccacagtggaataaaactggaaatcaaatccaaaaggaatctgcaaatacatggaatttaaacaacttcctctcgggccgggcatggtggctcacgcctgtaatcccagcactttgagaggccagtttgggcagatcacctgaggtcaggagtttgagactagcctggccaacatggtgaaaccttatgtctactaaaattacaaaaaatagctggggatggtggcaggcacctgtaatcccagctactcaggaggccaaggcaggagaatcacttgaacccgggaggcggaggttgcagtgagccgagattatgccactgcactccagcctgggtgacagaacaagactccgtctccaaacaacaacaacaacaacaaaaaaaaaaaaaaaaaagaaagcaaagaaaagaaacatgctcctaaatgagcattgggtcaaaaatgaaatcaagatgaaaattaaaaaattgtttgaactgaacgataataatgatataacctatcaaagcctttgggatacagcaaaggtggtgcaaagaggaaagttcttagccctaaatgcctacatcaaaaagacgaaaagagcacaaactgacattccaaggtcacacctcaaggaactagagaatcaagaacaaatcaaacccaaacccagcagaagaaaggaagtcaccaagatcagggcagaactaaatgaaattgaaacaaaaaagaattgcaaaagataaatgaaacaaatagctgcttcttcaaaaacataaataaaattggtagaccattaccaagattaagaaaagaagagagaaaatccaaagaacatcattaagaaatgacacaggagatattacaactgacaccactgaaataaaaaagattattcaaggctactatgaacacctttatgtacataaactagaaaacctagaagagatggctaaattcctggaaaaataaaaccctcccatctttttttttttttacaattagtattaaaatgggaagcatatctagctcccagatcttggttacttttttttaaaattattattattatactttaagctttagggtacatgtgcacaatgtgcaggtttgttacatatgtatacatgtgccatgttggtgtgctgcacccattaactcgtcatttagcattaggtatatctcctaatgctctccttcccccctcccccgaccccacaacagtccctgatgtgtgatgttccccttcctgtgtccatgtgttctcactgttcaactcccacccatgaatgagaacatgcggtgtttggttttttgtccttgcgatagtttgctgagaatggtagtctccagcttcatccatgtccctacaaaggacatgaactcatcatttttaatggctgcatagtattccatggtgtatatgtgccacattttcttaatccagtctatcattgttggacatttgagttggttccaagtctttgctattgtgaatagtgccacaataaatatacatgtgcatgtgtctttatagcagcatgatttataatcctttggtatatacccagtaatgggatggctgggtctaatggtatttctagttctagaaccctgaggaattgccacactgacttccacaatggttgaactagtttacagtcccacctacagtgtaaaagtgttcgtatttctccacatcctctccagcacctgttgtttcctgattttttaatgatcgccattctaactggtgtgagatggtatctcattgtggttttgatttgcatttctctgatggccagtgaggataagcattttttcatgtgttttttggctgcataaatgtcttcttttgagaagtgtctgttcatatactttgcccactttttgatggggttgtttgtttttttcttgtaaatttgtttgagttcattgtagattctggatattagccctttgtcagatgagtagattgcaaaaattttctcccattctgtaggttgcctgttcactctgatagtagtttcttttgctgtgcagaagctctgtagtttaattagatcccatttgtcaattttggcttttgttgtcattgcttttggtgttttagacatgaagtccttgcccatgcctgtgtcctgaacagtattgcctaggttttcttctagggtttttatggttttacgtctaacatttaagtctttaatccatcttgaattaatttttgtataacgtgtaaggaaggtatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggtgactgtagccttgtagtatagtttgaagtcaggtagcgtgatgcctccatctttgttcttttggcttaggactgacttggtgatgcaggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttcttccatttgtttgtatgctcttttatttcattgagcagtggtttgtagttctccttgaagaggtccttcacatcccttgtaagttggattcctaggtattttattctctttgaagcaattgtgaatgggtcttcactcatgatttggctctctgtttgtctgttattggtgtataagaatgcttgtgatttttgcacatcgattttgtatcctgagactttgctgaagttgcttatcagcttaaggagatttggggctgagacgatggggttttctagatatacaatcctgtcatctgcaaatagggacaatttgacttcctcttgtcctaattgaataccctttattttcttctcctgcctgattgccctggacagaacttccaacactaagttgaataggagtggtgagagagggcatccctgtcttgtgccagttttcaaagggaatgcttccagtttttgcccattaagtatgatattggctgtgagtttgtcatagatagctcttattattttgagatacatcccatcaatacctaatttattgagagtttttagcatgaaggttgttgaattttgtcaaaggccttttctgcatctattgagataatcatgtggtttttgtctttggttctgtttatatgctggattacgtttattgatttgcgaatgttgaaccagccttgcatcccagggatgaagcccacttgatcatggtggataagctttttgatgtgttgctggatttggtttgccagtattttattgaggatttttgcatcaatgttcatcaaggatattggtctaaaattctctttttttgttgtgtctctaccaggctttggtatcaggatgatgctggcctcataaaatgagttagggaggattccctctttttctattgattggaataatttcagaaggaatggtgccagctcctccttgtacctctgaaaaccctcccatcttaaatcaggaagaattagataccctgaacagaccaacaacaagcagcaagcttgaaatggtaattaaaaaattaccaacaaaaaaaagtctaggaccagatgaattcacaacagaattctgccagacattcaaagaagaattggcaccagtacttttgacactattccacaagacagagaaagaaggagccctccctaattcattttaggaggccagcatcagcctaataccgagaccaaaaaagaaaactgcagactgatatccttgattaacatcgatgctaagatccttgacaaaataccagttaactgaatccaacagcgtatcaaaaagataatccaccatgatcaggtgggtttcataccaaggatgcagtgatggtttaacataggtaagtcaacaaatgtgatacaccacataaacagaattaaaaacaaaagtcacacgatcatttctatagatgcagaaaaaaaacattcaacaaaatccagcatcactttacaattaaaactctcagcgaagtcagcatacaagggacatacctcaatgtaataaaagctatctatgacaaacccacagccaacatagtactgaatggggaaaagttgaaagctttccctctgagaactggaacaagacaaggatgcccactctcaccactcctcttcaacatagtactggaagtcctagctagaacaatcagacaagagaaagaaaaaaagaacatccaaatcggtaaagaggaagtcaaactgtcactgtttgctgacaatatgatcgtttacctcaaaaaccctaaatactcctccagaaagctgctagaactgataaaagaattcaacaaagtttctggatacaagattaatgtacacaaatcagtagctcttctttacaccaacagtgaccaagcagagaatcaaatcaagaactcaaccccttttacaatagctgcaaaaaataaaataaaataaaataaaatacttgggaatagacctaaccaaggagacgaaagacctctctacaaggaagactacaaaacactgctgaaagaaatcatagacgacacaaacaaatggaaacacatcccatgctcatggatgggtagaatcaatattgtgaaaatgaccatactgccaaaagcagtctacaaatttgacacaatccccatcaacataccaccgtcattcttcacagaattagaaaagacaattctaaacttcatttggaaccaaaaaagtgcctgcatagccaaagcaagactaaacaaaaagaacaaatctggaggcatcacactacctgagttcaaactatactgttaaggccatagtcaccaaaacagcatggtactggtataaaaataggcacatagaccgatggaacagaatagataacccagaaatgaacccaaatgcttacagccaacggatcttagataaagcaaacaaaaacataaaatggggaaatgacacccttttcaacaaatggtgctcagttaattggctagtcacatgtaggagaatgaaactggattctcatctctcaccttatacaaaaatcaactcaagacggattaaggacttaaatctaagacctgaaactataaaaaatctagaagatatcattggaaaaatccttccagacattggcttaggcagagattttatgaccaagagcccaaacacaaatgcaataaaaacaagataaataattgggacttaattaaactaacgagcttttgcacagcaaaaggagcagtcagcagagtaaacagacaatccacagactgggagaaaatcttcacaatctgtacatctgacgaaggacgaatatccagactctacaacgaactcaaacaaatcagtaagaaaaaaaaacaaaaaacaaagaaacaatcccatctaaaagtaggctaaggacatgaatagacaattctcaaaagaagatatacaaatggccaaaaaacatatgaaaaaaaatgctcaacatcactaatgatcagggaactgcaaatcaaaaccgcaatgcaataccactttactcctgcaataatggccataatcaaaagatcaaaaaataggagatcttggtgtggatgcggtgatcagggaacacttctacactgctggtgggaatgtaaactagtacagctactctcgaaaagagtgtggagattccttaaagaactaaaagtagaactaccatttgatccagcaatcccactactgggtatctactcagaggaaaataagtcattatacaaaaaaaagataattgcacacgcatgtttatagcaacacaatttgcagttgcaaaattatggaaccaacccaaatgcccatcaatcaaagaactgataagctgtggtatatatacatatatacaatggaattctactcggccattaaaaggaataaattaatggcatttgcagcgacccggatgacattggagactattattctaagtgaagtaactcaggaatggaaaaccgaacattgtatgctctccctgatatgtgggagctaagctatgaggacgcaaaggcataagaatgatacaagggactttggggacttgtggggaagggtgggagtggggcaagggataaaagactgcaaatacggcacagtgtatactgcttgggtgatgggtgcaccaaaatctcacaaatcaccactaaagaacttactcatgtaaccaactaccacctgtaccccaataacttatggaaaaattaaaaaaaacaagcaaacaaaaaccaaagtgtgctatcccatacactggaatatcatttgacaattttaaaaaatgatgtactgatacatggtgtaaaatggatgaaccttgaaaacattatgctaagtgaaataagcaaggcacaaaatagccacatatcatatgatttcatttatatgaaatgtccagaataggcaaatctgtacaaagagaaggcagattaggttttgctacggcttggagggagtgagaatgagaaatgactgctaatgtgtacagtttcttttagggggaaatggaaaattttctaaaattagattgtgatgatggttgtacaatcctatgaagatactgaaaacattgaattgtacactttaagtggatgaattgtacggtatataaattatatctcaataaagttattttaaaacaatgcacattatagaaaatctacaaagtttctgctaataacatgtaatgtttttagttgtctttaaattactatctttattttaggatgtttttagttctagaatcctgagatttgatgaacaaatgggtgtgattttccccacaattaactttgggcacattttaagtaattgtatgtgctgtgattactagaactacacatgctgtgctagtatggaatagcatgatttatgaatcatattttttctttaatatttctttagtattttgagccacctgtaggctcattgagctgatgtttggagcaatttgctattatgcctatcttgcatggtaaagggtagtatagagctcattatcttttaagtttagttcatattctttttctctaagttcatcattaccttagacatactactattgaatttcatgtggcagctttggcctgctcaggcagccttgagccattatttatcagtttgttactgttagcttaacatttcactactgggaagagctaaataacatgcaaatttgaaggtcttattgtataattccttttctagataattaaaatgttaatggttgctcaatggatataaagcttcagttatgcaagatgagtaagttttacagatctgttatacaatatggtgcctacagttgacagtacagtattgttcaccttaaaatatgttaagaggatagatttcatgttaagtgctcttaccacaaccccccgacacaagaacatgaagaaatttttggaggtgatggatatgtgtagtactttgattgtgcttatggtatcatgggtatatgcatatatccaaactcataagtatgtatgcattatgtgcagttttatatataaattaataaagctttaaaaaagtatctctgcatgcacttttaaatttccctctgttaatattctgggtctaaaatagaacctatttatggttttgttcatggtctttaatctccaaatacagataaggttgtaaaaacattaacaattatgtgggaaccacaacttccaactgatggtctactcttgtaatattcttcttgcataaagcaagatatgatgtttactctttctcctcaaatattttccttttgttgtctttgtttcccccagtggcaatgcttctctagttttacagtggaatgcaagaacaaaagtgattagcttttttaccaatagatgtcttctgttctgtaaaatggggcaagcctgtaagtttattctgaattttgggttatagtatggaatggaggagaagatgctattactaggacatagtagagattggctatgatccaaataccattacattacaatttgaatcttaacaacaaagaagatatcaaattgactcctttttctacgtgatacaacacagtgaccttgaaagcagttctaatttcaggcttgtctttcagtgttactatagtcattagatagtttcacaatggtaaatgtgacttattaggtatgagatatttcattttcagaattatatcaaagcttgacattagaacagatgtagatatttgcagctgtgtgtccgagtcattcaaatcgcttctacctagaagtgcaaatagatttgaattttcctttctcagagtgatttgtgtccagtttgtagattttctgagcactgtcttctttatctcttcttgctttccttttttgaaattcattgttttcaatgagtttgtgtgtgaataataaaaggctagataaagcttaagctagcaaatttcagtgtttttttcagaagccctaataaaatatttactttatttttaaaaggtacttggtttgaaggagtagggccataagagtgattacagaaacggtattgagggcaagtgctggctgaacttagagactgggcttacagtagtccccccttaccaagggggatacattccaagaccccccgttggatgcctgaacctgtggataatacctaaccttttatatactgtgtggttttttttttccatctggtaacagagacagctactaagtgactcatagacaggtagtgtttatagcatggatatgctggggaaaggagtagttcaggtttcgagagggatggaatgggacaacatgacattttatcatgctacacaaaatggcgtgcaattaaaaacataaattatttatttctggaattttcaatattttcagaacacaggtgactgaaaccatggatagcaaaaccatggataaggaagaatttctgtacttttagaatttaatgtcctttagtatcataaataatccagagtttgccttctgcctttcagatttaccactagcagaatagtggaatttttttcttgttttttattttggtatatacatttaattttttcatgaataacaaaaagaatcatgatagtttattcaaaggtttcccatgtaaacacctaagatgggaccaattcaatccaaaatttaattgtatacctattatgtgcctcaaaatgaactagatatttgatttacaaggttcagaaaaaatgtatatattcccagcccaagattcttaatttttttaaataataggatgtaaggaaaaagagactttagtttaaagagctattaccataatgcagaaacatgagtcaaaaatagatcttactcacctgcaagtgtatgtactaagtgaggaaggaagtattcagtaggtgatgttgaacactagcaccttattgtaaaggtcctgatcttcatgcgcagagcagcaagccctgcagtagagatttagtgttaaggtatatgttgccattgttattgggaaaaacttgttttaattgtgaaagtgggtatgaattcttctaaggctctattggaaaaaaccttaatgcaaatattcattgagcaaaaacggttatacatatgtgaattatctcttacccaaaataaactttcaatgtaattaaggagttaagactgcatatatgaagccattgtagacatgacagagtaagaacctaccctaacctcttggggtaaactctctttgcccaggaatgcttcatggaagaagtaggatttttcttttcttgttaagaggcagggctccctctgtcatccaggctggcctgtagtggcatgatcacggctcaatatagccttgacctcataggctgaagccatcctcccacctcagcctcctgagtagctgggactacaggcatgcaccactacgcccagctgatcttttttattttttgtagagacagagtctccctttgttgcccaggctggtcttaaactcctgggctcaagcaatcctccagccttggcttcccaaagtgctacagccacaacactcagccagaagtgggattttagatgcccactgaagaattgatagacttccttatgttacagtgaaaatcacctttttcagtagaacgtactatagcttttggttgacatgtgtactggaagcaatgaattgcattatggcacagtaggaatgataaacacaggttctgaagtcagactgtttgaatccaaattcggatttcatcacttactagctccatcactataacatgggaataataacagtatctttctaatagggttgttaaggattaatgagaataatacatctacatactgtgagaatagtatgggctatgtagtctgattggctacatagctgattgtagtctggttcaaatcccagttctgccacttacaaaaaccttaggcacttggcttctcaagattcagttttctcatttataaatggagataatgaagcctaactcacagaactgttgtgatgattaaatgaagcaatttacatcaagtacttactggagtgcctgacatataataaaagctctataaataatgttatgttcttatacaatctaagtcgtgtagagacttcagtattatctttttattcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacagagcagcttcttatttggcagacttatattttatttcccaatcagatactgactagcaacataatctcaaactatctctttaccttttctttgcccaaatttatttctgtataaaatgagaatgaatattactgactcagcaggacaatatcctgtggacagagagactgtttggtggagcatttttcaatctttgactgctagccacaaatcacttaagaagccttgctatttttgtaggtaataatatatacttccaagcctctgcctgcagctgattatcttagaaaggtatgcccaggcacaccgctggtagcggttggtagaacaatcatacagttccttcaaatggcaaggattgagccattcaagtaagagattagcactatagtcaattatgtagcctgaactagattattatagtacctacttgtttagggttgaatttattttttgcttgttttgaattacacagtggcatggatgaatgaacctttcctttttattgaagtgaagcatacatgtagtaaagtacacttaagactatagatgagtttttacctaagtacatatatgtctttgaattgaccatatgtatcaagatataaaatagtttcttcatcccacgaagtttacccatgcccctacgccccccaaccccgaggtgaccactactatgacttccattaccatcagttaattttgcatgttattgaaattcatataaatgaaatcatacagtgatccttgtatctggcttttttcagtcatcattatgtgtaaaagattcatttattttgttacacgtgtcagtagtttgttctttatcattgctatgcaatattacattgaagaatgtaccacagtcaattacacattcccctgttgatggacttttgggttgtttccagtttgggactattatttttaaaaatgctattaacattcttttacatatcttttgataaacatatacattgatttctcttagacaaaaacttagtagtagaaatactgaatcacagggtaggtgtacattgaactttagtagatgctgccaaacagttttccaacatggtttgtaaattagtttcaacagccatgtatgaaatatccagttctccaattgcccatgtcctcaccatcactgggcagtgtcggtcttaattttatctgttttgatgagtatgtagaagcatctaattgaggtttgaatttacatattcctaatgaataatagtattaatcatctttttattatactattggccatttggatagcatctttttgaagtttcttcttaagtacttttgttcattttttattgaattgtctgtcctttttcaaatagattcagagtagttctttatatactcaagatatgagtcctttgtcagatacatatattgcaaatctattctctgtgcctcagatttgcctttcctaatgctgttgtgtaatgaacaaaagttgttaattttaataaaatccagtgtatcaatctttcctttcatgaatagtgatttttttatccaattcaataaatatttgtctatttgaggttatggaaataatcttctaatttttataacatgtttcatgtttaaactttcatatttggcttatgagctatctcaaataaaaatatttttacagtgtgaggtaggggtcaaggttcattttttttccagcacagttatccaattgctccctacactattttttttttaaagaacctaaacgcatccaataaattacagtcacacctttgtaagaaagccaaatgactgtacatgtggtgggctatttccagactctgtgtactgttccaatggtttattttctattgctgctttaacacaacactgaattactgtaaatttatattaagccttgaaaaatggtgggtaagtactagaaatttgtttcagttttttaaagcttgtcttggctattctaatttttttgcaggggaaatcagtttatcaatttccatttaaagtatctgtagggatttttaagtttgcaataactctctaggtaaggtagaggagaattgatattttgacagtattcaaccttccaatgaaatgaacatgttatctctccatttatgtaggtattgagtttgatttaacaatatgctgcactttttgttttgtaaatcttgaacatattttattaaatttatctctggaaatttgatgctttctggtgacatttaaatcatattgcttttcccagttcatcttccagttgtttcttggaagtatatggaaataattgacctaggaatattgaaataatatatgagaaaattgccaatttcactttttaaaattctgagtttgtataattttttgttttataaaatatcaccttagatatttttatttcttctttttcatttctttataccttttatttctttttcatgcttaattgcaccagttaggacctgtagtgcagtgtttaatagaagtggttatagtcaacatcattatcttttttctaaactcagagggacaatgattgctatttttccattaaatgtaatgttagtgccagggttttggcacatatattttactaaattaaggaaatccctttctagtcatactataatgggaatttttataaagaatggatgcgagttttatcaaattctttttctgaatctacagagatgataattgttttttctcctttactcttgatataatgaattacactgattgatattttatgtaaaaataaccctgtattcttgggataaactccaagatggtcatactgtacacattatctttaagtattgttggactggatttgctgttttttaaaaaattatacatggccatgagagagattggcctacgattttcttttctcatagtgtccttgtcaatgttttagtatagggatttgctggccttatgagctgggaagtattccctccttctctattttttctttaaatgtttcatagaattcaccagttaaggaatctggatctgtagttttctttgtagaaacctttttaaattacagattaaaagtctttaacagttatattactattcagatgatttatttttatgtcagtttaaatacattgtgtttttcaaggaaattgaccatttcatctaaattgtcaaattcattggcagaaagttgttgataatatccttgttttgtccctttaatttctgcagaatgtgtactgaagtctgcattttaataatgttttgatataagtaattttatttctttattttgatcaagcctctgaggcattcattaagctttattaattgttaaaaattaactttcgtaagtgattttctctaccatttgttttctattccattgatttctgcttatatctgtattatttcctaccttctaccttctatggatttaatcttgctgttctttttctagcttctttacctggaagcttaaatcatagatttttcagctttgtcttttctaatagatgtatttaaaaacttaaatttccatctaaggagtgctcaaaccatatcccagaaattttgttcttttgcgtttttcctttgatcattcggtttaagatattttctaattttcctgttgatttctgtttttctccatagattatttagaattgtgttgctcaacttacaaatatttgggggcttcccagatatctttatgttattgatttttaatttgattctattgtggccagaatacatattttgtatgatttaactattaatacttattgagacttatcatatggccaaatttagggtttatctgggtgaattttccttgtacccttgaaaataatttgtattctgcaatttgtgtattgcattataaatgtccattaggtcaggtttgttggtagagttgttaaaatcttgtgtattcttaccaacttcttgcctaattgttttatcaattactgagaggtaggtgttaaaatttccattatgattgtagagttttctatttctccttttctctctgtcaattttttgctgtatgtcttttgagatatttttattaggtatatataaattcaggaaacgtatgtcttcttgaagagttgacctttttatcattatgtaaagaccctctttattttcataatactcttttctttggatttttctttgtctgatatcagtatagatacatcagattctttatacttagtacagtataactttttctatataatttttatttttacctgtctgtacatttaaaatatgttttttaggaataaaatgcattcatatcttgcttcttttcgagtccaacaatctttcccgtttatttggagtgtttagttgatttatatttaatgtatattgttatgtttggattttagtcttccacattgctatttgttttatgctcctcctttgtccctggtttcctgttctgtttgggttcatcagatatgctgtggtattccattctatctcctctattggcttttaagctctccctctttctactatttttaaatgattgctccaaagatttcagtgtgcactcataatttaccacattctgcattaaattaatattatgtgacttcacatataatgtaagattcttacaacagtgtaattttatttacatataatgttcttttgtgtgattgtgtttatatatttcagatgattattatataggtaataaattttacaattaattgctattactattgctttaaacagcttcttctaaataatttagcatgagaaacaaaaccaattttcatatttaccaacatatttacatttctactcttctaccctcctgtgcagcagacttctagttggtatcattccctaaagcctgacgttcttccaccgtcatttattgtaaaatgattttgctggtgacaaattctctcaccgttaatttatctgcaaatgtctttgttttagttccattttaaataaatttttcactggatatagaaatccctttttgatatttgttgctttcagcactttaaatatttcttccactgtcttttcgtctccatttttcctgataataacacatcaattatttttaatattttgctcctttatattatgtctggtttttctctggatgtatttgagattttctctctgtaattggttttcaatagtttctttttgttgtggttagttatggttgtatttattttgccctctattcattaatattcctggatctgtagggttgttattttttaataactttggaaaatctcagctatcttttcctcatatatagtcgtgtgtcacataacaacattttggtcaacaacaaaccacgtatatggtggtggtctcatatgattatcatggaactgaaaatttcctatcaccacgtgatgtcatagctgtagtaacattgtatcacatttataatgtatttttactgtaccttttctaggtttagttatacaaatacttaccattgtgctataattgcctacaggatgcagtacagttacatgctatgtaggtttgtagcttgggagcaataggctctgctatacggcctaaatgtataataggccataccatctaagtttgtgtaaatacactttatatgttcacacgatgacaaaatcgcccaacaactcatttcttaaaacatacccagttgttaagtgacacataactgtatttcttctgtcgtattttctcctcttcttttggagtgcatattagatcacttgatactgtatcacaggtcactgagggtctaggtatgttttcaatttttattctctctgagtttaatttggatggtttttattcactgccttcaaatttactgattttttgatgtgttcaatattctgttaatcgccacaaaaattttaatttccatttggttcttttaagagttatcatatttttccagaaattccctattttttactcattatatacatgtttgcctatagattctttaacatatttattatagctattttaaagatcttttcagcttattccaaattttcagataaccatgtgtctatttctattggtagttttgtttttcttgaataagcaccacatattcaagtttcttccaatctgctaatttttattgtatactaaatgatatggatagtatggtataaagattctggattctattaaatttcttgaagaatgctgaatattgttctacctggcagttcaattcctggtatcaacttgatcctgcagtgatggagttttagattttgttatagcagggctatttccaatgccctttgtcttacgtgtatcccttggacttggcatacgggctttattgttaatgtgtgggttttctggggtaattttatttaaaaaatttcatttagtatttcttttttttaagtttattattattatactttaagttttagggtacatgtgcacaatgtgcaggtttgttacatatgtatacatgtgccatgttggtgtgctgcacccattaactggtcagttagcgttaggtatatctcctaacgctatccctcccccctccccccaccccacaacagtccccagtgtgtgatgttccccttcctgtgtccatgtgttctcattgttcaattcccaccgatagactagattaagaaaatgtggcacatattcaccatggaatactatgcagccataaaaaatgatgagttcatgtcctttgtagggacatggatgaaactggaaaccatcattctcagcaaactatcgcaaggacaaaaaatcaacaccgcatgttctcatttagtgtttcttatagtgaagtctgttggcaacaaattgtcttagctgtcattcattagaaaacatttccattgtgctttcacttgttattgagttacatagtagacagaattctaccatctccaccccaagatttctggcccctggttatttagtaaaaaaccaatctccttaaagctggtaagcaacttcagcaaagtctcaggatacaaaatcagtgtgcaaaaatcacaagcattcctatacaccaataatagacaaacagagagccaaattatgagtgaactcccattcacaattgctacaaagagaataaaatacctaggaatacaacttacaagggatgtcaaggacttcttcaaagggaactacaaaccattcctcaaggaaataaggacacaaacaaatggaaaacattccatgctcatggatagaaagaatcaatatcatgaaaatggccatactgcccaaagtaatttatagattcaatggtattcccatcaagctaccactgactttcttcgcagaattagaaaaaaactgctttaaatttcatatggaaccaataaagagcccgcattgccaagacaatcctaagcaaaaagaacaaagctggttgcatcacgctacctaacttcaaactatactacaaggcttttatcacctagtgatatcatagccatagtaacattgctaaggagagaatccagctcagctgtgcccagaatattacctacagaaatggtgagataataaatgggtattgttttaagtcattaactttgtggtaatttgttacatagcaagagaaaactaatgcactatccttttgttcattatttaagtttttacttccctcctaaatatgcttgttagtatttattttagggtctttgaatagttgctttttgtattctgtcaagttttaaattataatcagtgagaaaaaaaggctgtagtgggcttattctatcttggcttgcctcagaagtgtttaggggtaaatttaagaaaatatttgcatggtatattcactgaaaactataaaacctgctatgttagacttttaaataccaaaataaatgaagagatagatcatacttatggaatggaagatcaaaattgtttggaagccattatccttagtaaactaattcaggaacagaaaaccaaacactgcatgttctcactgacatgtgggagctgaacaatgagaatacatggacacaggaaggggaacaacacacactgtggcctgtggagcagggtgtttgggtcagggggatggagagcatcaggaaaaatagctaaggcatgctgggcttaattcttaggtgatggtttgataggtacagcaaaccaccatgacacacgtttacctgtgtaacaaacctgcacatcctgcatacgtaccccagaacttaaaataaaaaaaaaaaagatgccagttgcctctaaagtcattcatagattcaaagtgattccagtttaacccaacaacctttatttggtaacagttgacaaatggattctaaaatgtgtatggaaatgaaagggacatagaatatccaaaacaatattgaaaacgaggccgggcgcagtggctcacccctgtaatcccagcactttgtgaggctgaggcgggcagatcacgaggtcaggagtttgagactggcctggccaatatggtgaaaccctgtctctactaaaattacagaaattagccgggcatggtggcatgcacctgtattcctagctactcgggaggctgaggcaagagaattgcttgaacccgggaggtggaggttgcagtgagccgtgatcgcgccaccgcaatccagcctgggcaacagagtgagactccattacaaaaagaaaaaaaatgtgtggtacttgataaggattgagaaatagatcaatgaaacagaatttggaggataaaaaagactaatatacaataaattgacttttgataaaggtatcaaataaattttttagagaaagcaaattcttttcaacaaatggccctgaaacatctagatattcgtatggggaaaaaacaaaacttaattcatacattacatcatacagaaaaaaaaatgtttttaattagatcttagtctgaacataaaagctaaaaccataatgcttttagaggaaaacatagatagatatttccgtgacttggcataggcagattttcttaggatacaaaaagcagtaactgtaaaagaaaaaaattgatagattagatttaaatttttaaactacttttatcagaaaacaccgctaggaaaatgaataggaaagccacagacaaggagaaaatatttgcaaaacataactgacaaattactgatatctaggatatgtaaaaaacttcaataactcaataataacaagatgtattatccaattttgaaaaatggagaaaactttgaatagatacttcacgaaagaagatatacaagtggccgataatcacatgaaaaggtgatcgatgtcgttagccatcagagaaatgcaaattaaaaccacaatgaggtagctccatatacccaccagaatgtctgttattacagcaactgatatcatcacaaaggttgtgcaaggatctggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataagaaaagtctgtagaaataagaaaagtctgtagaaatatacgccaataataaaaatgtttctggaaatttcagtcttaatatatgttttgcatatttgggtagatgtgtgtgtgcacacacacatctaccctccctcttttgtgcttactcttactgtgagcaccaaatagtagaaggactgaatgtacatacagacatgtatgtttatgttctgaaatgacgactggccattttatggagacttttctcaaaccatacacatatctcctgtaaagtcaaatagatatccttcccatgataccaacatggaaattattactttaatgtgccactgttacattgctcttaaaagtgtcagaggtagagaaaaaatgttgagaacaattttgctagacggtgattataaatattgggtagaatggtcttcggggacacatgacaaccattgaagagccatatctttcattagtctcaaaattagactcaaaatatttgttttagaaatttcctccagccatcttgaaactatttttgaagatactttatactttttttcctcacagctattggtgatgtatcattgctctgtcttaacacaaaggataccttttaggatgaaagctattattatttctacatttctatatatactctaataaatacttctgctaacaaatgcatatatttaataggaaggatggttttctgggtagatttgggatttggtaggagatagaaatgactcttgtgaattccattaattgccctaatgtatgtgaatagctaaccttataagcaagcttgtaactcggtattatttatcttctaattatactttactttcataggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtaggagaatggtctatttattagtccatgtatttcgttttgctggcaggttattcagtctttaagactttagaatttttccggtgcattggaggatgttaaaaaaaagactttaaaatttgtgatataacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatcttttttatattttaatcatcactgtggttattcgttcttactagtaatgaatgagtaatgagctcactgttgaaccttactttgaaatttgtcggtatgaagccattagtcacaaagatgtcctaaaaattacatttttaaagaaataataacaaaagtagttagaagaatgcacacctgatgagtgtttgtgacttctcaaattatttcataaactataaattaaaactgagttgtaaaccccattgctcttagaattgattgttcttagtctgagctcatagtaatgattatgatagcaatgacttttggcctttaaaaatacgccacagtgtgctgttttcattttagttttgtcactaagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttagctccttaactccaaagtagtaactgcatgaagtttgaaacttatatacctgtaccaaatgttttcaagtgtttgaatgtattttaagagcatatgtgccaattcaattcttacatagtggcttatctctttaagtttttaggaacttgtagaacccagtgtttctgtctattggaaagacccaaaattacctaactaggaaaactaatttaacatttaaaaattcatatatttgtgtcattttcagttgaaaatctgtagtaccgaaaacagccttacatattctacctttctttggagtctgtttcttatgtttaatttatatctgttaatgcaaacgaattgaactatccttcaaaaggacattctttttttaaacaataatatgtattatcagatcttgaaaatatgtaattcttaacttgccatatcttttgcaggttttcaaactatcccaccttcacattttgggttgtcacaaagttctcaattctactgctgttaaaaatggactaatagggccgggcaccatggctcatgactgtaatcccagcactttgggaggccaaggcgggtggatcacctgagatcaggagttcaagactcgcctgaccaatatagtgaaaccccatctctactaaaaatataaaaattatccaggcgtgttggtgtgcgcctgtagtcccagctactagggaggctgagaaaggagaattgcttgaacctgggaggtggaggttgcagtgagctgagattgcaccactgcaccgcagccagggcgagactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactcctaggattcattgctctagcacaatttattctctctgctaacatttggtgcttataaatcatagcaaaacttgtaagaaaagaaaattgtgtttttagtcaattaacactaaccaaggggtgctctatttgtaggcttttaatctttttatttaatgatccttcttttaatagtgaatagcctgtcttaatatgtgcattgaataataatagagtaaatatgatattttctgtggttcggggtgggatattgcatgccaaaacattttcaagtaccctttcactgataggcttcatatcttggaaaagttgaatctttatttttgtgttcaatgttgtacaaatatatattggctttttctccttaagtaacttattgcaagtactataataataatataataataataataataataataggccaggcatggtggctcacgcctgtaatcccagcactttgggaggccgaggtgggtggatcacctgaggtcaggaattcaagaccagcctggccaacatggtaacaccccgtttctactaaaaatatgaaaattagccaggcgtggtggtgggtgcctgtaatcacagctgctcgggaggctgagccaggagaatccctagaacccagaaggtggaggttgcagtgagctgagatcacaccattgcactccagcctgggcgacagagtgagactctgtccaaataataataataataataattcaataaatagtaataggaaagcctcctggtgaattatgaaaaaaatcagaatgtggcttcatgaaatgcttttcaaatacaagcaaaagtacagttggtaatggccatcgtatattcatgttttgatttttctattctgtcacccatgatctttatatttattgccaatgaggcctttaaagtcaactgtatcttcttgaagcagtctgagcatatcaagaaattggcacctggtgtttttattaaaagataacacaagccaagataaacttcagcattaatccaaaaatacccctttactaaaggaatttgaaggctgttggtgaaatggtactatctagccaactttaatgttttgagaagctaatttttggaaagccacagtagcagtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctgtgttgactggttgccagcctagggtgactatatgagttaaattgtttaaatgtaaaacaattgttgtactattgtaaatctccttcctctttctcatatgccagatagagtcatgttatattatgaaattacatagaaatacctgaaagattaaaaagatgctcatattttaagatttgtttttatcttcaattttactaataaagaaaataataataattttaaaaagtccttccatagcttctactatataccaggcactgtgctaagtaatttttacattgtatctcatttaatccttggaacaacctgctaaagtaggtgctattcttaattccattttatagaagaagaaattgaagccaaggagattaataatcttactgaagtcaaacagctaataactaatggagctgtatttgtaacccagcattctagctccaaagtcctgtgttcttaatcacagtgtcattctgccttgttagtattttgccattgattctgaatcttaagagtattggaaagggaactaaagtctgaattttattttaggttaaaaagacaaccctttgtccataagaatgaactctattctaaattcataacaagtgcctattatagttcctcaaaaaataatccctacatatcttcattttttgttgaaatcaataaaatttgaaatgaccagaggagagaaggtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaataaatgtaactacttacaaataaagcaatttgatcttaatcacaatgagacatggcttgaatttctgattgccctacagcagtgatgcttaaagtgtggtcctggaactagcagctttagcttccacaaagcacttgttagaatgcaaattattgggcctctcctaagtctcttttttctaaattatttattcttaagactggtcaagtgcagtaacgagaagggaggaaagagttgaacaaggagttcaatctataactgaacaatcaattgagataactcactaccttcagaccagtctcctcagtcttacggaatccaaaactcttggggtgggcccaggaatctgttttaacaagccctctagttgattctgatgcatgctccaatttgagaaaataccctacagtttctgtttaatttaactttaagtcaaactctttgttaagaattacagagccacacattgttaagccatgagtctttttctttagatgttattttattgaatttaatatataataaaatgtaaactaaaagagtctgcaaatcagtgttcataacaaaaagaatccagttcaatttatattagaaagggaatcagcataggtctagatattttaatgttgtgtgggttttattctgcaaactaataggaagatgactgatattttaaaagcctgacttttatgctactcttaacactatactgaaatgtcgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgtttgtattcaaaatgtgaattctaagctgcatcattttaattaacactcactagacaaggttctatgtgtggctcactggcgaattaaaaagacagtagaaggcaagtttcctatagtctcctaaagggactttgttgtattatagtcagagttcctgaaaagatacttcacctggagtctttggtatgcatatttggatttgagtagccttcatttcagtgaaagcaaatttatgcaaaggagacatgcatattagagcattgcatatagatgaatccacccatagagaagtaattatggtgaatagaggcatcttttaggctttgaaattagataaagttagggtcaaatgtcagctcccctgcacacttctgctttgtatctatgaggaaaacagacactgggtttctgtcttcacctataaaaagagaataataacatatccactcatgtgctttctatgttggtttgagtgacccagagcagagagtcacattcctctttatgggttctcaaaactgcctccattcggtcaagatgattgctggtggatttggcagtcaacacaatctggactgtcttttaattctgaagactgctttatggcagaaaaaaagtatttaaagtagtgatccttaaagcttttcaaaatctaatctttttccccatgccatcactattcttccagttacctagacttaaaaatttacttctgtttactcattctctactcactccctataaatatgcatatttccagaaacaattaagagtaagtttcacctgctatacccctttaccactaaatattttaatgcagatttcttaagattaaaaatattctcatgttttattataagatgacaataaaaagctatgggattgtttatattttataaaattcttaccaaatgtcttggctgcagcctgtaatcctagcaacttgagaggctggggcaggagggttgcttgaggccaggaatttgagacgagcctggacaacatagcaagaccctgtctctaaattttttttaattatataaccacagtacacttattaacttcagaaaatttaacatagatatacattaatttctatctttcatattccagttgggtccaatgacctaataatgttcttagcatttcttcttccagtacaggatccaggccaagtcatgttttgcatttaattgtcatatctctttagccttctttaatctgaaacagttcctaagtttattttctttttttcatgacctcgacatttttaagaaattgtaccaccacccccatttttaaatagaatattccttttttgcctgatgtttattcataattagattcaggttatgcatccccagctggaatactacatgagtggttctgtgtccttctcaggctaaccgataaggaggtccatgatgtctatctgcttctcatttgtggttttagttttaatcatccagtcaagttgttgctcagtttctccactgcatcattaggtttttccttgcaactaataaaactgtaggaaggcacattaagatagtgcaaatataccaatactcatcaaaaatttcccttagatttaacatctattaatgattttgcctcaaccagtctctagtgggatagtggcaaaatgatgttgtttcaactctagcactacctccacatatactagtcagtcctactgtaagcaagagccctcccttctctctggtttacctatgcatttcttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatagtgagatcctatctctatagaaaagaaagaaaaaacaaagaataaaataatagttacctttcattaagtacacaccacacaccagtcttctaagcacttaatattgtcagcaaaagacaatgagatctagaggagaaaaaggaagagctttattttctgtaaaaagtaatctgcggattgggaaggcacagctttctgtacaagcgaaagtgtgatctctgaagaacaaagggagggtttggcttaagtagggaaagttctcacccatgttctcaaccaggtccatttatgcaaatgaaggattcagacttatcagttctgattgattgaaatacttgagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcctctgggacaagatagccattttctgatttgactgggtaaaggttgtagccctgttgctttgccataaaactgtatgtaccttctgtgcaggcatgaaaggacccagtggagtacctggatcagctggccctgagggggaaccgggacttattggtcctccaggtaagacttattcctgaagatagttatacctgatacttagatgctttaaagaatttgaaagttttcattctgtctttcagccagaccatcggaggctaagtccccaacaactgaggcaaaataaacaaggctctgcctttatttactaatctcttaaattctctattttagtaacataatattgatagcagaccttttaaagttaagataaatgcaggatcaacaaaaatgcttccttgacattagcttctatactaacttccccaaattcaattgaacagatcacaagagcaagtcacatatgaattttttataatattttcgatattaaaatagttctttttcctaagaggcttatagaggtttcttataaattgagaaataaggaatctgctaaattcccctactagatcaaagggtccctggacaagcacagcaagcaaaaactgcaaatgatgttggagtcagaatggatgtgtaagggaataaaattgtcttcccctgacaccagtgttcacagatttgaacacagatggatgagactttgtagtaactgagtaagattcaaggtttgaaaatagagatgatatgcttaatttttacactgaccctaagaaacttatttttcaattgaaaattatttttcaattttaagttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagcatagctgactggtgaatgtggacctgaggaaaataggaaagcacataataaggagatttgtcactatcagagaagcatacaagattgcttttatttgtgtttagagcagtggaaaactcagttaaattttccaagcactcactgtacttacttgttcagcaaattttcaatatgttgatttaaatcccttgaccatattgaaactattgtgaatatttccacatttgaaaatatcgcagtaggctgtaatttctttcataaagagcagcaaatataaatgaacagtttaagtgattgccatagacctttaagagtcatggtgaagtttcatattgagatgataaattgatattaggagcattaataggtgctcctgataatattgagtctggtatctgttagattttcaatttgtactcaacctacttccaaaaagaatttgagtcaacttgaaataaaaaatactttaacgttaaggtttctaaaatagaaatagaggatcatacattatatatgttaacaactctagattatataaatatgactaataaataaacataaagagtttgtatttcaaatatcagtggcaacacagcagagtggtaatacctatagccttcctagagtcaatgccctgacatttcattaatgctatatttctagggaaataacaagttagtgtcatcttcatcacaagtgtttctgtgaagtttccctaaaatgaaaatttatacacagactgtccaaaggcctgtatatacagaaaattattaaatgaactcaaaccaagaggctaaatcaggaagggaagccagtggtggattgaaaatgggcattttgaaaatacttctttagaatgccctgcctgttctctacacaaaaaggtatgcctgagaataattcccccagacggattcaaaggaaaatgtttttcagcaatgaagctggcagattgatggcaaccacacccttcctttctcattgatgaacaaaacagcaggctgaaaattgaccatggggttcagattcttttagtacaacaagagactaaataacatacagactctccaaataagcatattttatttgtctcctagcccatgatatctgacaatgcctttatagacactctataaatatcaaataaattaactagtcaaatgaggtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcctactgtgccttttgtttttgtttcagaaatcctgttgggttctagagtagccttggccaaagtgcctctctctattcttttggggcttccgaattgaaaaccatgtcaaaggcaactgaatatattcactatgatttttaaataaataatatttaaccttaaactaaaagcattaattagctcttgtgaggtacaattcttggcctaaagcagatcatttcaaaaaggccacatttacttttagttagattagttattaagggaacagtttccctgggctctttgcagtatagcagctgcttgagtgtgcagtgtttataattcctgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtatgacatttctgtacaaaatccagttcatttaaggtgttcccatgtatcttctctatactggggtggacagctaggttgatgggatgaggggactaaatcactctcaaggactcttccatccccatgaattcttttcctggaattctgactttggatgttgaagtcccattgtcttacctggggctgcattttgttgttgttgttgttgttgtgttgtttttttttttgatacggagcctcgctctgtcgcccaggctggagtgcaatggcgtggtctcagctcactgctacctctgcctcccaggttcaagcaattcttctgcctcagcctccgaagtagctgggaattacaggcgcccgccagcatgcctggctaatttttgtatttttagtagagacggggtttcaccatgttggccaggctggtctcgaaatgttgacctcgtgatctgcccacctctgcctcccaaagtgttgggattacaggcgtgagccaccgcacctggcagggctgcctattttaagactgactatcccctttgcctccataaagacatttaagaagatagtctgggctcccagtttctgggatctctatgatgagaagcttcctgagatctcattgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgtaagaaagaagacagagaagatggattaaatactaaagcttttctgtctgggagaaaagaaaaacatactgagaaccattagtctattaaagtcttataactatggggtatagagggcattgggagtatatgggatcactctctcttcgaaaatttggagactataacccagaattctgcatcattgtgggcagccacaggtgcaaccagatactccagatacttccatcattatgggccttccttttatttacctttcttttccttacgagactggatattttcagctctgtcccaaattaggcagtagaataggtttttttaaattactttataatgtacaaagcactttcatgtccattgtctaatttaatttacacaactatgattaagaaaaatgtatataaatattctgctttttcattttatacacaaagagactggctaataggttaaataacttacagttagaaagtgatggaggtaacacctgccaattctaaatccatttctttttaaattttcccatgttgttcactcttacatgactgtgagtcagtcaggtttttcttaacgagtttttgaaagggataaattagactaaatcaatgattttcaacctagggaattttttaagactcctagtcttatgccaaatccattgtataaaaattccaaataattctgataatacaggtttaagatctattggtcttttatcagtcatcttcagtctgagataagcatacccctttgaatatatgaagaatttccatgatgcacagaggcattattttttaaaaatcaaatttcaactcctcgacttttatatgtattttctcctaaagtcaatctgactttagcagatgtgctttgggcaatctcctttcccatgtctcctttgtctcctttcactgtcatgcattccccactttgtaagagtcatactcttgcacattgccttgaagtatgaaaacctctgacagacaaattcaaagggataattcaaaataacagctttgctaaagatacaattaccgttagatccagcaatcccattactggatatttacccaaaggaaaatagtatatcaaagagatagttacactgacatgtttattgtagcactattcacaatagcaaagatatggaatcaacctaagtatccaacaaaggatgaatggataaagaagatgtggtatatatacacaatggaatattattcagccatataaaaaatgaaatcatgtcatttgcagcaacatggttggaactggaagtcattatcttaagtgaaataagccaggcacaaaaaaaacaagtatcacatgttctcacgtatatatgggagctaaaaatttgaacacatggaggcagagagtggaaagacaggtagcagagacttggaagggtaagtgtggggaatggggaggatgaagagaagtgggttaagggatacaaacatacagtaagatagaaggaattaattccatatttgatagcagaagagaatgactatacttaaaaaatatattgtacatgagtgatggacaccctaaataccctgacttgatcactatggattatatacataaaaaaaatgttcatgtgccccataattttgcacaaataaaaaattaatggttttgttaaagtctccattaactcaagctctgtaattcacttttaatccaaccttctaagaaatacgtttctaataaaagtttttttgtaataattatataaaaatttataatacatatatttttatcagttgtgaattaataataacaatgacaggtcaaaataaaacatttaacacgtaaagtcttatagtcacaaagttttaaaaaggtatattcaatattaatttttgagaaatatgatagcatgatcaataaaaaactttcaaaaataaaaatatgttacattaggaaaaaactgtgtgagaaaagtggaatggaaatataatttttaaatgtagaaggaacaatgtataatttccaactgctaaagacaagtttatatattttctataatggttaatgttagatctcagatcattatattggatgcatttaaaagagtgatataaaagtttgttcttagatatcaatattcacaaaacaccataaatgaaaactggcaaggtagaaatgtggtttgcaaattcccagtccctgctattacaaagtggaataccgaagggtgggtgtggagctgagagacaatagctaaaatcttaatactggcacagtatcaatttaaacttacgatgaaatttagatatcaaaactttagatatgttaactttcaaaagtgtaagagagtgcatttttcatcattcttttgtgagtaaatgagaaaagaaaggcttgatcacaagtaaagataacctctcttgtccctactagctctgaatttcaaagattagtttctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattctcatttaagggtttgaatgagcaagacatacgtaatgtatgtacctcaggatacttcattctgttgatttttttcagtttaaatttatttttatgtgttgcttttgggttatcactacttggtatttttcttatggtccttgttatctatcataacatcatcagttgcccagatttccctcatcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 3618 - DNA, 92065 bp, human
gaaaggagacgtgcccactggagagcaagtcagaactttcgtgagccctgctccaggtcccaggagaaagtgccagccatgaggactggagtattgcctggtaaggagaagattattattttatctaacacgttcttctataacgctctatatgctaggcactggtctgcactgctctaagtactttataagtattaactcctttacatcttataacacttccctggaaataggcattattattgcccccataatacatatgagtaaactgaagttcagagatgttaaataacttgttcaaggtcacatagctggttaagtgccagagccaggctttgaacctaggcagtctggatctagtggctgtgttatactgcttcgcaacagaaacttgatttttctttcttctgtgtttatcatcctttctcaatcactcctgggcaagtctactttgctagcaaatttcccttacccctttggcttttttttcacccatgaaccctctaatgttttctgcagcttctttgagctcattctttatcttccacactgcctcttttggcattactcatgaacgacatgctcttttcatctgccaaatattttttccataaattatcccatctcaacttgggaagtcacaatgggaagtattgttcctattttgtgaatgaggcaactaaggcaagcaactttcctgaagtctcacacaaccatctagtggcaaagtgcactagaatccagattctctgattctgaatctaatgttcttgtccattgcaccatctgatggaatttaactatctattcattaattaatttattcattaatattgtaaaaatatactgagtgtcttactgtatggtaaggccctgggtgcaaaagtcggtataaaaattgttgctcttaagcaacagacaacacagagagataaggtctcaccataaaaagttaaatagcagcacatatactaagtgccaaatgagtggtctggtcacatcatacaagaattttgaggttggatatgtagcatcaaagactgctttatcagaaaggtgagacttgaacttggcatagaagggtacttagaacttagagaagagaatggagcagcactttccaaactctgggaatggtgtgcattaaagcagtccttcacaacctttattgtgtcatggcatgcagagaaaagcatagtatttgtaaagcacactaggctgaatggaggaagcagtttgacatctagaggcaagcattctaggagtttcaacagcactgtctctgggctcagttgaggacagagaagaaatctcatagcctcagacacttgtaatatgtttgggaaggtctgcactaggtattgggggcacactgtggtcatggtgggtctaaagaccactgacaagcccacagggatgaaatgaggggaatttccagagaagccatagtagataccattggaaagaaaagttatgggcaaatgatgaagggcttttgaattttattctgtggacctacagaataggtaggcaaaatatgcatagcactgttttagaaagattccactggttttcatatgggagattaactagagggaagaagagtagtcaagaggctattaccattgtccaggtgggaggtgatgttatcttgaactagattgatagtaatagagacagagaatggtggacagaattgagttatattttggaggtaaaaatgtcagggtttggtaatagaattgcataatggagagtagaagaaagggaggtgacaaggaggatttcaaattttcaagtttaagcaaatgcttatgaatagtgatgccattctttaagatagagagcccaggagaagtagaaagatttttttggaggggaaggacaaatgagatgatgagtttcaagttgacatttggaggcaaggaaaccagttaggaggctattgtaaaagccaagtaagacaaggtgagatcctggactacaatggtagcagtgggaatggaaggaaaatggtgaattgagagacattatacaggaagaattgataggattttgtcacggactgacttctggagttgaaaggtagaggaaggcttgaagcctaagatatcttctgtcctttatcttcttagtgatgctccgatcttcgtggcttaatatactatctatttgctgatgagtcacaaatttgtatctccatacttttatgcccaattgcctgctggacatatcaacttgcatgcctaataggtatctccaacttaccatgttcaaaactgcccctgcccacaacccccaacaaaacctgctgcactcacaaaacctgctcctcacagtcttccccgtctccctaaataccaatttcattcttccggttgctcaggcggaagacctaggaatcaatcttgatttttccctctttcatatcctacatttatttgatcagcaaatcttattggttctaccttcagaatatatctagaatctgaccactttttcattgctactatcctggtttatgtcacaatgatctgcttcctggattatattgcactagcctctcaactgttctccttgcttctgttcttgccaccatcactcaagcctattattctctcactgttttttggaaccaggataattttattatgtgaatgtcagatcatgtcactcctctgctcaaaactcctccaatggcttcccatctgacactcagtaacaacaaaaccccttataatggcccataatgctgtatgcaacccagatattgacatactcctgtccttcaggtgatggatcaaatatcccacttggtaaaatcttctctgattaccatatttagtattgcaagcgccttctcgccattctctatctgccttccatgttttatttctttatactttgaatactagcagatgttatatgtttatctatttatttgtttatcatctatctccttctgctagaacaggagctggaaaactttttctgtaaaggtccagataataaatattttaggctttgtgagccacgtaatctttaacacaactacctacctctatcattgttatacaaaagctgccatagatgagcatggctgtgttccaataaaactgtatttaccaaaacagggagcgggctagatttagctaatgggccatagtgtactgacccctgctagaatgtaaattccaggagggcaaggacttttgtttactgctgtatctccaacatctagaatagtacctggcatatagtaggcacatgatttattttactgaatgaatgcatcagtgggagattggaaagctgtggaataaaaaatatatatatataacagagccattgatggtgcagaatcctgaacaaaatctagctttggatgggtttgcagcatatcaactctccttccttctttttcccctcatccctacactaaaacttaagcttgttatataaagtaaaagttgctttcattgcctgtgcaattctcccaatgtgtgaaatttcatctgacttcctttaatgttgtcatttgtctatttaaccctcctgactcagactccctctaataacaataataactcaaatactctgtactaaaaccagaacgctgaaatcagtatttttaattaatttgaaacaactgctagcaatagcttctattgacaactctacgcttttcaacacttaatcatattctgaagtactcccagaagctgggcgactgttactcttatgatatgagatgatattttccttccatgcattcaatgtgaatggtttgttctgaaaaacttcagctttcatgtactcctaatggtaagaatcacatggtaggaaatatgataaatgaagtatttaccagttcttactgactgttctttcatacttccttggatctcttacaggcactaaagatatcctgtagttatatgacttcctattgaaaatgcactttcactcattcattattttatatagtcttccacacattgctaacatttaccaaacattcactacgtatgtggtattgtgctgggggatttatatatattaattcatttaattcttataaaacacctaagtgatatatactatcataattttatagatgaaggaactgaagtactaaaagctgaagtaatttgctcaaggccccacaaccagcagaaaaggaagctagcatttcaactcaggtctgcccaactccagagccaagatttatctattgttttttgtcacctcaacaaatatttaccatatgccatgcagcacactaggcagtacctacaaagatgaatagggcatgatctccttggccttccagaggtaacactagttggggctatatgggtgggaatggagtgtcagatgcagaagctaaggaattttctctttacaaacaggtgggtgagaaagtagacacagcactgtgaatttgtggagttttgaaaaatggacagagggctacagactgagagggaatagggccaccaactctagaattaaggtcaactgatagggtagaaacatgccattctcaggggcttaagctgacaaaagaaattgcccactgtagaaatgagattggctgcccacagaaaagtatttactgatagataagggacctccctatgtgtcattaaggagtaatgctctaaaatgtaatcagtggaaaacacaactgtagccttggaaatgctatggctgggaaagtccatataactaagacggggttcatgatattgtgacatgtacaaacaagttatttgaccattatagagagaaaaataaaaataattagaaagagaagttgcttttattactctgtgccctggcctactgacacatttattgactttctgatagggtgatgcatggatgcatcagactgaataaactacatgactccatctcttcagatcatcccacaccatatactatctcttcactcaccagtaataacagtcaccatataacaagtgcctacagagtcaaacactttacataaattatcttatttaatcctcaaggcaactctatgatatcatagaattctattattagttccattttcaaatgacggaactgaggctcagagaggttatgtgacttaagcccataaaacggaatgagtggtatattagttttctgtgactaccataacaaattgccacaaacttggtggcttaaaacagcagatatttatactttcacagttctggaggccagaagttcaaaatcaaggtgttggcagggccatgctccctacaaaggctctaggggagattctgttccttgcctcttcctagcggttccaggtgttgcttggcttgtggtagcatcattccaatccctgcctctgtcttcagatgggcttctcccttgtctctgtgccctgtcacttataaggacacttatcattggatttacagcccaccctaatccaggatgatctcatgtagacatccttatcttacatacatcagcaaagagtcatattctaaataagttcacattttgcagttccagttggatgtaacttttgggggcggtgacacaattcaacccactatgtatagcctagctgggaccctagcctatctgactccaaaactctggctctttccactaactaaagcaggctgctcccaccaaacaaacagccttttgtctttatttggtttcctaagtagatttcctactgggatttatcaagatgaattaataaattgacattttggcttccaaattattgccttataagtttaggttgtgtgaaatttgtcccctagagcctgatcaatccctggctaaaatggaaaaaattgagttttggaacctgtgaagctgatgaatggatcctgaataggaccaaggtccatttagagtataagcatcccacagcctgccagccatactaatttctttactatatatgtgaccataatataatgggatagcataatattctaagtctaccgaagaatgtctaatcatctaagagcttacagggggaatttttgtgtaccttaatattatatccagaaatattccctgtagtgccaactatatttgttcctgagcctcagctccctgcatcaggtcacaaggaagatgtctctaggagttcattatcacattaagacaaggattctgtaggaaaatgggaatctagaaacagtagggacttcctgtacctctacatcagtgtctttgcaggggaattgccctagctgaccagttgacactggcctgctcacaccttaattatgaatagaatattcccagggatgtctttctcagattgtggtcagtttgtgggccgcctattgtggtggtccactgagtgacacctggggagctagttaaaaatgtcagtttcctggtcctttatagcagacttactgagttagtatatctgaagatagggtcaggagcctgcattttaaaacaagattctggaataattctgatacatattcaagtttgagaaccattgccttctggtgaaatcaggcttccatgacgttgaaatacagaataaactccaaatgttcatttacaattccagccaataatcacttaccttattgcattcttgtagcgtgatctatatgctttagttcatgtgacaatatcatttcatatggcttaatttaaatgaaagcaaaggcagttatggcaagatttcttaatcctgctctcctgagacaatttacataataacttttggggagaatgcaataatctctctctaatatcttaaactgatctctaaggttccttttggctccaacattctgattctatcagtgttcctagggcttcaaatctgtctgtgcaaaacacattgcttgttacagactaaacctattttccttcttccaggcaacaagtttctgaagaaaactggttgctcatgatctttctgggtgttttctaataatatataccttctcacaatattattgcaaagagtgagcgaggtgatctatgcaaagtgccaagcatagtgcctgacacaaggaagtggttagtaaatatgcatgctgcttccagtgcattgtgacaatactatctcttgaattattgaaaatataacatcaggaaacttcagctgaatgaaaactagggaattagctgtattgacaatattaggtttatttggctttaggggaactagatagaaccgaaatctctgcagactggctcagctgcagaatagagagatggcccggggaggacatgtgttggttcctgccatgcatattgtcttggagaaaagctgctatgactctggcccaacaaaggttttatcctaaaagtcagcttccaatccccaacatgattcctaagctagcatttctcaaaatgtattccatggagtactagtttctgaggattgatgttgatagtattacataaagagctccatgaacaagcaatgttacaaaccactggattagtcaaatgtggtttcctggctgcgagaatattcagagtccttaataggtcaacaggtaatgtgaatctccaaaaactaatggggtataccggatttgaaaatttttgtgacctcactcacagagatggtggtgagggactagtggttctgaaaaatgcaattatgagaacactactccaaaatgactagtgacttgctaacaagaatggacacttttcagcccttacatgataaaagttaagagaacaattacgtgctaaactatagagtactgtccctcagccccctagtgtctccattttcttctttgatcagcttagattctataaccatccttaaagtcactgtttagcatacaccctagattccctaggctctctctgctttcatgtgatttgaataacagacatccaatcgttgttaaatcctactctctttattcccaacctgccccagcagccgaatgagattggataaaagcttataaccgtgctaaccagtctcgctttagattcaggaccactaacttcaaatgggcccttagtactatctgctaacttcactacattcatttcatccattcattcttgaatgctcctgggtggcttttttacatctttcctttcctcaaacttccgacacttgtttctacattttccctttcagctgctaccttgtttcctatttcactgagaaaatagaagttgtcagaaaagaactcccaccaatctatttgtatttgtatccataaactctgccttccctcttgtcactgtgagcgaaccatctgggattccactgaatgctgactcctctacttatgcactaaattttatttctttttgcctaatcaaggtcattactcaagtcattcactcttccctcatggcatcaatttttctttcattgaacaacatcttcaatgtttaaaaaatctgttctcttcacccaagtcatagccccatttctctcctcctcagagcaaaaattctggaatgagttgtctctgctcattcgttccaatttctctcctctcattttctcttgaatcctctccagtcaggcttttgccatcatcactccaccaaaatgattcatatcaaggtcaacaatatctcctcagtattaaattcaatggtcattttactgttctcctttttttttcgcccaacagcggcatttgacacagtttatcactctctccttgaaacacttttttcttccacttggcttccaggacaccatgtaattcttggctctttctacttcactagctactatttcttaatatcctttacaggtatgtcttcattttcatgataactaggttgtctgattggcatctcaacttgaaattatccaaggtcaaagtgactattttccttatacctgcttctcccacagccttctttatccattcttctggttatttaggccaaagccttggagtctgacttgactccctttttctctcacactccagatcctatctatcagcaatactttcagctgaatagttaaaaatttatttgtttagaaacagcatctcacactgtcacccaggctggaatggagtggcacaatcatagctcactataacttcagactcctgggctcaagggatcctcccacctcagatttcccagtagttggaactacaggtactcaccacagtgctggctaattattattattattattattattattattattattattattattttgtagaaacagatgtcttgctttgttgcccaggctggtcttgaacttctggcctaaagttattttcccaccatggcctctcaaattgttgggattacaggtgtgagccactgcacctggcctaaaagtatatttagaatctgaacacttctctactgctataaccttaatccaagccagcatcatttcttacttggatcattacataatccattaaacatgtaaatcagatcatgtcatgctcctgctcaaaaccgtccgtggccttttatattgttcacaataaaagccaaagtctttagagtgacctacaagattctacatgatctaccttcattcccattacctctctgacctcatgccctgtcactctcctctttgattactgagatcagccatatggcttacttgctgtttctcagacataccaagaaaactcccagaggtccattgcttttctctctaactaggatgtttcttcctcatagagtgtcatgcttattcacttgcttctgtcaaatctctgtgcaaatgacactttatcagtgatactttctttatcatcttatttaaaaattgccactctctgcatgcttcctacaactttactctgcttaatttttttccatagtacttgtcattttctgatatattaatattgatttgtttgtttactgtctatcttcaccactagaatataagcttcaggaaggcagggattttattttgttgctgctgtatccctagtgtgtaatgtggtagctggcacataataggtgctcaataaatttcaaattattataataaagaatgattccaagtgcaataggaattccaagattcctgccatcttcagatggacccagatatccttcatcatctgcagcaatcccccacccagtgccaaactctgtgacactgcatgtctggtagtgagtttagtctttacatgaggacttccaggaagttccatagattcttaagcaaagtgctccattattgaagctatttaactcctagaaagatctttgtggctgtgtgcggtggctcacgcctgtaatcccagcactttgggaggctgaggtgggcagatcaggaagtcagggaattgagaccatcctggctaacacagtgaaaccccgtctctactaaaaatagaaaaaattaaccgggtgtggtggcacgctcctgtggtcccagctactcggtaggctgagacaggagaattgcttgaacccggggggtggaggttgcagtgagcagagatggcaccactgcactacagcctgggcgacagagcaagattctgtctcagtaaaagaaaaaaagaaaaaaagaaaaagaaagatttttgccaagggtccttttctgatacataacattttttgaataggtattaggtgtacacgatacaaagtgccaaatgttcaaagagcaagtagtgaaaagtatattctaccactcccactgctaccaacttattccaagccacccacatttctaaactggaattatagcacaatttttttagaaacagaagttagatgatgtcgctcctctgctaacatcagcctggggcatgtcatcacactcaaggtaaaagctagagtctccctctgcccccagccaccaagatcccttcctggaggcaaacactcttactagtttattgtgaattttttagagatagcatgtatattatacacacatatctccatgtgtataattcatttttaaactgtacacactattttttatatttctttttttctcactttattctacctcattctttttaatagctacagttgtatcagtatggctactgtattctccagagattcttagtctggagtccatatatgggtttcaatgggtctatgaatctcctgaaagtgcatgttgacacttgtgtgcgtgtgtacatgtatatcttttagcagagcaggcccatatctttgatcagattgaaaggaatctgagacccaaaatgagtaagaaaccactatattgagtctgaatctgccttcctgaaacacctaccctttagtcctaattccactgtttggagcagttctgtcaggacctggtacatagaggacatacaacaggtaacttgtgaaatggatgaagggacaacataaaatgaatctattctgtctctctctttttaaaatttttaaatttttatttattattattttttaaagacagagtatcactcttgtcacccaggctggagtgcaatggcacaatattggttcactgaaaacttccactcccaggttcaagcaattgtcctgcctcagcctccccagtagctaggattacaggcacctgccaccatgcccagctaatttttgtatttttagtagagacatggtttcaccatgttggccaggctggtcacaaactcctgacctcatgtgatccacccgcctaggcctcccaaagtgctgggattacaagcgtgagccactgcgcccggcctattctctcttctttatgttagcttttggttagcctgaggaaactatcatattctaagtcatcccttttctaaagttaattacttaattttcttaacttttcctaatttgacatggtttccaaacctgtaggctttccctacatgctgtaatgtgggtttcttcctcaaatgccatcggggcaagctggtaatttaaaaaagtgaagtggatcagatgtgagacaacggcaagtggtgggacctgtggagtccacatggctaagatgttcacattcaaactcacatataacacatccataaccaaacaaaaaatattttcaggccagttttggactatgggcaggcagcttgcaaatataaaaatttggacctcgtacagtttgttgatactcttttcacatcttctgcactctatcaattcacttttgtcctccccataggcctgacaatttaatcaaactaaggtagtgcctgcatctcaaataccccttaagattccttgctattattcctttgccaatatggctctgtctgtataaaatgcctttgtggaatattctctacttgcccctcaagatccacttttaaaaatagactattttttagagcagttttaggttaacagcaaaattgagaggaacatacagagagttcccgttagcccctaaagatccagttttcacccttcttcatcctctttgtgtaccccccgagactgacctttatagactgcatttaaaaacatatttttagttattgtgggtacatagtaggtgtatatatttttggggtacatgagatgttctgatacaggcatgcaatgtgaaataaacacatcatgaagaatggggtatccataccctcaagcatttactcactgagtcgcaaacaatccaattacagtccttaaattatttttaaatgtacagttatcactggctatagtcaccctgttgtgctatcaaatagcagatcttattcattctattttttgtacccattgaccatccccaactccccccagccccccactaccttcccagcctctggtaaccatatgaattggcttccttgtcctctgaattcttcttggatatggccaatgtaaggcactaacaggggactggagatcagagacaggttaaagtctgcgtatttattctcctggctccctctttatggagtgggtgcagcttggctgaatcctgttagaaggatctgctgtgagccacagacttttttttggcagtcatcttctaaagctatggctactctgtctaggttctggttaactgctttctccccttggcttttcaggtctcagggtggtaagtgctccctggggtgcttcaccatcctttttgctttcccttaacaatgctcacactgttataaacagtccgttcattaaactccactcacttccctgttgaatatgctctcaatatcctactagatcctttactgttaccaatgccttcaactcccttgtgtacttggtgtactccccattgttaaggtcccagctcctaggacaatgtggtgcattcctagatatcactccctttgagaaagttagctattcccccacctctttgagaacatttcttgcaacactctgtgtttagatcttgggcttcttatgattgggaatgaagcctattcgttattgtttcctggccaagtagatgtttggtgagtattggttatcttttttgctttgtgaggaggatataaaatcaaggaaggaggatatttgctttttatttctttcaaattatttgattttaaaagaaatgcctacacattattttttaaaaattaaaatgaaaagaaaaaagtagtaaaagtggcaccgttcttcacatccgtgctggaagtaacagtggtaatggtttttgttgtgcatccttccagtatctttttatgcacataaaggcttaagtttgtgtacataaaatgtagactcacatatttctctgctccttgctttttttttaacttaacaacacacctgtctttctatatcagccaatgtaagtatacagccctacttcattatgttttatggctgcattgtatttcatttgatgaatttaccataatttatttaacaagcctctattattagctagtttatctaatattttcactgttaaaagcaacacaacttaaaacacagagacatactggatcaaatttaagcccaaaaatatatggctgagctccagaagcaagaaaggaaaactgtcagattccagagacaagagaaaactcacagtcacagcaatgagcataaattgacatttcaccactcacaggaaaaatgggaccaggtatattccttaaaggatgagattataagtcctctgtagggcttagaattgagttagaattgtgcttccctcataaaacaaagagtagaaggatgctgccccatttattatttaaaagcagatttcccaaatagtcaggggtacaataataacaaatcttatttagtacttactatgtgccaagcattgttctacatgatttacatgtatttatttatttaaccatcacagaaaccctatgatattaggtactattataaaccccattttataagtagggagtaaaacgtttaagtaacttgcgcagctaggaggtggcagctctaaaattcagactcaggcatcctgactccaggaccatgcctgtaagtaaatgtgctatattgcttctctacaaacaggatgtaggtcatcttccttaggatgaggtggaaataaactcacccataagaagtttaaaactttaaacctgagctgcacactagtatgaaaccaaaattcacagtacccacataatgcagaaaccctggggtgagaacttaacataaaacctggctcagagcaggaacacaatgaaactctagcagaggcaaatgaaaaaccgcctgtagacccacctccataactcagagtccaattcttacggaagggttctaacagaaaacagttcctgcagaagataagctcacatgcaaaaaaatgataaagcacatgaggaaattgactggaatgagttagttggtatatacaagaaatgggagaattatgtcccaagaaactacagataatacagtaatctgaaaggactttattttttgggtttttctcatctttttgtagccctcatgtatgaaagaactttaaaatgttgtatgtttgaaggtttcaagatgtaaaaaaggaacataatacataaagcaagagcacaactttcctcggtgtgtgtacaccaaataaataggccagaaatgaagaatatagaaaatatgggatgagcattgtaagattttagttctagccccaatgaaatatttaaaaagtcaaatgacagtttaaactacaaataagttatgagtgaagagagaacaaatggaataacaaatagagccgagataatcatagaatatagcatggcactataaaaatgctaaatatgaaagggaaaatagaagacacacatgatataacaagaaacttcacattcatctaataaagctccagaaaaaaaataggaagagataatattcaaagagaaatagctgataattttctaaaactgaacaggacatgagtcctgagattaaaaccatgtacctagttctaagcagaataaagacaaattgataccctgtagatgcaacagggtgaaactgtagaacatcaaagataaaatgaaaatcttgaaacctactatagacaaacaatgttgcaaaatatttctgtagaatagattcctaaaatggaatttctgggccagggtatatgcacattaaaaaaatgaatatgttttaaatgcatgagtgagtgaattaatgagtctagtagtatttctctcaatctggacatatatttattttagtacagcctgagattggatcccccagctatctatttatttatatatttgtgactgcatcaccactattgatttctattgagcataagaccaattaaaatccccaggactttttcaaatgaaaggctgtcaaatgaggtcctctttaacatgtacttaggcaattaatctttaaaacttagaagtagggctattaagacattggtgagatcactgagagctagagctgttaaagaaggtttcataaaggaagtaggacttaggctgcatagaatttattttcggtggagggtgcaaaggacagcttctatgtttgtgggatggaggtaagaagagtgataaggtgcatgaatagaccataggataggaaatgagcttggggtggatatgtggagggtgggtgagtaaagagataaggttcaagggaaggggtggggcaagattatggagggcctaagaagccagggagagtgtctgcatatgatattatacatgggcaattggaagtcccttcagcctttttaaaggaaattatatgttttctgactggccaatgaaaggctaactaacccaggaaagagcaagaaggctgggtgaagtaatgcaggcccctagttctcctgtttctgggttactggataggttatatagcaagtaggcaagcttagcaaacagctcagggacactagggtgacttgatgttaaactgcctgactagtgagaattaaatgtaataaaactggaattgcaagactaaaaatggtatttaggcagaataatctactagcaaattcaggattctttagagttgagtgggaaatataagaaagaaagaaagatgctggatgcaggagaacaagagatggaatgagaaagtggaatatacactggaatgagcaacaggaaactttagttctagtctcagctctacccctactaaccgcacaactttgtgcagattacttaaacattgaggctagtttcctcctctgcaaacaacctagaatacaaactctaaagggtggtaaccagatctgccatgttcatcattgtatctctagccactggtacagggcctagaacgtagtaggggctcagtaaatattggatgaatagatgaatgaatgaatgaatgaatgaatcaatcaatcaatcaattagagcctgccctgcctgcctcacagagttattataaacttcaaatgaaatcagggatggggaaatattacatgaacttaaaacactgagcaatccgatggtaaaatactacagctactactcacaattattattttaaaaattaaattagaatgctatttgtagtactttaagggtgaaatcataagtgggctaatgatttcaagttttcttagcatggaaagtaagaagaaaaggaaaagtataagacattttgagtgaggtaaataaaacatcagaatctgtgttctgaaccatgttctgtcatttgcattcaatgtgcttatggtagggctaatattgatgtcagttatagttagcattcattgactacatacagtaatgctatgtcctgtctgtccttaaaaaaatagaacacccttcaaagaaggtagtcacattctcattttagtgatgtggaaactgagattcagaaaggttaaatgacttgcttttaaaaccatggtaaggtggtttcagaaccagacattttctcccagatatttttgtctctgaagccagtgggaaaaaaactgcagataaatagatttctttacaccataaggatgcctttgctaagagacagcaattcaaagaaggaatgggctgcctcctgagctaatgagtttctcatcactagaagcaggatcgctatgtaatttgcagggcccagtgcaaaatgaaatggccttatgtccaggaagctggtcttggctggtagtttgcaagcagaagttagcctgcctccagacagggatgtcagagtgaggcgtcaacatgagctgatgcacaggaccagatggccttaatctgagacaccatggctctattctattagcccaagtgagttaagggagcatcccaaggtagctgacatgacaccttagaggcttcagatgagagagaattctgcaagaggatttggagagagccatggtgccatgatcatctggggcactgaaaacatgctctgccctatgaggcagcaccaacactcagaagaaaacaaaaaagaaactcttttagtggaggtgaagtgtaatgaaaagaattagacagatgtgggttcaaatcctagctctggcaattactagctagctatttgcctttgaacaaatcacttaaacctccctgcgactgttctgtcatctagaatatgatcacagtacctgccttgcagaggtgtggggaaggaggcaagtcaaatgtatctggcactgggtaagccctccataaatgttaactgttggatgtgtttataaaccactgggagtggggacggtatgacgttgggtcatttgcctttccttgagcacttcatggacgaatagccaaatctgccggacccacctaggggcatggaaaccacttcccgctctagtgctactaactacagcactgcagtagtggtaggcagtgggtgaaagtggagtggggccactagtagacagtaataacaataaactctccaggagaacagggccctcaagcttttcccctagccttgaagatacttacaggagataactgcccaagtccaatcttggaatcctgctagttgagtgttttacccacaaggacatttcatgagatcaggactaagaataaaattcacttctgcccagtagcgctatatgcattagtcacttggaatagcaacaatcttaatatctttctatttgtccgcaaaccccaccatcccacctctttaaaattccgtgaaatggccagaatagcgaaacaccgatacctacagtcttccaggaacttcattgtcccttatgcaacatagaaggaatggtatgagaactaagagaacattgcagtaaatcactgaatttcttggctttctttttttcttttaataataaaaagcactccaatcaaactattaattaacttgtaaaaggctcgaactattatgtactattccccgcccatgtccatgtgctgcacagtattttcttactcaggactggtggaacatttcttttgcttttgtttgaaaaattactttttatttggccttgggctgctatcataacttctgttttcactagattgcataagccatacatctgcacacatttttgatttgtacagggagtttgaattttaatatctacctccatctcaatcccagcactttgggaggccgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaatatctacctccatctcaaaaacctctcatcttttgtccttttcttcaagattctgatttccttgtggacattcattttgatacttacataaatcttgcgttattctgcccatttttttggctacaaggctcagctttggggctgtaaatgtgaaatatttccatcataacctatctttgggtatgggaaggtccttaatgctggaagttcattgaataattgcttattttaatagatgtttattttcattcacatttctccctccactccatcccttggggcagtaccctagttcagttcttcatctactctctccttgactgttgcgatagcctcctaagcagccactccacatccaatctccccatatccaaagtatcctaaacatagctaccagtcatctctctaaaccacagcttttggcaaaagatccttgaagtttcccttttgcctaatgagtaacgtactagctcctcatcctggcattcgaagctctctatgtttatatgtttgcctatctttcttttctagcttctttcccattacttgtcttcatatagctttagcttttgccaaactaccattctttgttttcagagcacaccctatactttccagcatcagtgtttctttcacctggaattaactgcctgccacagagatctccgttcatcagcctattcattctttaatgcccaagacacatgccaccaatttcatttgaatggtccttagagacactgaaatggcgcctgctgtacacctgtccaccccgacccccgctgcccactgctggctcttccagtcttgtgaaacattaacctctcctaacagcaagcacagcttctccatggagaagacactgaaatggcacctgctggacacccgtccaccccccacccctgctgcccactgctgcgtctgccagtctcgtgaaacattaacctctcctaacagcaagcacagcttctccatggggcctgctcactctggccctctggtcccaccatttttctcactactcaaataaagtttggagacctttccctgattttttaagaacatgctagctctttcatgatactcgttatcataccacccccatctgcttttcagtgtacctttcaattgctctctagtgctccattcttgattgttttccatttctattatagctttcaaggagagtctttacttggcctactttcttagtaaatggtttggtgagattctgattttcatctgatattagttctttctccaagagggacagagaaaaatgaaaaaaatatcttgccttcagttattcttttcatattctttgaaattctaagccacagaagtcttctgttaggctgctaccttcattttaagagactcttccctaaatgacaagttgtgacttcagaactagagaacatggcagcctctcatggctttctgctcagtcccatttttcttttctggatccactctgggccttctttaaagtgactcaacttcccaagcatgtgattttacgtattttaaaaacaagtctggttttttcaactcattctgaaatgtggctgccaaagtaaatacccaaccctctctaacacatacataccctctttcacacacacatgcacatgcacatgtaaacatactcctgaaggatgaggaaagcaatggtaaatggggaagcaaaaaaataccatttttcatttagacagacttcccaataccgatgaactaaaattcagggatttgtgatttgaaatgcatggatggcctttgagtggtcttttcaaatcccctaaatatatcaatttaataacttattgagcatctaccatttgatgagtgctgtgtagatgtatctatatatatcataaaatttatttcttgctacaacttttggaagagattattataatcctcatttacagatgaggaaactgagtctctgtgagaggaaatgatttgcccaagatccctcaggcaataagtagtaaatctgactttgaaacacaggtctgattccttatccccatcagatttcccaggcattctggtacaggtggtgtttcaacagatgggaatggggcagggtgagaaagatagtatgaataaaggtacagacatgggaaaatgtagctacacataggacagtagtaggaattaaggttgcaaaattgtgttagggacagaacacaaaaggattagaaacttgaacttccttccattgtcctgaagggacaataaaagattttgtagtaggaaaacaatataatcagagagccaaatcaagaatgcaatccaatttacaatagccatacaaaaaaaattaaatacctaagaatacatctaaccaaagaggtgaaagatctctacagggagaattaacatacactgctgagagaaatcagaggcaacacagacaaatggaaaaacattccacactcattaattagaagaatcaatattgttaaaatggccatactgctcaaagcaatctacagattcaacgctattcctatcaaataaccaatgtcacttttcacagatttaaaaaaagattttaaaattcatatggaatttaaaacgagcccaaatagtcaaagtaaacctaagccaaaagaacaaagctggaggcatcacattacccaacttcaaactatactacaaggctacaggaaccaaaacagcatgttgctggtacagaaaaagacatatagaccaatgcaacaggatagagaatgcagaaataaagccacacacctacaaccaactagtctttgacaaagttgataaaaaataagcaacagggacaggactttctattcaataaatggtgctgggataactggcatatgcagaagattgaaactggacctctggctatcaccatatatacaaaaattaactcaagattgattaaagacttaaatgtaagacttcaaactataaaaactccagaaggaaacctgggaaatatcctttggacatcagcctaggcaaagaatttatgactgagtcatcaaaagcaattgaaacaaaaccaaaaattgacaggtgggatctaattaaaccaaagagcttctgcacagcaaaagaaaatatcgacaggcaccctacagaactggataaaatattcataaactatgcatccaacaaaggactaatatccagcatctataaggaacttaaatcaacaagcaaaaaacaaccccattgaaaagagggcaaaggacatgaacagacgcttttcaaaagaagacatacaagtggccaaaagacatgaaaaaatgctcatcattactaatcatcagagaaatgtgaatcaaaaccacagtgagataccatctcacaccagtcagaatggctattattaaaacgtcaaaaacagcagatgttgaagaggttgcagtgaaaagggaatgtgtatacattgctggtggcaatgtaagttagttcagcccctgtggaaagcagttaaagatttctcaaagatctaaaaatagaaataccatttgatccagcagtcctcttactgggtatatatccaaaggaaaataaaccattctaccaaaaagacacctgcacttgtatgttcatcgcagcactattcacaacagtaaagacatggaatcaacataggtgcccattgatagtggatcggataaagaaaatgtacacgtacaccatggaatactacccagccataaaaatgaacaaaatcatgtcctttatgggaacatggatgcagctgaaggccattatcctaagcaaattaatgcaaaaaaaaatcacatattctcacttataagtgggagctataccttgggtacacatggacataaagatgagaacaatagacattaaggactccaaaaactatctgggtgatggaatcaatagaagcccaaacctcagcatcatgcagtacacccttgtaataaacctgtacatgtaccccctgaatctaaaataaaaattaaaaaaaatttaaacagctgcattttagacagattaatctaattcaagtctgaatctatgctgttgacagtatttttaaaaattctttcctaagaattctttattcactccaggcctatgctttggtcagaattctctctttgtttttcaatactttagtgaaaattcagaaggccatgtggaaaaaaacagaggaaacaaaccacacacaaacacaagataattatatacaagtctgggaagaaagagcacaatgggtcatgacgaactttattgaacagaaggcgaataagcaacgttccaattgtacaggaaaaaaaaaacccagcaacccaaacaccaccaccaacaataagaaacaaaggcagccaggatctgggagacatggatgaagcttgtgaaaatgacactttcttaaaagagcagaagagaaactaaaaaggatgaaggggagaaccatggatttgagggttaaactaaaaggaaaaatagaaaggaaataggaaggaagggtgtaactcatagctggttttgatatatcatcccagtctgacaaccaaggcagtctccctgcattagaaggccatgctaaaagtagatgagttgtaaacaagcctcccactggtcattagtttggcaaattagtgggttatctcttagagtcctctctttttctcctttccctttcctctgcattcaatttgtcactcattcctacaagtctaccccagaagggttgcctgaatcaaagcccttctccccatttccactcacggggccactgtgttaattaaattccatgtcgtttctcagctggaccaggcttcctgcctctaattcgtttcttcctccctctaattgaggcttagatctgccccagtattgagcttcctatactctcttgcttataaaccttctttggtggcccatggcctataaggtacagtagaactcactcagttttacatgatgcagtgggagtggaatcaaagggttcccctagacccatggatgaagagacgactaaggagctaagtctgggatgagaaactcttgcaaaaagccaactaatagctttttcctcctcatctcagaaccacccctcttcccagagtgtgtgtatacaagatgagttacttaagattgcacccaacctgatggtagattggagaaggctatctgtccctttctcagttgaatatatgagggtcttcttcccaggaggcttgcccacaccagtcttctttcccaccatggcccatcccctttccaaagagtataaacttcataccctcctcccttcaagaactcctatctttgcttagcaaaatttgtttcccaagcttggagagaggaaaggggcctttttccaaatcaggggtaaataaaaagtggcagaatcttacagtagacatcatattagagctcatttttatgaattcttctactgtatataaggtcctcactttcttattactcagcctaccactccagtttcatcttccacttttactgcttctccccaccccttcacaatcctgacataccctaaactccagtcatactgaactttccaacattcctcagataaatcaagcctttgcagaaattcatgcacaagctgttccttctgcttagaacatccttactcttcttatctcgccagtaaattcctactctcctttaagaccctgctcaactattgcctcttctgggaactctttccagactgttccagatagaattaattaatcgtcctttgagctctcatagcatttttccatatccctttgatagcaccatccttatcatggcaaaacaatataacaactaaagggatgggctctggaggcagactgcctgggtttgagttcttactctgccacttataagctatgtgatgttgagccaattacttcgcctttctttgcttcagcttcgtcatgtataaaacaaaataaataagatgatacttgtaaaacctttagaacagaacctgacacattgcaaatgttagtaaatattatacatcatcatttcttctattgttttattgttatcgtatatataacctacttgtatatgtaatatacatgtgttattatatagcactattatagcattacttaacttttgctgtgtctgtgtcttgtcttccaagctggtttatagtgttttgagggcagaaaccttgtattactttctcccccatagtgcctggtgttaagtatgggctcattaagtatttgttggggtcagtatattatactgaaaaaagcactgaaatctgagagatttgggtttggatcttgattctgctcataattgttgtatgatctcaatcttcctgagcctcagtttcctcatctataaaatgaggatgataataagagtacctacctcacagggatattttaagaattaaataacttagtacatgtaaaacctagcacataataacataataagaactcactaaatggtttttattatcagctttgtatccctttgcatttaacttaataaatacttttacttgaatgaatgaacccagccattttctggaacttgaggatcaagggaatccaggcagatactctatttgttcctaagaatccagaggaaaatgtgagtcatctccattctgtatcatggctcactctgaactgggtcaccatcctccagaaggtgacaaatgtggctggctgagtcactataagagcttttctgtaaggatttgcccgaaccccccaccatagctcattggacatagtatctttcatattaggtgcgaggtgcatacccttcctgaaatgggcagaataaagaggtgcaaaactcctggggaatcagagtggctatgaattcactcctctttcttattctgttgcctcttccctttgtttggtttatttgctaatcaactttgcccacactcacatctagtgtagcccaagtctgtgcagagaagacactttgaaagcctaagactatcatagttccagcagaataatagaaaaataacaagtgttgactattcagttctgatgtagcactgtattgaagaacataacattctagatccagatggcctgaatttgaatcccagctccaccaccaactagctgtgagacctcaggcaaatcacttaacgtttgcatcctttcatttctccatctatcaaatagaaacaataaaagtacttacctacctcttagggttttgtgagggttaaatgagttaatacatacagaacacttaaaagaatgtctggcacatagtaggtgctatataaatattagcttttaaaaacagctttattgagatataattcatctatgtgaattatatctcaataaattcacctatttaaagtgtacagttcagtcatttttagtatttcacagagttgtgcaaccatcaccacaatctaatttttagaaaatattcattaccccaaaaaggaatctcatacccactggtagccgtttccatccctgaagctccctctcccccttcccagctccaggtaatcactaacctactttctgtctgtatagatttgcctcttctggacattttatataaatgaactcatacaataggtggtcttctgtgactagcttctctcccttagcataactgtcttttaaaaaattgcaacttccattttagattcagggtgtacatgtccaggtttgctacatgggtatattgcatgatgctgaggtttggggtacagctgatcccatcacccagacagtgagcatccaataggtagtttttcgggccttgtccacctcccttcctcccctgtctagtagtctccagtgtctatcgttcccatatttatgtccatgtgtacccagtgtttagctcccacttacaagtgagaacatagcataatgtttttaaggttcatccatgttgtatatatatcagagcttacttcctttttaaggctgaataatagttcattatatgaatatatcatattttgtttttccatttatcagttgattgacattttggattgtttctatcttttggctagtatgaataacactgctatcaatattcatttacaagtttttgtgtaaagatatgtttttaaatctcttgggtatatatctgggagtggaattgctggatcatatggtaacactatgtttaatggtttgaggaaccaccaaactattttccaaagagcctgcactatttaaaattccctccagtagtgggaatgatggtttcaatttttccacatcttcatcaacacttgttattttattttatttttattttattaaattattatttttattatatttattttattttttatttattttttattatagccatcctactgtgtgtaaagtagtatctcattgtggttttgatttgcatttctctgatggttaatgaggttgagtatcttttcatgtgtttattgaccattcttatgtctactttggagaaatgtccctacaaattctttgcccatttttaaattgggttgtcattttattactgagttgtaacagttcttatatattctgcatgcaaatctcttgtcagatatatgtttgtgaatattctgtcattctgtgtaattttttttcattttcttgaagctattattattaaatagaaatttgtaagttcgcatataataaagatgacagattgtattagaaagaatgagatctaaaatcacctgatgcaccctatggtacactaccctgctcctgcactcctttgaaattaaattcaaaacagatcaagcttctcctctgtgccaggcactgtgggggaataagacctaacctctattctcaaagagcttcataacacagaagagaagatgcaaacatgtggaaacttaaataattataacatgtttaaatagcagttcaggaccacaacagaaaagatgccacagagcactatatgattaatttccaaatgaattgcatggaaaagaattgctatgggaactcaagggagggagaaagcacttggggctgaggtggtcaggggaagctttaaggagaagggatctaagcagtctgtaattaactaccgccatgcctgtgtaatactaaacaaagacttggagagaaaaaaatattgactgtttttgaggtgaggcatcttagtgattaaattgataccaccatttcttttcaacctctgcaggaatccccacagtcccacctttccaatgaagacttacgtggcctctgtctagtccagaggttaccaattaacaaagttaacaagccacatctggcttacagacacgtttggtttggtccaattaaaatattagaactagctgctaaaacatttaactggacaaatttcacataaaatattaatttccagtttctctagaaaaatcagaagacctggctaccctgcattggaacatgcattctctgggaccatggccaatggcaaccctgcttgcacatgcagaattcagtttgagacttcctagaatcatagttcttagactaaaaggtatcttaagagtgcatctgtttctattccctgactttgggaatgtatggtattataatattaccctcaatttacaacttgatttagaatatcaactaaaacccacagagaatttgacttgctgcaggccacagggctattaactggaagagggagggctaaaacccatgttctctacttctcaacggaatgttctttcaacaatctgtctttacagtctggatgcatattgtttagtagcattcttctggcacttcctaatcactgctttgtgttgttggacgatttttgatatgatcgttatctccctctctcttttttttttttttttttttttgagacggtgtctcactctgtcgcccaggctggagtgcggtggtgcgatcttggctcactgcaagctccgcctcccgggttcacgccattctcctgcctcagcctcccaagtagctgggacaacaggcgcccgccatcacgcccagctaattttctttttttgtatttttagtagagacggggtttcatcatgttagccaggatggtctcgatctcctgacctcatgatctgcccgcctcagcctcccaaagtgttgggattacaggcgtgagccaccgcccagcctgatcattatctctcttaaatgacattgtaacatcccaaactgcaaaggggcccacatcaagtttttctatgaaagcccatgacgtggagcacaatgctttgtactaaataggcactcaggtggtatttgttattgattgataggattctgaagaactcagtatgtaaccatccttccaaacctgggtgtgttaaaatgtgttcattgttcagagacaaaggtctggtacctttaagaagtctcagctttgcaatgagtttgtggggcagctgcttggcatagatactggggagggacagggaggagatcattatgtaggcacatggcgctaggatgtaccttactttgtcttggctgttttctgaatgttaagaggaaggatgaaataatagcagatataggaaaagttatttaaagccttgccttagatcagtggttctcaggcgtgaggatgcatcaaaagcccctggagggcttcttaaaacacagattgctatatcccacccctgagtttctggttcagtaggtctgaagtgagtggggtccacaaatatgcatttctaacaagttctcaggtgatgctgatgctcctggtccagggaccacactttaagaaccattgctctgccaagtagttggctcaagagtagctaattagagaaatctgagcacagttagcaactggaagcaaaaagtccatgaggaaactgtgtgatgtacgtagtggggagagtgtgaactggctaggaaaccagaatggtcagattccagtaccaggggtatcatatctttttaagcagtgtccaaagaataagtatattttaattcacatattcctgattcattttactagtgtttcccaaaatgtgcactgtggaaccctagaagatattaataggtaggcaatgagattaaaaaggatccatagagaaagatgttggaacattttgaattaaagaaaattgaacaggattctttacggcttctaagagcctttaaaatgtgaatgaatgaatgcactgcaaatctccaaggaaatatagaatatgcagtatttattttattaatttatgcagaatattcagaattagttgaccaaagatccttcgttaacacttggctgtttttttgtaaaatgttgtttaggaaaccttcattggtttacacctgaaatgccacaatattttatcaatagatgaggttgcttgcaacagtggaaacagcactgcactgggagtcaaaacatctgggattttgttctgtctctgccacttaggtctgccacaagttggcttgctcccatgaaaaagatgggtatgattgaaatttatcatccctttgcaaatggtagcagccagtagctccacccaaaataagtaaataaaatctcacacaatcaatttttttaaatctaatttaccatacccttaaggttattcaatctttttgttttttttttctcatgttaccttgtgtaacaggtattcaaccttcaaagccagaaatatgagaagccttatgctgagagtttgatagaaaggaagggaggaagggagaaagtagaaagggagaaaaggaagaagagaggaagggatgaaaggaggaaaggcggggcagggaggaaaggaagaacagcagaaagaaggaaggaaggaaaaataagaagtcagacagtcaggtcattgcagaccatgattccatctgaaaagaaaaggctgagaagcatagacacatcctgtgtttatttgattcctggctctaggagaaagttttatttcaccaaggacagagtcagctcgcttgtttaccacagagtattggaagtgtgtgaagtgtgtttgtcccccaattaaccattagttgtttttttttcacttgaacaagatacaaacttgacccaatggagaaacattgcaagttgtatgtgggaggatgccataaaatatctacattgatatttaaataaaatacctgcctacattaaacgatctttgaaaagaaactgatgggattcaaggctgaattatatttactgaattcctacaaggtacataaatatatgcaacatggagtcccttgtagatccatgatgaaatcatatttcttttaaacacaagggtcaattcaagttaaaaaataaaataaatgtttacaagctttctgccttttttaaatttcaaagtgaaaataatatttaattgcatttaaatatatacatatattttaataactctgattacctatttgattgcataaaagaatgacgagaacatcaacactgcttttagccacaatatttgagaagtagcagccagaagtgtttttttaaatattttatcttgaaatcagatctcatgtacctaggtgaactgaatatgcccagaggatatcaggggactctccactactgtagatccaaaaaacagagggctaaatagaaattccacttgctgtcatccagcaaaatagagatggctttgctgagtccttagatcatgtttagtttcaggaggggttgagctgtaatgactaaattatctggtcactctaaccaagcagctaattaatccagtcaaacaaacttatcagtcatgaaggtgaaattgttttttcatctagaatttgatcataagggctttcaagaaggaagctccttgagtctcccttgtaaaccctttctgcagtatgcctttctttcccacgtctgttgaaaattatttattcttgaaccagcttcagtggtgaacagcagctggttgctaccctctcatacccattttttgtcatctggaacatggttattcagcgtagcttcatcttcaaaaggtgcctgatttactctgggattgggaatggagagaataattttgaagctctttctctttgcctgtttccttccttccatgactttgggttattttctagtgatcttcagtattaaaaggcatactgacagctcttttctcccaggctgattttcagcttgtctactgagcttttttgggtttggttttatggaatgaaatccccttgtttggttttccccacattcacactgaggctgtgaatgtccaccaactcaattctgagctacaattgagtagtgtattaagaatacatgtgactgccacatgggccctggactgctgaattcatggtcaaatcattgttttcccaaccatcatgcttgggggcaccacatcagcctacagtgaacatggattaataagtgctgatttagagtaaatagttttctggtaagtggtacattgaagatttctcttcccctttctatgatttgtatagtagccacaattttctatatcattattgcagcttcccagtactactttatgtagaaatcttgcacattcctacctctggcttttgctcaggctacgactctatggcagtggcagaaccgttttaggaatgtcttctgctgtaattttctctttgtcccaccacttccactttaaacttctggtgtattccctaatcaaagaggcatctaagttgtctttagtgagaaaccatctatatatacaaagccataacatgtggatgaaaaggacatactgtcaactctcttgtgccagacacccagatgttggcaagtagtacttggaccgaacagcatagtcgttgaacagcatcatcttccccttttttaattcatccagatgttttggcatcacagacacatagccagatttcatccctgattttgtcaaaggcttaaaaaaatgtgaaaaaataatatgcttctcctctgatgaacaattaccaatgaactctgttcaaaagggaaaacataatgtttcatttaaaagaccaataatattgaattaagataaagttcccatgagagtatattttacattctcatgaatcacggatgagtttattatgatccatgcttgtatgaaagactgacaaataaattcatattgatttgacatttaaaatagcatgtctaaaaatgtacagcatcacattaagtatcaagtaattattcaactatcagcttcaaatgtacatgggagaaaatgggtccagaacccaaaatgtagtgaaagatttaaatgctcaaatttctaccacaggttttttttttttttttttttttgagacaaggtctcactctatcacccagtctgtgtgcaatggtgtaatcatggctcactgcagcctcaaactcctgggctcgagtgatcctcccacctcagcctcccaagtagttaggacttacagtcatgtgccgtcatgcctggctaatttattttatttttatttttgtagagacaaggccttgctttgttgtccaggttggtcttgaactcctggcctcaagcagtcctctcacttcggcctcccaaaggactaggattataggcgtgagccactgtgcccagccttctaccacaatttttaaagaagccaataccatacattaatccatttacaagggctcacgcaagagtgccttttgagcctgtgtttgacaggaagtttctattcagatcattgtgcctagagtatatagaggggttacagcaaagtgctgtactttgggttacagtaaagtgactcaattgatgtaccaagatattgatcatttacaccctttaggcctgaaaaatatacttttctttgtgttccatgaaactaaaaaggcagggaagcattaaagagacagcaataaaaagatttgatggtatgtatatgtgagtttgagtgtttgagctggcgttgtgagtttgtgggtggattagaaagcatatggctaaagacatgtgcaacagatgcaagggcctgggctttggccttccctttgaaacttctttatggggacatgtgctgccttgcttcctggattaagaccacatttgcacaatttgcacattgtccctcttgggcctgcttcccaccggagactgcatcttccacaaaaacaaggcaagaagtaaagaacttaagagagctgattgtgaagtccaactacatgggttcaaatcctggtaccatcattaattagctgggtcattttggaccacttaacttccaggaccctcattttcctcatctacacaaagggctaataacagtatttacctcatagttgttatgtaaagtgcttatcccagagcctggcagagagcagacactagttgatcattatgattattgagcaattactatgtaccaggtgctttattttcatctctgatcctcacaacagccctacaaggcagatactattatcttcagtttacaagtgaagaggctgaagctcagtgagataaaatacactgctcaaggtcacacaaccaggaagagcagaaaccaggctccaagtccctctgtccctcactcctaaggcctgtgctatttgccatatcatcatcccactggtgcctctaaaagtttcttcttctagggttcatccctcttctctcttcatcctcctcttggcctaccctggcctgagaactgcttggcacaatcctatacagcaggtccttgaataacattgttttgttcaaagccatttagttatcacgttaatggggaaaatttggttttccccagggccactgtccatggacaggatggcgtcctgaccagggtggttcccaccttttgtgctccttgtgctgccaggatgggctccggccacctgtgaccctgaactggaatcagcgggttagaaaataactgaatgagtgaatacaaattattggaaaatgaaaactcgtaaagtacacaatgaccatacgaatccatgataataaatgacacgataggaaagcgctcaatgagcgcttttgtgattcttctggaactgctgggtggcaggaggtgctccttatgattttgctttgcaaatgtttattccttgacctgacccgccattgctacaaccgctgtcactcattgattcaccaaaaattaggcaaataattctcttacttgtttttattaatctttcctaaatgtatgtgtagctcacacttattgttaatgtttaattaacttattaatgtttaatattagaagtgtttgggtggtttttgtttgtttgtttttttgtttgtttttgagacagggtctcactcctctcgcccaggctggagtgcagtggcgcaatcacggctcactgcagcctcaacctcccaggattcaggtgatcctcccacctcagcctcctgagtagctgtgactacagacgtgtgccaccatgcctggctaaatttttgtatttttagtagagacagggtttcaccatgttgcccaggctggtatttggatctttatttagaagtttggtgatatttttgtgaccagaaatatgctgtgggtacttaactcttgtttatatcaattagcctacagtaaaattagttttgttattcgttgtttcacttaaagtccagttcccaagaacctgtcaaggacgttcagtgaggacttactgtactcagagacagcagagagcaaagggcaagaaggctggttggaggacgaggaggcctagagccccttgcctgcttttgcacatgcatctgctcctggtggatgactcacttaacctctccgtgcttctgcctcttcaactggaaaatggaatctgtaagttgcagcactagcttctgtgacattctactaggcctccaggaagaggaggccatccctctatatgtccagtcagcatatggggaacagtggggctgtgtgtgactcaccctgtggtgtgccagcctcaggcttatactagcctaggcttatactcccagatcctgagctagcagctggagctttgggatctggaactgttacagggccaaagaacctgcttagcttcagggctgcttctagataaactgccaggatgtgggcaaagcatttgtcatggaaggtggggagtgtatgtaggttgtttcaggggctgctttgtgggaagccaaaccttttggcaatgggctcagaactggctttcctttttgggtgtcctctaaattccgagggtgcccccacaccagagggtctccacttctgccatccctaacctagtggggagatgaatctgatcttttgtctcaaagcccacattaaagaggaccattgcatgcttcatcaccaggctgtgactcccagacctcaactcatgtctttttccctcttcaccagggcagaggctagactgtttcctctcctctccctgaacaatagcagtgcccagattttggagggcataccgcctacctggcactgtgctaagtactttgcctgcatttccttggtaatcctcatgtaatcctacaagggaagtaccattttgtcacgatttaacagaagaggatacaaaagctcagagcctggaggtgacttgctcaaagtcacattgatagtaagtggtaaagccgggactgaaatacaggtctaacttttgagacaaccttttttctttttcttttttttctatttcaattacataatcctaatcctgtgcgtgtttgaaggggagagacaggggagggagtgagatggcaatttgcttgtgacctaaggaggccctgaaatctcctgggaatgaggatgggggacctacatgagttgcccagggcactggtaatgcagcccacaccagcagtcagtgatctccaacatggagggctccaggcctgcctagctgctggctgctactggaggccagaaaaagacagctccagtgtccttctaggctgggggtggttcttgcctccagggcttatggaagaacttatcagacaaaactctgccctttcaagcagaaaagtactttacaaagaacatagagaggtgaagtgggtacttttcaatttttgcctgattatctaatatctaaatgctttttcttcactttggaatcctgacctgacctgttttgtgccctgtccacccaccaccactgagtcaaagctcagggcctggcatccagtattagtcatacctatttgttgcccgaatgaatggggctgaaccctggtctgactctaaaatacatgcttgaaaaaaattattatggaaattttcaaacacatacacaaaagtaaaaaatatagtataatgaacccccaagtatccatcacccagattcaacatctatcatgattttccatgttagctttacctatctctctttctttttccctcttatgctttaccccacatgtttcattatgcaactcaaaaatagggatatttttatatacaatgacgaaattattatcccccccatcgccaaactaacaataattcccttcaaaccatgctcttgagcactacactggagttcctccattctactttctttcccagtccccaacaggaagcatttctcaggcatctgctcttgcacctcctcagagctggaattacagtttgatgtgtattgggtactcacaatgtgcccttttaggtaagcagggggccagattcccctctccctgttttacaaagaagaatggcgacacacagctattaagtgccttgtacaaggtcacacagtcaattagtggctgataaatgggactcaagcactgtggctgggtctatacagccccaaatacagtttgcaaggaaattaaatgaagggactcgtgtcctggggacagtaccgtgtgttttctgttgctgttgaagtcattgcacttagcccatcaggacagcctgattgatgggatcagttggactcctatgtttgttttcctcatctgactggattgcaacaatcacctacaggcaggctggccacacccgtgagtttttctcttctttttttccatgttcctggagctgactccggagcccacatttctcctgtctttctaggcttggacttgctctctgccaaagcagatgactcccagagcagccacagtctgggacagggcaaatgtgagaagcagaaggactagcttaactgcttttctgttcctgcctccttcttgttccaaagacttactcttagatgcttggctctcctgagcttgatctccatgtctaattctctagacctcttccactcccctgatatcccacccacattttccaagtaagtctctcagagccttgtattccaaaatacaaactggctagtggaaagaaggaatcattgctgttggctagtggatgactgatcagtctgagtccaaccaggaaaatagaaatcactgagtatttatttaagggaaaagggattcagtgcagggaattgatcacacaggtgatggaaaagctgtgatgccaagcagaggacaatgaagcaacctagagattagtcacagcagggagctgctaccattccttggctagaacctcagggctgggacacttagtagaaacttgagccacagtaacctggtcagcagtgccagagccacaaagagacacagtcactgctggggacaccacatgaagcagagggggagggagagaaataccctggtttctctctcccttttgctttctaatatcctaacagtgccttccattggccaaacccatcagagcctggggaacagcctgcaaaggccaacctgccccatcagcttccctgctacaagagcagagatgtgaaaaggaagtaatggacttgggggggcaaacaggcctggggacagcacagatctcctcctccctgccacccccaactaacttatttggatatgtcagggtctatttggaaacagtgcatttactcaacaaaatgattctaaagctgacaagaaagacccttaaggaaaagggtgtgggtggagcacgaacccgcttccttgactacctgcaagtcttagcatccagattctagcccagtcctcttatttcacttcctcctgcatgctccatccctcctcctcccacgcataggctgactccaacaaaggcaggccggccattttgctttctggcaatgtgtgatgcattcattggctcccaggactgtgtaaacccaaccttcttgcctgcagggtttcagcttggcagccaggctctgaactgcagtgctgtcaggcaggtgaacccgctggcaccacaatccagaaaacatatctcctgattcctcaggtgttctacacgtttgaatgtgtagatgaagggagatggctgggagggggaaaagaaagacatcaaactatttatgtgctttcccacaccttatttcatttactctccacaactcctcaaggcagatgcccttcttcccattaaaaaataaatttttaaatcttagaatacttttagatttacaggacagttgaaaagagagtacagagaatccctatgcatccttcactcagtttctcctgatgttaacatcttacaaaatcatcttttgtctgtttttacaaatgatgaaactggggctcagagaggttagtgacttgcccaaggtcatagaactaggacacagcagaagaaacaggcataaatccagttagatcttaactgtatcacaccaccaagttgaattatttgtttccgactcattatattggaagtcactctctgaaccttgaacccttcacttcacctcatagttgggttgtaaacattatcagagaggatttcttccatagatccatagtatgttaacactaaaagatacatctaagaccatttaatctagggaaggcaaataagtttcatttcatttgccgactttaattgagcagtagaggctgtttggaattccgtgctgagaatgattctaaatctatgtttttgctcattaggaaaaaaatgctatgactgattattgatacctgccatatatgttgactaggagagtggtggaactcatgttacctattagccgtttctcagtgaatgtctctgcctcattagtggtacagctaagaacagaactcaggctcctgactcatggtctcttgttctttctggtttacaatggactcacaataacaacaataatataatacagtgtatcacataatgagtgtctactcactgccaggcactctcctaagcacattccactttctgtaccttacttttaattctcagaacaacccttcaaggtaggcacattcaaccccaaacttagaaatgcagaagcctaggctcagtgaattttaaaaacttacctaaggtccacagtgagcaagtggtaaaactggaatttaaacctacgctggtctggctccaaagcctaaaccctgtggtctcacttcctgcaaacacaatgttgaatttgcgctcacagcaggtggagatgaccctggtcccactgctttgattaagactaaactggagtgaaaaaatcatttttgttcttactaattttcttaaaaagatttgttcacagttccttacttagatggaactgattttttcgggctgtctcatattagatgtgatacaaattgacatgttaggagagctgatgtgaaaggcgacctggttcacttacaaataaatgattaatataatctcattgtgcggctagcctgcattactgattctctcacttgggaggctcagaaaaacaacaggtcagacaataaaacccatgctagcataagactatagtgtgggatgaccatggatgagtcagggagaataagaagataattaactaagagggagttctatggagttcgaagataattaaaaaatgttccttctctatcctaagaatatctgacattattagcgaaggcaatgaataagataaggggaagaggtgagttaattagaattatgagatacaacattttaaagaaattgacagggatcacatttcaacggaaagacattcaattcaaccgacttcattatagcaattcaacattgattagggacatgttatgtgtgtggctgtgctctgtgtgcttagaggactactgagatgctgtaatcttcctccctgacattctactgaatagatacccaagttttggcagcgcagtaaataatctcttacacacacatttgggtgcaatttctaaaattgtttctgcaaaatagtattatgtgccactgagtagatatcttgtatgccagatattactgttcctgccaggctaaatgttcaaacaacatggaagcctcagtgatagccaatccattatttatctacctatattcacttcagttgccaaaactattctaaatataaggaatcccttccttagaggccccaatatggctttccgtattgttctgagtcctttctaactggttaatgcccatgccatattggttatcataaattttgaatagcatcttttctctgctcagaagtgtcgctcagtaataccctacctcttctgactcctcctacagtgtaatctctcaccagtcctcactacattctgaactgatgttccagctccacttaaatctgtcatgttttgttccttaacatatgctattccctttacttggaatacactctctttccttgtctgcctaacaattgctgcttgtctcgcaaatattttctctgtgaagctttctcagtgcccttaggtaccctcatggccctcctgaatttatctctattataatgttttatattttatggcaagagtttgttggatctttgcccacttgaatgtgagccccttgagaacagggactattttatttatgtctgagtctctagggaacaaaagagggattcagggcttatgtggtaaatgaatcaatgaatgctcccagttcttcgtcatctttagaggctacttccagggcttttaaatttggactcccttttcttccaagaggtggtgagagcagggtaggtggacatgatatttaatgaatttcttttaagtgccagacattgtgctgaaccatttacacaaacaatctcacgtctcaagtcgatgtttttattttcatcctcgttttacagatgaaagtggaaaattcagaccagtgacttgccacattcagaggagtaacaaagatacatagcaagtaggctgcaaagctaggatttgaacgtaggctccaatacctgcatcagctcccttgcactgtgcactcttccctcgcttgtgtgtatggtgagcagagtcagctctgggcaaaatggtgaaataagccaagtttgtctttagtgtcttcagactcccagtgtgtctcggggactcagtactacagtgccacctacatgctgcaacacctactatggctcctacaggcagcccatcctgctgagagcttctccttcctaactcctctaagaccttgacctctggtttgtgttttctgaaggtaaactgccttaacctaaccttttccagagcacatattatatttattggtgccttcccagaaagcaatctttagcttaggagcaggtagctcccacgggaggcatgtaggtgtttctgtgttgtggtaaggggaaggggttgtctgggggcctctatcaagatacaccatggaggcttctcctacaaccaaagggtgtttggcccctttctcagatggctgagggccctggagtcagatcaataagcatttgaatcttggctctgccattcactgattgcatgatttcccacagttaatctcagtgagccttcgtttcctcccctgtaaaatggatctaataatagttctcatctcctagacgtgttgtgaggatgacatgagataacacacttacggtgtccagtacaaaataagcatgtaaaaatgttaactgttcccttaaatcaatttttagtagtcttctgcctcacccccataaccatccaggtctctcttcgcttccttgtttctcttttcctcttctcaccaacaagtctctttcttcaaagtctccctttcctttcccaactccctcccaccagtacgctcaacctttggcaaccctctgtcccacactttccaggtcaatcccaatttcagataatctctcttgatatcaaactgcatgacctgatttgaatcggaaaacagagtgaaacagagtcccttgctctgaggaatgttgctatggtctatcttagatcaagaagacaagagctgccttggcagccctacatcataatctgatgagcatgaagaaggctcaccttgcctataaatatttgttttttgcctatgagtgatgccagaaaccgtcatggtcggcatacaattcctttgagtcaaattgcaaggtttgtctgtcagggttgccttggtaaggcagggttattatttatatctgagtgcaaattccttgatcagagcctttcctgtcagggagaggagacggaagggttccagggagcctactccccacggaagaggaaggctgtgctagcatggatggggtatgtgagtgtgggagctcagctgactgagagctgtgtccccggctccattttgcctaggggcgagccctgtgtgttgcaacagatgtgtgctttggaatcaccaaggttgggaagccaggcctcagagggagtggctggaggctgatctcatcctgaaatgatgtgggcttggattcccagagggtggagaggaggaccagtccagagagaaggacatgcttttggagggaggtctaaagacaaaaagagggctttagttattttttgagcttaggtgtaggtgatggttgggggtaagtgacaaaagaaaataggtcctgaaaggggggtgtctcctttcatgattaggaacagaagaatgaactcaaggactgcccccttttcttcaggaagcaaacaacttctgagggtgtgacagggttcactgggtgttcccctttaagggaggttagcccctacgtgaagctgcttggctggtagaggataattgggtgttccccaatccagataagcagaagctcaggtgcccctccctgtaggcttttcagctttctttatcacttgctaggcaggccctgccatccttgggagtaggtatgagagagggagttgagaggccaggctttccctgcccctgttcttcacagaacacagctgaaaaaggaaggccagagatgtgacaccccccagccccagggattctaccacacattgcaaacctcacagaggatgcttattctacaaaatttgtgggcatattcataggtactatggagctaaataatttgaaaacaataacaaaacccatttactgattatttggttaataaagacctcattccttcaaagtatgttgctaggagccactgaaagtggacttgacctgaggagcagcaaggagcttcctcctgctgtatacacagacacacacagacagacagacagacacacacacacgcatgcgcgcacacacatgcacatgcccggatccttctccaaacacgtccatgataccagggcagcagaattggggcacattagagacacaggctctgcccacattctgaagctccctgtcattcccaggtcttggtgcttggccagactccccttacccagactcatagcctcatagctatcattccaaaaccccaaaagctctggaaactgagagcctttgtacgtttatgacaaactcatttggcagcgcaacttgaactgacatgaggttatttatagtctttatttttcacaccctgtgtgaatattcatgtgtttttgctccagaaatatcaatgtacttgattactgggtactgcctcagaccccactggaggtgatatatatgtgctgtatacacccaatcgccttttaaaagtccaaagcattctgaattccttcaattatactaagcctcccactgtcttataatgatctgtttggcatgtctccctcattagcctgtgaacttcttctccagtgctcagcacacagtccagcatggggtggaagctcgactaatgttttaggaatgaagaacgaacagtctttagtgattccggagacttgttgtcatgttctttcttacatctaaactaaagtacgtcatgctaccattcgtttattctgtgccatcaatagcgaggaagaacagttggtcaggctccttcattttttttcctcttgaggctaaatcgtccttataatcctaatacctttaaccttttcccctagatcctcttttccaatcccttaatcgtcttcattgctgtcttctgaagtctttacaggttctttccttccgaaattgtggcctagtgcttaggatagggctgcaaagagcccagctattacacataataggcctctggtttctatggtgcttttccgatcagtttcatttggctgggctaagaagctttgcctttaaaaatacactcgcaggacaaactccaggggcatgaacaactttcacctgagcatgctggttggtaataggaagggaaaatagcactgtctgatcataagaaactgtaattacgaaagctgaaagcaacaggtaacacatgcagtaggcacctgtatacaaaaaccactgttgataattacggtacctcagcctattatttttaccttgggagaaccggccttgtttgtgcgcatcatgtgccttttctctcataaggttgctaaaggccatttctgaccacttcccattaaattcagggagtgaacctgactctgtcagggttgctgaaaatcaccggattaagttaaactcactaattaagcctgttagacttcctgtaactcacgatttttcttggcataagtaaaaacatttcactcagaggcaaaatgtgttatattaataaccaggaaacaagaaaatacacatagtagcattttcggaagcaaattctgtcatccgcattctgttgaaacggccattgtcatttctcctaatagcctaaagtgtttacttttggggtggaaactatacatactgtgatggagattcagagatacgcttttgtcagttaaattcgaaaaatatattcaggtgtgcttgttgtgtcccccccccccccaagcatgagtcagagcctttcatggggttttgtgtaaatgtattttctaagaggtgctgttgggattttgcatacaggtcattctttttaaaaaggtcacgttgcaatttttctatcctttcttgtgttgttatccctcagggaagaagatgtagaatgccaaattgcaaagggagcttgtaaagaggggaacattaaaattggataaccaagagctcccagagagggcctcaatggctgaaaggagccccttctgagcaaatgggtagcagcgtaaaagccaaattaacctgggaggagaaggtatggaacttttggagaaacactttgtttacctcaccatcttaccatatccagctggctgtttctccaagaatgttagtgctccagaagggagggaaacctgtccccactgctaatagaagaggctgaaattttctttcagagtttccagatgtccttggcaaatgctagcaatagtcattctctctcttttaataattataataagctgctttttaagggaacattaactgtgtggtaggctctatgctaagtgttttatataaggtatctctattaatcttcactatgatccttccaaaaaggtattgctattaccctcaatttccataggaggaaacgggcccaaagaagttagacaacctgggcaaggtcacccagctagtaagtggaggagccagaacttaaacgcagatccacctgacaccaacacctggttctgaaccatggtgtgcaagtccttgtaaagtcaaacagtctctttaataagcttgactatattttctcttttaccaaatcacagaacatctggtctgcttaattttatgagactgtaattacagcaatgaaaaggatgttagcctactctgaaaaccctagctgaagggctttctattgctttgtttagagatttgttcttttctctccacctccacccccgactccccaaattggatagtaagttcttcaaggaaggttctggaaagtggttttttttttttcttcaagttctgtgttacatgtgcagaacttgcagtttggttacttaggtatacaagtgccatggtggtttgctgcacccatctacccgtcacctacattaggtatttctcctaatgctatccctcccctagccccccacgccccacaggccccggtgtgtgatgttcccctctctgcttccatgtgttctcattgttcaactcccacttatgagtgaggacatgcggtgtttggttttctgatcttgcgatagtttgctgagaatgatggtttccagcttcatccatgtccctgcaaaggacgtgaactcattcttttttatggctgcataatattccatggtgtatgtgtgccacattttctttatccagtctatcattgatggacatttgggttggttccaagtctttgctattgtgaatagtgccgcaataaacataggtgggcatgtgtctttatagcagcatgatttgtaatcctttgtgtatatgcccagtaatgggatcgctgggtcaaatggtatttctagttctagatccttgaagaatctccagtgtcttccacgatatttgaactaatttacacacccaccaacagtgtaaaagcattcctctttttggttctggaaagtcttatgctcctctgctttctatagttctcatagtgcctggcatgtagtgtgtgctccataaatattgactgattgatgaatgtgtggatgtttcatgcaatagtttttgggttgttcaacaccatttcttaatgctaagcaaacaggttagaaccttcaagatgtctgttgtcttaatctagttgcttgcactgaggtaactttttaatatcatctctgcacaggagctgaatgccttctttggcacctggatgattgattgtgttttctccttttcctcggaaagctctggtattgcgcaaacgctgctttaggtgattaacaatgccgccaacttcaccagtcacctttgcagacaattcttgaattttataggaaagtgggaacctgtttaagtatagtttctagttaattctgcttccccatcctggtttgctcaatgctacataaaagattttctttgtggaatgagacagaatagaaaaaataaaaatacattctcaatggctgggtgaagagagtccttgagattttaccagcttggtatttctcactgttggaacttcaacccaggatgcagattcatcctagtgagcctcacaggaaactctgccttggtctagaagatacagtgcaaatatataggataggacaggtaaggtcagcagaagccacttttcagcacataccatgtgattgctagaataatacaaataacaaccatttactagcagattactatgtggcaggtactgtgctaagcattttccagacattcattattgttgccatttttccaggtgagcaaactgcagctcagagagtctaagtgaatttctttgtctttaagcagtatgagatagaccctggacttgaactcaggtccatctgattccagagtacatagtccttttgctacagtgctttgcagggagctgtgctggcttctcaaatggtttggggctatctgtgtgaggctgacaagaaaactatttaaaggctggtagaagagggccctaacagaaggtctgactctcattttctttctatttgcagaagataattctttcctgtttcaatatcagaaggggatctagctgaaggcaaaaggccacagggttctggtgaggcacaagttcaaaccttgctgtagttggacctgttctactgactatcaacggcctgggtctgtgggtgatcatagtgtcagggggctggagattggaagttcagagtggaagagctggcatatgccgcaaaatgcaccctgttgggatggagcaggaaactcaactgcagctgagtttagtggggcacccaaagagagtggcaacaacaggtatcaatttagagaagcacttggctttggtgaaagcagaagtcctgcccagcctagctgaactgagcaggagcaggtgaggcttaggagtcctgccaggtgctagtagcaaggatgggactctagtccttggaggcaagggtgaaggagttgggagcctgggaagaaccagacaaaatcccagttccacagaaactgaatgactagactggtggctctcaactgagacaatactgccccctaggggacttttggaaaatgcaagagggtattcagaggactggaaatggggatgctagatgttctccaacgcccacgacagacttgcaaaatgaaaaatagtctagcatcccgaataatttttgaatgttctgctggacttccatggagctgaaaactgcttttctaattatctaaacttttactataaatgttttatacctaagcataaagggttttgcttcccctgccccgaccccacagttttaatcaactattctgtaaagatatggaagattacatggttacagaggatcacacagactcattcaccatttcaggaaatcatgtcaacaattgtgatgttgcttttggaattaatcaatataacatatcagtttgtgtccataactgttgcattcatggggattctatataaaggcacaagcttctgactacttcatttaatcattcaatgtagtcctgtgtgagcatttacagagttaaatacatagtgttttattatgtattgctttattttctctttatgtggcaggacatatagctatctttttgaacttatgcgtgtaggtaggttatagtacctagaaatttaatttcaggatagtaaaggggtgaagcaaaagcagatttattataaaagagaggatgttaagtctgataaggttgaacaccactgtgctagcctgatggcttcgtgagggccaggaccatgtgttttgcttccgtttggcctaattaactgaggtgcttataaataatgaataatgaatgtggatgcaagcacacagctggagtcaggcatgtaggtcagcatagtcggggtatataaaactggcaggagatggggacttttttttttgagacggggacttttgatcaccaaaagaaggcaggatcccagttatcagaagagaaaccatagttcagagtttgcctcaaagctagagcgtcctaatgtcaaggcccagggcttcctacagtcctcttatcttgagacatgctggagccaagggactgacgtcagatggtcccagtggtgaagagagttgtgtttacattctcacttgctggtatcaatcgtaggggcccaaagacctcactacctaaaaagagggctgttttccagcttagctgtacctctttgcattgttttgtctggccaagacagagaggataccagggaaaatgaggctcgagtattgtacgtataatctgtcaatgccctccatgcccccattaggatctcaggctgtcttggccttcaggcagatccagctcccccatttttctgttgttgctgctgctgttttttttttttcactcccctgatcccatcaataatacgtgtactccttccttctgggtcctgtcctcaaaggtaactgctaaatatctgacaaaggaatggctaaagccttcagggctcctgataagagaatgggctcccacttagcaagaagggcagggggcagcacctcacttagagatatggtacataagtacagagggaggtattgaaccacctgttgtcaggagcagaagggaccctgaggtcatctggttcactagatcccaaacctggctgtacaatggaattaccaggaatgctgttgaaatacagatgcagtgtggctcctaatcctcagagtctgattcagtaagtccgagatgaggacttgaattatctgcatattattaacagtatcactggtgattttgatgaggaacccagttagggaaaccactcagactgactttctcgttttatgggtagccagctgagtcaccgacagggatgatgactcgcctcgggtcacagagcaagtcatggcagagttggaaatggaactcagggtttttcctcccctgtattggtggtgggacgatctgacattattagtgtgggaagaaggaccttaaatttcactgtacaagctgctgctcactctgcctagaggtagaggacagagggcatcttaaaggttgtttttcgttataataagcagtacatttacttcagagtttggaagtgaatcaacaaaatacccatcaagattagtaggacaagaggaactcgccaatatctttgacgatgtctatccatagaaagccaagtgaaataatggaggtaattatccacctattttctttgaacactttgaccgaaaatctcctggtaactgagggaaaataggagcttttaaaaattgttgtctcaagtagcctgaatgacttcaactcccactttacttttctttttctgtggagatgctctcccagatgcttgtctcctgggggtagcagctttccacagacaaaatgtccacagctttgggaagcatggagggagaagggaaacattaagtgaaatgggatgtcaggtcaagctgcgttggtggtgatgtagtcacctgtcgtttcaagataaccttttggatcctagatatgtcgtagctggggccttgggacaagtcccagcagcctccaagccacaagcttatcattttggcgcaattcaaggcagcctccttgaaaagctccacgatggcagctgctccatcagcaactggatgaaaacaatgccaaatctctttatttaaaattaggcacttcctattttggttcctaaatggcaaatctatctgctctctgcctccagtcttctgtgtccaaagctgccttaatgtgaggtatttcagcagcgatcagcaagtgtcttcctatttataagcagcagagctgccatgggtcactgcacttgtatctctgagcaagagaagtcagggggcctattggaaaggaaaaatactgtggcctccgacagtgaaccttggcgtgggtcagggaagactgttcaagtgcaccagagaatggagctgtgatgagttcagttttgtatcactggcatggaagtcagtagcctcaagatctgggaagagtttggtcaccactaatttgctacatgaccctgggcaagagtcgtcccttctctgggcttcagcctcaccatttctggggaaaaggatgcaccatttaatacatggtgccatttactgtgacaaccggcctgccaccaaaatataaagctgaatctttatctcactccttattccaaaatataatccaattaggtcagatttagatgttaaaaagagaaaccattaaaagattagaagaaggcataagagaatattgaggtagggagtctttgcaaagcaacgagaaactgtagaatctatgaagaaaaagaatgatagatttgactatgcaaaaatttaacaacctgagtatggtgaaagatatctcatgcaaagtggaaaggcaacatataaaccaggataaagtcacaacatagaaggaagacaatggtttattattcagaatactccaccagctccagtgtaagaagtgcattattttctttacagcacttaccatgatttacaatgacatgatttagctacttgtttttctattatttcctctgcttacatgttagcttcatgaaagctcaggttttgcttactcactattatatttctagtgctagactggtgcctggcatacagtaggtactcaataaatacttgttgaaggaaggaataaacgagcttctgtagaccaatgagaagataatgaacaattcactagaaaaatgctcaaagaataatgaacaggcaattcacagaggaaaggcaaagggcctatgccctattaaaaggaacaccaatcagtaataattaagaaatgcaaattaaaacaatattgagatgattcagatgtcagcttttacctctcaaattggcaaaaatttaaaaggtcactaaaacccagggtttgtgagaatctggtgaaacagcacactcattcactcttgatgcacatctggagggcaactggaaatgttatttgagtcagcaattcctgtcttaggagtttacctttgcaaaatgctccatgtataaggatgttcatttaaacattatttgtaaataggagcaaattgaaaaaactaaatgacctcggtgaaggactggttaaatcatttataatacatcccaataatgacatactaagcattactatgctaatgattaagagtttgagccttggttagactgcctaggtttgacttcctcctctagcttttatgagctgtgtgacttcgaccaagtttctaacctctctgtgccgtttctcatctgtaaaatgggaaaagtaacaattcatgaagttgtgaagagtaaatgagataattcatatgaaatattcagataggacctggcacagagcatttaataattgctacacattactattccaactactagtataatgatgacaatgacgatgtagccacaaataaagacaagctagatctttaaatactgatgtgcaatgatatctccaatatagtattgtgataaaagcaagttgcagaagagtaagtatagtaggatctgatttttgttaagggtattatatgttacacatacaggaaaagactggaaggatagacagactgtcaacactggggagtagaataggagaggtagattttcccttgagcaataattagagttgtttgaaactagcatgtgctacttttataataaacaaaagatgtaaagggaaaaaaaagctccgtttggaattccgaggacagttaatcccaccaggcttcacatcccccagttcttggccacagcccaaacgttaagcctccctgctcgtcatctgtcctctcccataccatcctcatactgctcagtgctcccatccctgccaccccgactcatccacctccccactaccgccctctctcactcttctcagtaccctctggaagcccccaccttgcagtaaacaattccccctacaccctggataaattttacagagcactattgtctacctccgggcctggaagtgctgaaacctgagtctccacggcggatctcacggctttgccaccagcgccctctagtggacactgtccacactcccacactacaggcaccctagggctgggaggtggggtctgtgctctagcttcccctgtttgcttccaggctgttagtcctccgtcctcagccaagaactcctccttctcatgccatctggctacttctctcctcgttgacgcttctttataaccatcccctcctggtcaacccccccccacccccacattcaacgaagagttcgacatctggctcattgtcttcttctccaccccaagtcctgacatcattctgggtgagttggacatccgtgatccatgtacaggacacactctcatcctagccttaccatgcttcatcatcagtcagaaccccctaccatctacaccttgctggctggcctcaacgctcttctttttacctcaggaggctctccagttttttgagccccctccatccatttcttccatcccatcagcccctttcaccttactaccttccctctccatcctggaacatgatgatgatgatgataagaataacaactaatatgtatgtgccaggcatatactacccatcttatgacatcatttcagtaatctcatgttatcctcacaataactttatgaggaagatactattgtggttttccttttaatgaggtgactgaggctcagagaggttgagtgacttacccaaagtcccacagcagagatgagatttgaagtcaggtctgtttgctttcagaatcttgcgtatatccccaattcccttgccctgtgtctttctgctgcatccatgaggcaaaatcctaagtctggataaatttaactgacagtttcctcctctgtgcttatgcccagatggaggaacattgctggagaaaatcccatcactttgttggttagtcccaccagaaagtcatagtttccaacctcagcggggccctcaactcagctaaacaatccttctaagtaactgtcctgacaatagcacttgcaaactttctccactgccctctggagtcagactgtctgggttagagtctgctttggccacttccatgctccataccatgccagcctttaagaaagggtgaagtggaggaaaaaggatgaggggaaaggggaagtgatatgtatcgagtgtcttctaggtaccagccactgtgccaggtgctttgcatgcagtgtttcatttaatcctgccagcagccctgcaagggcaatactcttgttatttttgctttacagaggaggaagctgaggcacagacaggttaagtcactcactaacgtgacacaatttgtatgtggagaagccatctcattcgtttagaccttccttatcttgatgaattattgtgacaagctgataaatgggtcccctgttacctatctcatgccctacaatctaccttccattctgttgctgggacaatctttctaaaatgcacatctgacagtgctactactctgcttaaagtccttccagagcttcccctcagtcttcagaatgaaacagaaacctttgatcttaatgatttggccctgtccttcctttctcactgcatccactaccacttgcccatgcagtcacacagtactatttttggccacctgatgacaccttgctttcttctgaagaaagaagaaagcatatatatatatattctctgcctccccatcctccacaccctttcctgcccactttaaatgctcctcttctgtgctttcacagcattcatgtttatcccagtgtgttataatttcctgctgtcttctctgtttcccccattaaactggaagcatcttgagaactgggattgtgccttagtcatctctgtactccccagggccgtagcaccagagccatggttaaatctatgtttgttgaatgactgaattaatgaatgaatagagtgaatgagagaagaaaaagctctcacttggaaagtttagtgacatgagctgtatggtatctgattcttggctgaagctgctgcagtttttccctatgactacagtgctataaaaatatgtctgcacatggataaagactggaagagaactttccacacaaaactaagagttgtgttagagtggtgagtgatggatgcttttttccccattttcaaaatgttctttagtgctgcttttggattgttttggcaatgtagcagacattgtagaaatggaatttggggctcccatggaggaatcgacaaccaatatgtattgatgcccagtgtactctgctgggttctgggtgctgtggggagatgggtgggtaaaggcgactcattctgactcaggtttgcatggtcaggaatcttgccaattacgttggatttgctggaataaaaagataactttcaagaattttccaagctcctgggttgaggtatttcttttctcccaaagctgggccgcaaacaaagatggcttttgtttgcagtaaaatactcattccttcaattttgtcctgcaaagtgacttctatagctttgggagtcaggtttgctgagtggggaaactgattgtccatgcttcattgatttagaaatgaccaaaaatgtttgccttttctggctcttgaataaaatgtttaggaatttcattggcaaaatgatgaaattgttccctttactgctgcaagacttccaaaactatatatcgtgggttaacttaacccagaagaggcaaaaaaaaaaaaaaaatgggaagcagactcagatgattaacactctgccttaattgggtgcttactcactctgccgtggcaaggcactgtgttctggactttggagatatctcatttaaaactctcaacagcctgtgggtaagggactgttattgttctcatggtagagatggtcaaactgagtttcatagaggctcagctctgaaatcatgagaccaggatttgaagccgagttcagctggttccatgggcacacactaaccatttggcaacagtgcctctagactagtctggctacaaagggacagaggtatgtatttattttgatttaacgaaccgttgtttaatgtttaccatgtcccgggcacatggtaactgctttaaaaatgttagattatttacttctcatagacaaccctgtgaggaggtactattattaatatcatatgacaggtgggaaaatggaggcacaggggtgttgaatcacttgcccggggtcactcaggctagcatgtgacagagctagagttacaatccaagtggccatgttcaggtgtgtggcccattaccttgactctgtgctggttagcatgctaccccctgtgccctgtctgcatagctctggctcagaaacactgaagacatgggcctctttttgtagttttgtaacagatttgtactttttaaagtattttccaccattaaagccatacgctctgcttctaagcgtcctgtggggttggtgggaagggtgaaaacatactcctgtccttctatagcaagactagcttagaggcaaggtggcccagtggttagagcatgcccatggtgccagtgaactcagcttcaaatcctggccttatgatttcagagctgaacctctctgaatgtctgtatcactatctttgctaaaggaagaggaagctttctcccgatatcttcatttacttccaattttcggtttttgggggagagctgggtttcctccacagctaggcgctgggtggcgaagggcttttggactgtcactacttttcattcgacagagacttcaggatagcccccttcaaaggcagtctgtttggggtcatcaggaacagacagagtgctcttccctaccgcactcatcccacctagtgccatctatccttacccactctgaatccctcctctcggcaggcactgcctcattccccagagccaggcctagacaatggcggctgctcagcttggagggagggggagtgaagaggcagcaggcccaacctgccagcttgaaagcttcatttgacaggggaggaggcacatctggtttgggttttcaattcaattcaacaatgatttattgtgggtctgccagctgcagaggttctgggctaggctaggcagcaagagatgcaaagataagtaaaatattgtctgtgcccttaaaggagttttctaggttgtaggggtgtgcagacgcaaatgagcattttttttttatgcgataagccctgtgcttagcagtttaccttgcctacattattatgtctttgcatcttcccagcaggttttgtgatggaggtgggtaaactattatcacttcattttatacacatgaggaaacagagcctcagagtggaagagactggcccaaggtcacatttttaagaatggaccaaaccagttctggaactattacattcttctgctccccagaggtgatgaagatgatgatgatgacaaaaaacacttactgagctctggaggccaagtcttgtgctatgcaggctgcagatattattttactggcaacttccaacatcccattgaggctgatgttgttatccctttttctagaagagaaaacggaggtagccttgggaagtgatggagttggaatttgaaaccaggtcattccagtccaccagcctgtaccataaaagaggtagacacagggtgccatgttcaggggcaagagcaatgaattgtgcctgcaaaagcttcatgccagagatggcatttacatttggccttgaagggtgagatggggttatgattggtagagttgggagagagggcatcccagtcagaagggatattctgagcaaagaacccaaagagatgacttgtggagcattttgattgagaggctgtaggttcatccggcatgcaggccggggactctgggtgtagaggaacaatgtgaaggaaaccagagatacgcctgatggtctaacacatttttgtcaagttgaggttcttatttttttaattaagagcaggtactctgccccaaaggcttttcaaatgatactatcttgcaacccatgagcaaacacactcgagtctctcactgtgtaaattctactgtgctgagagctgcggtgaatacaaaagaaaacaactcaattcctcaagtgtgtgccgatggcccccgtgtggttgaggaggcaagatacacacaatcaggaaaagcagcagctagcataggcagttagtgatcagggccaaatgagtttttccagccgtcagatttcaaggaacatgaacgagaggaaggccggcaagcttaaggccgggtggggcaatcagtgtagctagcattaagggctctggccaggcctcccttccccaaactgccacggtctccaaccatgtcttgacctcccagagtttgttagggaagatgggaccttatgggatcagagacagcgcatgggagctgggaaacggagccgaatacctgatattcctgatcctccaattttctacacttattctcatttcctggcagctcctccagctgctgaattgtatgtgtatgtgtgagccgtattttaaattaagcagtgagttctttcagctcatcataaacatgctaaaaagcttcagccgcggcctgagcccacccccgccctttacacacacaggcagcagctggggccactcgaccccacactctaatgtgcattgcctatgactcaccaacaaaaacgactgtatgtttcagtctccctgggtagctgattcctagttgtggtgggaaatctcagtccgatttggaaggcaaagggcctcagccccgccctactgactgtgaattctacaacatatggagcgcctaccttgtgcaaggcattgtgggtaagtccattcatctctctgggctttccatttcctcagcttcaaaatgcatgtactaatcctgccggctttacctccctcctagggctctgtgtctcagccacactggtctttcaatttctgcaacattctcggtcttttctcgccccagggcctttgttcgtgctcctgcctggactgcccttcctcttgcttttggcatggaaggctccttcctaacctttcagtctcagcttaacgttacctcctgagaagagccttctctgaccacccacagttagatgcctcctgttcctctcttacatttcttttattagcaatgcttccttaaccccatttactgctctgggtaattatgtctatttatatttgtctatttatggtatgtctctcccactggaatgtaagctccaagaggacagggaccttgtctgtgtcactcagcaatgtgtccctctcctctagagtggtgcttggcacatagtaggctgacataagcaaaaccatctggaaaatattttcttcctgaggttcttgccagacatatggttgctgagggaaaaattatggcagaactgtgtcattccataggaaaaaaaatcaggctaaaagggaagagtttgttgaaaacagttctgttttagaaaccagtccttggagtctcatcgccagacacagtcttatgaaattaaacaaaagaaataaaaagcataaaaagctaagtttttattgggtatttactatgtgccaggaactgttctaagtgttctacacagattatctcatttaatcctcatcataacccaatgacgtcaactctattattagctccatttaacagatgaaggaattgaggctctgggatgttaagaaaagtgcccaaggtcacacagctagcaagagacagaaccaaaagttgaactcaaggcagtctgagtccaagtccacaaactaaatcatctatgccacctgcagcccccacctcatgttaccctacacctcccacgccacccccaggcacgattctactacagcactggccacattgcagaacaggggtttgtttacttgtctgtccttcctactagacgaggagcttctcaagtgcagagactggatcttattcatttttgcttcccctgtgcctggaagagagcttgttctggaatagctaaccaaggaatattcgttgaatgagcaaatgagtgagggagtaagtgaatccatattccttaatattttcaggcttcaggcttatgggctcatgtgtatttccctggtcaagcatagcactgggcacaagggtattctggtgcaagaggtgcctctcaccacagggtacaagaaggactagctctggctgggtaaaccaaagcagtgttccacagagcaaggggcttgatccagaaggtttcattttgtcatcggtctaaaaagtagctggacctgtttaggacttaaacaaactttcagtgttccaatcccatctcaaatcctttgcagaatgaggcagggtgtggggaggtggtggtggggcagttataaataaacaaatacccacaaaccggctggttttttaaacagaatttgcttcagtcagtgctgcaccacattttcccaactggcctccgtcgtgagaacaagtgggaactttcatactgaatggctttatttttattctgaccagatgaatggcaggagttttggctcgggaggcaggtttccgatcctcagcacacagtttgctgccctactgtgccccgtccatcacacacagcgccctgcacaacatacccagtcattgcatctactgcctcagcccttgaaaataattgggtcattgttttattacaccagcgagagagctgcaagcctgttaggattatgtcattgatatttgcgtgaaaaggcaatcatgatatgctggtcatttaacacagctgggaatgcaactgtgttgtcattgtttaaggttctcatccagcccctctgacttttttgcacagcccagcccgtgaaaatggatcactctgatgtatgtcacctttaaaatgctttctagcccttcaagggaccaagcaggatttaactcttttcatgcacttggactttgctgcttgtaggcacagcagtctgaaggtgagagatgcttgcttttcatacttgtgggagttgtacaccctagtggcaggatgctgccatacagtgtcatttgttcactaactgctgatcagagccaaggacaattttggctcaagaacaaatgagacctaatgtctgtgagggaagactatgtagataagtcacgggtcagagttgtgttgcgacttgtattgtgtgctagtttcagtaggacttgtgctttcattgcaattgtcagtatgcttaagcaggggtctctgctaatgaaattcgagcatatttgcatttatcgacaggtattactgatggtagaacatcttatttccacacaaggcaatgagtaacattgattatagaagtgtaaacaaagctcaaattcatgtgccaatttgtctatttcaactcatcgatcctcttcttccactggcatgctagcctgagttttatggcataaggccattaaagtattcttcaaaggaatctgttgcagacacctgttcatccctcttctggtcccggtccttgccaaaccagctctgcctttgccaaccaccttgaggtgtgacaggaaaagctgacccaataagggagtcaactgaagggatggagtggcttagatgcaaatggccaaatcccaatggccatggctataaggaacacaggttcctgaagttttcttggcaactagctctaactgctttgccttctgagtgctttggtatttgttttattctaagttcccagttttgatctatttttgccttatggctgcagattccctttctggaaaatggggctctggctgggatcaaatcagagaacacacccagacttggcatagtgcctggcacagagtaagtgctcaacaaatggtagctgttgtctctttttccctgtccaggtttcttctggttctgttctctgtacctccagtattggcccagaaccaggaactgttccctcccctgactggcaagtcagattacctggccctcagacaagctgggctcccttttctggcagccttttgttgtccttacctgttgccatgtgccactcagtgtaaccacaggcagacctctgccaattgctgacattaacctattgaatcctggcagagaagaataagtttgcagactggaatttgcatgtctgggccagatacgagaccaggaggcaaagccatatttacctgttctccccagttgtggcaaatcacccacattctggttaaaaccagatgtttcacacccatgactgcaatgccacacatcaaacagttgcttacaaagaacacaaagtggttttcacatcgcaaatgtaacttgcaggtcacttctcaaatttcctcgcagcagctaccatgcctgggtatttttcccttaaaaatgacaaccttgttgggtctcttgtagggactttcatttggaagccctgggagaacttatatgctctttccaagagggtctctgatggctttaattcacatggagttaatatattggaaaagaaaagagatcttccccaaactcacctgctccttgaaaatgctattctgttgccttggcgaacagccaatccaaacattaaaaaagagatagagaatgcaggaatcctaaatgctattctcagtgcatgtccaaacaagaactgggggctgaggggcaaagaacagaaagaggagaaaagagtttttgtagcctaggccgtgagttgatcccaccccgtcatgtcctgtacccttcacgctcataaagaagacagaggaggccgggcgcggtgtctcatgcctgtaatcccagcactttgggtggccgaggcaggcggatcacctgaggtcaggtgttggagaccagcctggccaacatggcgaaaccctgtccctactaaaaatacaaaaattagccgggggtggtggaacatgcctgtaatcccagctactcgggagtctgagacaggagaattgcttgaacctgggaggttgaggttgcagtgagccaagattgtgccattgcactccaacctgggcaacaagagtgaaactcggtctcaaaaaaaaaaaaagaaaaagaaaaagaaagaggaaggagaaggagaagaaggagaaggagaaggagagaagaagaaggagaaggagaacgagaagatgtggtggcatcatgacttctctgctagggttaattgctcagcctgagaggctctccaggctggcaggtcacactagagccaagagtgaagggtccattcagtaaggtcactgccatgatcagttctcaaccactttaactcagtttttctgttgctgctttgttggttagtggtttgtttgtttctacccatttgggagaagggtaggaaaggaactaaggtgatcaactattccatatgtgtcaggccctgtacttgtcttttcaaacacttattcacactctgagggactctctcaggtccagcaactgtgtagctatgatgtgaaatagcagcttctctctatgcattcactgggaatggtttgttctgatcacacaattttttccagttcttccgacgttaggtgttgcatggtaagaaacaggtggttaattattgagacagttcttatttggaattgtctcttcctccttctcctctcaggcagatgctaaaggatgtctgtagttttttcatggcattttgctaaagatgcacattcattaattcatcaaatagctttttttgagacattattatgagtgaggtgttgtgctatgatatgctttatataccatatcttatttcatcctcaccacaaagctatgaggtaggtactatcattatcttaattttacaatgaagagactgaggctcaggaaacataatgcaaggtcacactcagttaataagttgagagctaggattcaaacccaggtttatctgactcagttacactacacttcctccacatagcacattgtgggcccgtcacagctcttgaggacaaaattcatccttagaaaagttttcttactccactttttgctgatactactgctgctgttgctgctgctactactattactactactgctactgtttctcctcctctatttatccagaactgcatttttccagcactcctaggtgctttgaacccagctaccagttgtagagttcaaacccaggcctgcatgagtcccttgcacccattctacttttctgcactgcttgtaatgtaacacaggaggtatgggacatccataactcaggtaggtaattgacttcaagcttaacattcactcaccaatcatttattgagcacatattagataagcaacctatggctcctgccctggagttgttcataagaccttccaggcagacagctatgggacgaatacacttgaatttattaaatctacctcaggcaaaaaaccaagcatgtaattataagtagtatatcagagtatgtgtaaatggggttctgtaaaatgtttgaaagaggcaggcctgggttagtggtgagaacaaggatcaagaaggctctgccaccaaataacaacatgagtgttgtcccgttaatctctctgggcttctgtttccagatcaaggacctcaaaataatagtcatagtcaccatttattgagtgctttactgttaaccaggcagtatgctaggtggttttcatttagtcttgacaacagtattctcgctttcccttttctacagctgagactcagagacattaggtaatgtctaggtcacacagctcttcagtgaccagttgtttctatgtcagaatcctcttataatcactgagttgtatcgcttcccttgcctcctgctcccaagtcaagtattctctactatgtcgcctgaaaattaaaattaaaatcaaggttaatcttgttcaactgagccaagaggataaacattagaaatagcaattagtaggtagaaatgttgccaggaagagctatacaaaagcatagaaaggcaaccaagggagttaatgatgggggtgtggcaggggttgcatgttgatgggtaattggatcctggccagctcttaccttcttccttcaccttcccactccgcaatttctcaggcttctctagagagcacaacccacctagagacagcctgtgttgccacaggagggcaccaggccaggaatggcaggcctagggcagtggggctctgggctgggaaccataaataaccactttaatgaaaaccagctttggccaaaagccttatcatttcttaagaggttctgtgcttcttctaatgacctagttacttgagaaaggcctagcctaacatatacaacaacaataatagttgccctatagtgagtacttactatgggccagggcctgtgctaaacactcactaattcatttaatcctcacacagccctacaggagcaagtactattatttcccccacgttacagagcaggcatcaggctgagagaggctaagtcatttgctcaagatcatatagctggttggagctggaatttgaagcctgaagcatctagttccagggcctgagctctttaattcctatatttaatgaatgtctgtcgaaggaataaacagatgaatgaatagacaaatgtattcatttcatttcactttaacaaacatttattgagtgctctgtgtcagctcctgtgctaggcattgaggatttataagtttagtgcgtgcgtgcgcgcacacacacacacacacaaacgcacacacacacacacacacatcctgcatggcccttgctctccaggggttcacaaaagcattctctattgtggcttgatttcttctggagagaagtaatttgaatgtcttgaacagcagtttttaatgatgctattaaatttaacctaaagcgggggttttgcaccggtgagcaaagtgtttcaaatgagaatgtgtctttgattaatcatcgattcagccagagaatagttactaccagaatggagctgcaactcctattatattagctaactcttcttccatctatcatgtctctatcttgtcgaaccctcccacgatacaaaagttatctgtaccctaatggacaattatcccatccatcattcctgctggtcttgttgattgctggtagtctgcttgcccacggaggagacttacaaatagtcatgaccagtgacgcactggaaaactgctcatttttagacattttaaatctatgtagaatgaattatttttcaggctgtacttaagctgcatttgctttgttggttatgtaagaagagatatgaattccttacctatgcgtgagacatggcgtctgaatatttttaagttcctgtgggcagcagccctatacatatttgttaaaatgatgaaagaataaagtaaacatacctagagtaattccagaggagcaggcttcatacctggagctcgggtgggtggccatcatgtcagggtagtcaccgtcttccttttcctttctaagtactttgaggagaatcccaagttgattagggtcaaggtgaggactcatggtgctgaaaatagggattgagtggacaatgagagatgcctgttgaattccctgggactattgctatgagatttgagggcagaaatgcccccctctcccatgtcctaccctaagcctggtaacacatttaactttttgttacagtaactaccatgcctagtaaaactggagtcactggttgcccagggcaaaaacccaagagttgtagttcactcatctttatttctcacctctacattcagccagtcactaagccctgccaagtatatttcctaagcattccttgcatgtcacctcttttctccattcctactgccagggctttagttcaggactcctcccacctccagacatctcttgccttgattcctacaataccttctggttttctcaccttctctccttagtcctctgtgaccattctccccaaagtggcctgagtgatctttcaaacatgcaaatcaaatcatttcacacctccatcccctccacttaacacttgtaaatagcctcacaacacctgagacttgaggctctcaaaatgtgggtcctggggccagcaacaccagcatctctggcaacttcttaaagttagagtacgtactcattagagtacctactgaatcagaaactctgagagtgctcacctgactctgtgtttaacagccctacaggtgattctgatgagcactcaaatttgagaactggcaccctagagccatggttctcaatcctggctgcacattcaaataaatggagggagcttttaaaagttctaatgcctctcctgcagagtaattaaatcagtttctaggggtgggatccagtcataagtattgtttttaaagttccccaggtgcttctaatatacagtcaaggctgagaactactgctctataggatgaagtccaaactccttagcttggcatttaaggtctatctctttggtcataaccacccccaacactatgctcttgcttgttcattctagaattcaatcacagggagtcatttgcaattctcttagagccacacatggtctcttacctctgtgcatttgcacacatcattcccactgctgtgcccatcccttcctccctcccttcacccagctaacaccatctcatctacaacacatagctcagaagacacctctaaggaacagttttccccgcctgtccagtctgggttagatgcccctcctctgtactcccacagcgtccacaacatagcactggatacattctcttgttcttctctggttagttgtctactttctctaccagtctgagagctaggatccccacctggcacacagtagatgttccatgattctgtacatcctgttccctctttttggagtgactttctgtgccttgtctgtggccttcaggatgcagctcagatatcacttcttgggaatctcagaattctctgtctggaccctttctctaggctcccgcaacaatctaaatgtaatctgatcctagcccttagcacacagggctatcaggctgccatagtctgtttacttatctgcctccctcactgaactgtaagtaacttgaggttagggacagagccttgtacattcctgtatcccagctcctagcacaaagactcacacattataggtgctcagtagccataaccatctgcagaacgaataactgaatcaatgatgaccttttcctcttctccatatcatcagccactatttctgtccaggcccccgttgctttattgcaatagccttctgactatttcccatctctcctttctctgatgccatctgaacactccccccctctccaagatgtggctttctaaaaccacagtcaccctatccctcccctgctcaaacactttcagtcattcctcattgtctgcagggcaaatatcaaagtggaattccagatccttccttcccaagagtggtctgccttcccaaccatacctccccccattcccctatggaataccagccacatcatctgagggtcctggtgcaaaacgaaaatgtggaaccccgtgttaaaatataatcaaggatttcaagatagcagcaaaggagagcattaaaccaagcatagggctcttctgacttcagggtccgatgcgacggcacaggtctgcccctacgtgtatccagcgcactggccaaatgcacttgctcctccttcaactgctctgtaggttcactttctccacggcttttgtcaggctgttccatctcttctaccccactagccaattcaaagcttgtcttccctgtagatccaccctgttcttcaagaattgctcaattctcatctcctactgttccagaccacagtagtttctaccacacagcctgatattaataattatttttatatgtgtgtagtcttgcctgtctactgaattttaagcttcttgagggcaaggactctattttgttcatcttttttttttatagacttagcatagtactttgtaatcatctcacttgttgaatgactcagggaagaaataatacaactccagtcactgagtttgccaaaaaacagtagacactgcaaacctgatttaaatccctcattattagctatgcaacattgaaggagtcacctcacttctctttgccatctataaaacgatgatacttagagaaaaagtgtttttttttttttttgttttgtttttttggtttttttgtttttacagaggcttgctctcttgcccaggctggagtacagtggcatgcaatctcggctcactgcaacctccgcctcctgggttcaagtgattctcctgcctcagcctcccaagtagctgggattacgggcccatgccaccatgccctgctaattttgtatttttagtagagatggggtttcaccatgttggccaggctggtcttgaactcctgacctcaagtgttccacctgtctcggcctcccaaagtgctgggattacaggcgttgagccaccatgcctggctagaaaaagtaattttttgttagtatcttgttctttggcaatgttttcaaaatcttttgttttttaatacatgtaaaacttattttatattttatatcacctaattgcaatacctgaggtctttgaagacctgattctgttttcattgtttctggcttcatcgtgttctttgtaattttggattatgagttcatgttcaacctgactttatccttggtaatcctatgaaaactgggtggtgggcatgttcttccagggaggatttgtgtttggttcttccaagtgcatcagggcactattaatccaggagttcttccagtgaattgtttagtcccaaaggcaagggccatgtcttctttggctatatgatcccagggcttaactcagggacttgtagatgctcaacatatatttgctgattgagtggatgaatgaatgtggtactttaccgcttcttttggaagcccaataagaattgtgacctctggtattaacaaagaacagtaggcacatcaggaaaataataattactaacatttattgagcaatgattatgtgtcaggtatcattctaagtgctttgtgtgtattaactcatttaattctcactatgatgctgtgaggtaggttactattattatcttcacattacagaggaggcaccagactcagacaggctgaataacttggccaaggtcacatagctagtgaatggcggaacacagatatgaacccaggcaccctagagacacatctacttaccaccttgtattggagaagaggtcaacagtagtgacagaagcaatagagtggaaattttcagtactgccaaaactatgagagccatatagtccacaccaggcatgaaaaggaagctggcatggtcttgtgttgtcagttaacccttgtatatagggttttcatttcctaactagagaaggaggagtttgaaagcacgaaccatgaattacagctctttgaaatgctcaacatagatttgctgagtgaataaatgactgttttgaaattaaacacaggagtgctttgaataaattactttgcatcttgtatgtcaaactgaaattggtgagacatctttcaccttgtgttaaaaactaaaaatccctagatgtggtcataacatggctggttataatgacaccttgcatttgtacttgtgtatgatactcaggactccctgagaaaaggaatgaagaaacttggattttgccttcataggccctgaggctgtcaggaaccaagggccactgtgtttgtaatccattcctttggctgctctccaaatctaggaagacctggaggaaaggggggctttattttctatctttgccaagatcaggaaataatttgtgaactctcagtaaacattctgggggccttccctctaacactgctttggtggaataatatctccagttttcaccaatcttggttcaatatttacctgggggtttgcagtgatcatggggacagggctccaacatgaagtgaaggttcatgagaaggaaaatgaggggaaggctgtgtgtgtgtgtgtgtgtgtgtgtgtgtgtgctggctgagggatgaaggtgggaggaataccaggattctgaagcaatgagagtgggattgggagagagagctcatgttgaagaagaaataactcaccagttcacatgggctccttttcaagggtttttctttatataaacaatttgcctggttccaattagaagcccacattaggcagttagctccaatttggcagttcattcttaatttggctttccttatgggtgggagggagggctgacagttaaaaggttgatgggaaaaaccttggtatcctggtgtgaagacagaccctgggatcagaaggttgccctgatgactttgccaatgtgttcattgcccctgtcctgctggggcgcatacagcaggcccttctttctcatacgcccttgacagaccaggactcactgctagaaaacccctggggaagtcattgctgaagactctagtgtggggcacattaggtttgaggagcaggggaaacattcaggcagctggcaaggtctgggctaccaggagagatttgggagttagaagcatattaggtgagagttgacactgtccaaagggagtatatagaaagaaaagcagaggaaagggctcatggagtcattacagcctgtgaggtgggaacagggtttgggagtactaagggtttggggagggtttatgtgtttattcacccattcatttattcaacatttcttgagctttatggcagatgctgagttgaagaggaagctggggatttaagagggagaagagttaagaggggatccctgggtggatccagatgaaggagaagggaggggctaagtgcctaggctcgctcttgccaggagagcacatctgttaacacaaagctgcatctgtatctcagccagctctcttccatttcatctcctcctctctacccacacttgcaagacggggagccacatggcggcttcctactcccttgtaccactacaccccctgccgggttctttctaggcatttagctgtggcatcagcagcaccccttctgagagatcaggcaatccccaagggtgagtggtagtggtagtggtggggagggttgatagcttcgagagaagagctggagaaggcgctgtctggctgtaattagccccagctgctgttgtgaggcagcgttgggggccgtcaggagtgtacatgcatgtgtatgaacctgtgagcgtggcacctcattgctatcactctatttttcactgtattgtgtgctggctgcagcctcgctgctctgaaacccctcctgtccctgaggatcccgaaagacagagtgttccacaggcagcaccagcttgaatcactaatgctattaagcaggaggacaacaaatataggcccccatatgtcctggatatgcaagtccctgctctctctttccccacccctgcttcctgaatgtttccaagtgagtgaagtcccagcacttgaaattagcaacacctcacttctgcacagccttttggcaaagagctttcacagctgccatgtcatgcatcctcagacgcttctaggagaagcattttataggtgaggaccctgtggttcagggaggtggagagatttgcacaggctaacccagacagtcagtggcagacttgtgtccaggaagcaagtcctcgacctcctggcctggtggcccatccccagcagagcactgccaagagggctgctcccgggtggctccagctgctgctgtctgtgagctcgtgagaacctgtcagctgtggctccaagacctgcctcagtgattgctgaaaacgctgagagtgctgaaaaccaggaccctcaagccgagcctgacgtcacatagttgattgagtacctgctatgtgcccaccactgtgctggtgcttatgggagacaaaacaggggtagtgcatagcccgtatcctcaaagaagtgataacttgaatggggaaacaactcttagataccaagtccaaaggcaattccaagcacttctctctcttccactaagcagtctgttgtcagtgacaatgacacaggaaccccttctgaattcatctgtcttatcgcaggcctggggtaggagaggatgggaggatgactaggaagggtaatgaggaagggcagggagatgggggaaggaagggaaaaactggagctcctaataaacaccaggcacattgtgaagtttatatgttatacataggtcatttgtattatgcttatcatacatgtacatgaatatatacacccaaacacatacacaaacacatacacaatcactttccagggattgactcatctatttggctcactctcaatcatgaaaagagcttaggacagtgacacttttagaaagccctgaatgagtgttaactagcctttcttcttatcatgatcatcttcattgtcattatcggcatattatataaattatctcatttatttcttctaactacaggacttagcaactattatttttatttccagtttacaaatgaggaaaccagtatcttattttatccaagcttgtgggtactgagaatataaagaggaattcaatatggttctaggcaaactttggggtcttccctatctagtgggagggaccgaggcacacataagccctcatggtccaataggtgctgtggtagaggaacgtatctggggaagttgaggaagtctccacgaatgaaggaggcttgagcagcatcttgagggatggcaggttatgtcaggaggaacagtggaggcaggggaagacattccaggcaaagtgagcagtatttgtgtgacagggcctagtgcatgtttcaaagggcaggacaattgtagctgggtgcaccactggcagcagcaggaggggagtggacgagtatttggggtcagctattcagagccctattggccaagctgaaggttttgttctgtgagcaagagggagccactggagctttttattaaggcagattcgggacagactaggaagacagtccttaccagggtgttgaaagattggagggaagagaggccagctgcatgcggaccaattgggagaccatctccagggtctgggcaagaagtggaacaggctctgaaccacgaccgtggcagtgagagccgagaggaggggatgactcaaggcacatgtcaacaggtagaaacctcagggctggctgtcatggggtcaaggagagggaaaaggtgacaaggaccctgaggttccagcttgggtccgtggtgatactgtcaactgaggcagggaacacaagactgttagtagagagggagagtgaggggagacagatgacaaggtctgtttggacttgctgggtttggagtgctggatagcggacatgtccagcaagaaactgggaatcttggctttgagcccagctgagacatgggggctggaaagccaccacagtcaagggatattagttgacctcaggggactggatggggtttctcctctcccattttactcatccagggcaagggctagggacagagccaggtgaataccagtatttaatgagggaggtggtgggggacaccagcccggagtgagaagacactcttctttggaccttcccagaaacatcatccctttcccctcatgatcatggtccttgttccagggctgcactcaggccagtgacagaaggaagggagggacagagggagaaagggaggaaagaagggagggaaggagggaggggggaggaaagaagggaaggaaggagggaggggggaggaggaaggagggagggagggggaagaaggagggagtgagggaggaaggaaagggaggaaggagggaaggagggagggaggagctctgtgcacagaactcatgcctgcacaggggccatgaagcaaggacaggacagtcacttcagctctggagttctttagtgtgggagtatcttctaacaaaacctaataaattaacagctgtgggtttggggcagcaaggacaaagaccacaactctacagtgacccctggagcactcagtgccactgactgcgtctccactgctgcagagctgggagcacattcatgacagcatttttcaagctcctgtctgtgcaaaccacagctggtctcctaggagtcctaacactttaattagacctagcaggtcccagaacaaaatcccataatccccaaatctatagcaacaagttaggcatgagagttttagttacattctggatgtaagagaaccctaactgccactttctttctgagtctccaaatgacctttgaccaatctctttaccagaaatatttatctagaatggccttggtctctgacaccttgaggacttctactgatttctctgttaaatccctggaaccacaccaataatagttctgaacattttacactcatcatctcatttattcctcacaaatattataaaccctgtttatatatatgtgtaatatttatagtaacaagagtagcagatattttgctgaggggaggcatggttctacacaggttacatgaagtaattcataattccacatgaacagcactatgaggtattattactgtctccatttcacaggcaaagagcaaatcacagaaagaatgagtaagttgttcaaggtcacacagcctataagaggcaaagcctgccggtgtggctccactgtgctattaaccagtaaggtcttctatagccccaactagctcaaaatggttctaaatgaagaatcgctgtgcgttttgcacctcagactgctagcatcgctgatttaggtctggagtttagataagtgaaactactcagggtctttgtgaagtatctttagagctgctgcttggacaagactgggtcaggacttcgaaggcatttccatgtgctcctggagagtcaggatgtaggctgggattcattatgcgacccagctgtgtgactttcctccccaccccttacccccattcaccaagatagaatgcactgtttcttaaggtgtggcttaaggagagctctttaaacatgcagattctagggctgaagcacaaacccactctgtatctttatagagataactgctggaatatgcattttagtaaactctcaggctgaattactttgagaatcatcagagtctactttgacaggatataggcttgtcttctgattctagaagtaccataagcctaactagggatgcttcccactcctctttcttgctgagcagagaagcaagggggactggaatgcagagaacatgctgagggcatgcctgcacagaaagctgagctccttgtcaccacataccttgaaagagtggactctgtatccccaggagaggatggggagggacagagagagaaagctatggaaagcctctggaagccttagtaccctggggcccagacaagggagtcccctgagggaggtagagagtggggctgttggaggaggagagcagctatgggccagcagcctgaggagctgagagtcacagtgggagtgactgtggcttcagagtgatgccatagctgcagtgagctgtacaggaaccagagacccaaagttttctgtagggcttcttttgctttgttagtgcttcaggagttggatccttctggaccctgatctcccagaagtgattccatttcgcctctaggaggtgggtagcaaagctcagtctgtggctggggaaagccaaggaagtgatttcacgaatctttagcagtgaatccacctatttagttagcaggggatggagcagatcagaactagcgagaggaaaggcttaggaatgctctctagtgggactgagaagaaaaggtgagagggtgacattaactggaggagatggtgagcccctgacccctgcagttgtgagacttgcactgagtgggatgatctgctgctataacctatcctcaggcaatgaagcataagcagagagccaggagtgttaatcattgctgatttttattaagcatttcctttgtactggacactgtactgggctgtacatgcatcatcacattcagtcttcacaacattatatgatagctcctattactgtgcccattttacagatgaggtttagataggttataccacttgcccaaggccacacaactagtaagtagcagagccagaatttgcacccaagtggttttaatccaaactgtgtccactaggccttaggaaggagcccacatagagctttggggatgctgcattcttgacctgtggctgtaggtgggcaactcctcttcataccttatagctcttggtaaatgaagtgaatcactgtatctaccatgaatctccttgggaatgagttcaatgcgggtatcagaggaagcaaagggtgggaagggggtctcaaaagtctaaatcttagtgtggtcccctcctttgacctactctctctgggctgaagaaatgccaggattgagggggcagcagattgttagatctgtttgttccatctactgaggcctcataacatttttggagcccttgttcagtgactcaggtaattcagcctgagggtacctttgcagggagttcccctatctcttatcctgtgttagtacatgagattattcctccttcttgtaccccagttacattaagtgggtcttattccccaaatccgtagtctctgccccaataagttgcctgtaccccattttagcaagaatagaatcttccctttctgccaacagagcttcttggcactttggccttgcctggttcctgcttgcagactcctgttctgaggctcatgtttgtacctagaatgatttcatgttcctcctctctctttgtccctctatcagaacctgctttcacgatgggagatttaagaggctgatcctcccaagaggttggcattttaactgatgccaaagccctgagtcaaaagaattatatacttaaaaattttcaagcccttgggagcggatggagagattggaaaggccaatggaacattcttaatgctcctggaatgccacaaggtggacataaaattcaggcttctgccaagacaggacttggattatttttgttataatcagaatccgtaatctgcccccaccccagcactcagggctttgatcaaaagtcttccagacaatgaacctctatgatccaagtatcattttctcagagctccttagaaggaggagagctaagaaacttcatgaattaccaaggaccaagcaaacaggcggtagtgaagtcagaaacaaattcctcccgagactagttttgtcctatagcctgaaaacaaatccggtctccaccagacataaggtggaattcctgtcttgattttttttttagcactgatattaacatttttcttctcaaatcctcttcagaaccagcccttttagaacacaaattagaagctgtttattttgtcaatcagagaaactgaaggcagccagccttggccaaaggaacatcttatcctttgcctttgctaaggacaatgttccttctattgtgctctgtggaaataaaagggcaaaatatgcttgccttcttttattcttattcatggctgagggtcatatgaaagttcagagaagagcacagtttttagtatgggtcgtggcaggttttccagatggcttcctagccaagatatttctcccgctcacctccaaacaagttatgtacccctaagaatgatttggtctcagtgttaggggaagagggtaggtagcagggcctggctttgtcatcctgggctattttgaggggacttcagcagtccccgacagaaggacaagaggggctgattctccctttgtgagcagccattggagctgcttcagggactgacaagccggccagagacaatgtcctctctcaggaaagcagtaaaaacatcagaaatgctcctttcctggggagcccttagttattttggcctctctttccattaaaataggaaagcattgaaagggaccattcgtgggatagcgtggagcctccccattgtggcagcatttctaactgcgttgagaattaaccatattgctcttcctttttaccatggaggagtttctagatttttatttataccctaccgcttaaaacatctttcactgtttcagcaaattgcagcataaaagatggagaagccagcaggggctgtgctcacaataatagctgtggttgcatttaagacattcaaatgccaagggtgcacttctcccattaagtccaacataagaaatcaggtgtgcacaacattgatgaacagaagaccccaaaggacaggtggagtttctggtatgctgtggtgggggcggtggggtggtgagcttgggaaagaacgaacaggcattttcattttccaaactaagaagcagtttcgggcgaaggggagccgtggggatgtcagaaattcttctaacgccatggacctgcccacacctgagtcagataaagatgaccttccctaggccctgctttcctctccccctccccaaaagacagcatgagcatgagtaagccgggtacttacaggtgcagaagaatttggaacaggaaaatggagcttacaggctcccgaatgcctgccgagtcagttgcatcagattaggaagtgatgatcctaagaataagatgtttggaaaatcttgtcccccgaaagccccctgctttgtcttctcagcccacatccaaactcagaccacccccaggatgtctctcatcctgccagactgcctggtgcctccgtgccccttaccgtgagggtgctggcagccacactgcttctttgagcctgtggcccggcaaggtagtcaggctcatgggattaggttggcaggagcgactgtcctctaaacgattagcccagagaaagagagagagagagagcaagcaaacccgaaaacgggtccagggtagagagctccaggtccttagcatgttcctggcgtattccaaaagtggcatccacagcagagaaagtgtcccaaaatagctcaggctgccaatgccttgctgaaacctgagaaagaattgctgaatttaaagatctgggtcgctgtgggtgtgtgatcaaagtgcagatttgttggtaggaggaactcaagccatgagcttaggagtgacatgaggtcacttgggtcacggcctgccttcttgtttccaacttgctgaagttggtggcagtgtcagagagctcctctgtggtgaggcaggggtttggaaagaggtcctaaggatgctgttttcatgcccaggtctctgatgcgctaacaatatgaaatagcagtgccctgttttctgcatttcaaacaaaggaactgatactatgcaaaggtttctttaggttattgctccatgtctgatgaaattcccttttcagtagatttttcatttcttttggcctttggcataagtaaatgtcagcttcttaaaaatcaacagagaagagcaaacagtagggtctctgtgattttcttgggatttgagaaatcttccctccctagcttctaactggatcatgtctgtacattgctgcctgtggtcctggaaaggacgaggtccacccagacatgctgtctcatttttatatttgctgagatcttgggacactctcctttcatcaggtatgtcaaaaaccttaggattgtctgcagagagtgtggttcagtatgtggaaaggtcagcatatgtcattcttggactggccctggggtttaagaagaaaaagcccagaatttggtttccaattccagctctgcctgtcttttgctgtatgaatttgggcaagtcacttctcttctctggacctcagtttcctcttctgtaaactgaagacaataatcttcattctaattctaacccaaatgttgtaaagagtaactcagagagttgaaagaatgctataaagggcagggtttggcactctcagtaagtggtgacatttttcagttcttcaaaggtccctgattggtagccactacctgcatccacatgcctatggcgagcccaagacatcccacagtactaggcactatgagcttcatgtctaggagtctaaatagtttccactttcagttgtgggaattttggcaagtagctcaatgcttagtagctcagttttcccatctgtcaagtgggtatacaaactaataataatacaggtccacaatcccttatctgaaactgttggagctagacatgttttacagttcaaaatatttggattttagaaaagcaatgtggtagatataacatatatatcacaccttaatgagatccaagataatacccagtgatcaaactcactaatatttctaaatgggataaatgaatagcctcatgtcaattcaggcccagttttgccaccaaatgagcttgccacagaatttcagttttcagaagctttgggatatcagagaggcacataggaaattgtggacaatgaaggaagttaatacttatttcgtgcatgtaatgtaccaggcattgttctaagtatacattaactcatttaagtggcccaataagcctgtgaggtaagcagtattattattatcatccccatttcatagatgagaaaactgagattcagaagttaaatcacttgcccagggtcccaaagccagttaggagcaatgctgggattccaacccacacagttcagctcttatccaccttctctgcctaacccatggggttaaattgaggctttaaatgcctacagggactgagcaggtcgctgaaaaagtaaaggtggccttatgggtactgaggcaaactggtgagcacgtgcctcacctacagggagcaggttgttgagctctggctgattgttgctatattggaatttggatcgaagtctttctctctctctctctctctctctctctgtgtgtgtgtgtgtgtgtgtgtgtgtgtgtgtgtgtgtgtttcagaaaagccagaaatccagctttctatctgaaatttcctgacttttaaatgttggcaattaattttaaaaaatgtttaaaacgttgtacgggtcaaataaactctgtctgcagtctgaatttagcctgtggctgccagtttgcaagctctgcaatgagtaaatagatgtgaaagtgctttggaaacttaaaaacgtgctctagaaacagaagagtctaattttagggttatatcttgttttttccttgactgtggtctagttttttaaaaacttgtattcccgacctgatggagatgaaaagtcagaattaaatagagacttcagtgaacttgagtacttcattcctttggcaggctggataaatgagaagcctaggtgtactggatggactaagcctcagaattcttgccacacccacaagccccttctaaggagtttccatccacagaccctagctgagggaagtagcagtttcttatgaataggtgactattcttggtaccacgtgaccctgcttcccccagcaatagccacttgagccaggagagggcatctgatccatgagcagtcactctataggctggcaaacagcctatgaaggaacctgggatgagaactttgcccagcaagtacagttactgaatttggaccaatgagagtttctctcttggggagtttgaataccagacctagaaagagtgagcaattggcaacaggggcagaagctgaacacagagaaggcaggcagcagggaccccggataagcaggaccaggagagattactgaacttcaactatgtgccagattctttacacgttgttttgtttaaaacattcaaagaacatgcgaggtaggtactgttattatgcctgttttacagatgaggaaactgaggtgaactaacttgaagtattgaggttcaagcccaggcctgtttgaagttaaaatgagagtgtaggaaccccaaagccagtggttctgaaactctagtgtttcagaatcacttgggttaaatgcaggttccttggcgtcaccccagacctatattgaatctgactctttgtgggtagagtctccctccccctacaaatctgtgttttagcagttttcccagggagcacttgatgcagggtttccccaccacacttttattttgagaaatgcagtttcagagggtatggcaagtactgtgtactgtgctacctttacctacacaaccaaggtcaatgtcaacagatgtggtcaaattccaatttaaagtcttttggaaatggggccaattatgtaaagaagagggcattagtttgttctcttctctcatcaaggaagtctacattattaccagttatttgagagaacagaagattgggatgaatgcttagtagttgtaaacacgatcggatctgcacttcagggtgggtgcaaagctagcatatgttcactaagcattttccatgaggtgcgtaaactgtagaaactcagtgctctggcaacaaagaacatgagagaaaattaccaaatgcagatagacatattgtaaaccgtggagcttaaaatgtaaacctacttgctaggctgatcatagaggttcttctcagccccagagaatttgtgtaagaatcctgtccatgcctttatttacaccattgattaaaaatgctaatcaggagaggatcaaggctatggacctccttctaggttgttgcagaactcccactctggcaatggtattcagctggttttgaatttttctgctttaagaactatccctgggaagactagtggtctgaagtttgcttggagagtctcaagccggaaactgatttgtggtccaaatgcttaatggcatcagacacttattcctacaagagaggcatgtggtccaaggggtggcacaggtcaaatgtgatggccaagtcccgcctcagcagggcttgaatccgcacttggcaacttttatttctctctgtccattcctgtggatactttatctgtgttaatgtcctcatttaggctaaggtcaaactctgttcttctctcttctggccagaaagacttcctgttttacaggtatatgatcttatctgtgttgataccttaactgtgagtgattccctaaagcaggtccttggacaagtgcccatcctccaggaaaattgcagcagtccaccgtgcaatgagaaagcctgaggactaggtagtaaatgtttcgcagagaagagaaatctatttcatgtattattctttattctgaggttatttccttctcttttggtgttgaaaggaagccccttctttttagaaaatgatgatttgtggttgttctgtttcttaatgattttacttgggaaaataaaaatctggaagttcaatatcagtccctgaaattttgggttgcattagctgcaagtctgggaacctggtctaattttgagtgttctgctagtacctctaggtacctcctattgccacttgtgttctaagtgcttataaattacctgcttcgcaatctgcagcagaatctctccgaggattgacatcaagcttacagctttggagtttacggtatactggtctgtagtttccttatttaagaaaattgggacactgcccatttgcagtcctctggtatccctcctgttctctctgattccacagatccttcagaccggcacctaatgcaaggcagttccgtttgctcttcttataatgttcttttccctatagagttggacatgcatatacatgttgtttggggaatttgcagcacatccaatgaaagcataattcccaactaacagtcaaatccttttctttggagctacccagaacacacctaccctctcttccatatgacagcccttcagagacttgaagacagtgtgtgactctcctgtgagttaagagcactggctgagtcagacagacccgagtgacaagcccagcttcgctccctctcagcggtgagagccaaggtaagttacttcattttaatttctctctagttcagttctttagctgatttagaaaatgggagtaaaaaagccactttgtttgtttatcgttcaataaataagatgaggtatgtaaagtgtttaacatagtgcctggaatagtaagcactcagtaaatgctagctatttccccctctttatttataaagagccggtgcgcattttaagtgtcagggctgtgggggaggaaggaagtggggagggcttctacttccctgaatgatcaaggaaggaagaagatcctaaagtagaccaggtatttctttagccttaggttgtctgttttcagttatctggatgcctatttgctaggacttggggaaagaatattgttgagaatctagggaaaggcttattttcaacagctggaaagctatttgttgacatattgaaccgtctcttgtttattcttatttccctgagcagctagccatgcaatcccctaaactcaattaccttttgtgaggcggcaggagcatgacacctcctagccgtattgatcagtgcagactgggtgggacgtgagggacctgagagatgctaagcggtaaattctgggcttttccttccttagaaggcctctcttctctgtgttcctagagactctggctttaatagaacggaagtctatgcctcacatgggctgagcatgcaagaaccctctctcagtagcctccttagaagcaggctgatgaaaatagtcacaatgggtcagaacttggaaccctggggtgaccagtgctagcatggttttctaactgcagctctttgcacacactgggttttgcaagcaattgaatgatatgaactctgaatgccattgcagctagagaaagtttggaaggagacacacccaactgtgaacagacagaggaatgggacttgcggggaatggggggtggggcattttcaggagtttagctttgtctgtacggaggatttcaagtctttatcctaagaatatattcctagattacttatggaattactaaacataaataaaagttagagaaagaagaaattatttttaaaaacaaaccaaaaataaaacacaaaataaagtggtacaaccattaagcttgtcggggtagaaagattgcttgggtcggggggtggatgtccgggattcctagagagagcttgcaaggagaggagtgaaaagggcttgagaaagaaccctagggaaacatatctttaaaaaaaataaaattaacttttattagtttttttcttttcgtattatgggtccattatagaccaatgagaaaatacagataaggaaaatgaaaattaaaaatcccctctaatcccatcattcaactgtggtcactgttggcgttttggtatatatccttccagattttttttctatgcagaaatctacatatttatctttatgataatcagatcctcatgtacacattagaatatattttcaatggctacaatagtggctgctacaattgcaccatgattcgtttaatcattaaacaagttgtgttctaacattagacacttaggttatttccaaaattgttgcattagaaataaacaacagtgccctgtagctgtgtgacattgggaaagctagttaacctctctgttcctctgttctcatctggaaaatgaaggtgctaatagaacctacctcgtagtatgttgtgagtgtcaaatgagatcatataggtaaagcacttagcacagggcctggcacagtaaacgttagctttaattgttaggtgtgttaataataataatagtagttgttgtgaggccattgttaatagaatggctattctgtgacttttttttttttttttttttttttgctttgaagggagaggagagcgactggaatttttcttttgagtagtatgctatagtgagctctggagtcacacagagctgtgtgcctttggtcatgtcaattcatctcatggaggctcagtttccttacctgtatactgagaatttaaaggacctagctcacagggtaattgtcaagatcaaatgagataatgctggtgaagccctcagccccattcttggcatatgggaagagttcaagcaatatcagttgttgttgttattattactacaaggattcagccatttgtagtaagaaagtttccttgctttgtggtgtggggatgtaggggagatggcagtgagaagagtactccgagtttctaatcacttgtctgattacaaagagataaaaatattttggaaacagaatggccagggctgaaatctgggatttaaaaaaaattattattattattttatgtgaccgtggtcacatagacttctccaagcccatttcctcatgtataaaatgggaatgatctcagtgcctaccttacaggtgttgctgggaggtcggaattatataatgcatatgtagtgcttagcccaagtgctcagttgttgttggtcgttaattatgaggtttataacgacctgaatgcctcccttgtcaaactctacatccctatacctaggctacttgaacttcacctggaggctttgccctatccaaggctcagggaccaattctccccttagactgagggtttctccccttagactgagtgcaccagttcaggaaaactggagtactctggtaaacctttctgctagctctactctgaccttgtgccccagttctagaaagcaggctgtagccatgtttgtatgaacaagccctcagctggtatgctcaaggctggtgtgcttttcttgctagctgtctgaaatccatggagcctttctgttgaatcctagccctatggcagggataccggtcgctggatttttctccgtgtctgtgaccctggggtaaattgtcttcgttatgatcaccattacagggctctattaaggtgtttgcttgccagcccccactgtccatcctcccaaaccctctttccctgcacctgaacctctttgaacgtttctgatgctgctccactcaatctccagcctcagtttctttccctcgagccctctgcctgtgcttccatgtcatatcagttgcagtgcctgggtcccaggactcctgtgtctgttcaactgcagagggcacgtatcttgtttcctgagccaggacccttttcatctcatctttttaattgtgtcaatctcctcttttctttgggcagagtggggtggggcataggctggtgggactgttgggggcgacagggaagaggggtggagttgcataggccaagtgctaaggcggagcttctggaggactgtcaagtgaaaggcggccagaggcaaatgtcagagcctatatagaggcaggaatctgggaccagagagacagagcaagcagtagcaagtcaggagcagtggggcgggtgggcgggcaggctggctggcgggcaggggggcgtggcaggggatagcaaagggagattgcagagaacagctgttggtactgggtcttactttaatgaactggctgggcacgaggtataagttaattggccagagtgaaagagctaggggcgcaaaggatactctctccctcttctccgtcactggcaaggtaagatctttctgggttttgcctggtgggaaactgtggcatgttcagatatttttctgaagatgggaggtggaggtctatggctgcttttttgactcatctttcccattgcaccaattattacaattattacaataaccagggtgtcagcaggaggccagcatttcttttatgacaacccatcttggggttgtccaggctggagacagaggcaggggtctcggtagtgtgactgagtaagggggagaggtggatctttatagcaccttggtgaagagtagggggctctggaactggatggacccaggaatctatgtgactgcaggcaaactattaagcttctctgggtctgaattttctcatttgtaagataaaggaagagtacaaccgaaatctcttagtgttgctatgggaaccacatgagatgatacatgtaaagtgcctagcagagtgtttgccagtcagtgcatgctaaagaaatgttcactgttagcgtttctgttgcaggttttctcattattatggaatcacaattccatgaggttgatgacttttgtgacattgtcccaaagtagcaagttttctgcttttggcatgggcaggctgtggggacatgtcaacattgtgtaatatttgcattggcttccaagccgtgtgtccaaaagccccttctgggctgcttattggagcaggctggaggggtgaggctctggattgcccacccccatggcatcagagaaacttgaaacttggacatgccagacactgggctttaagtgacccatgatctgggatgtcagagaaataattgaatgcaagctcagggatgccaaacactaggcaacccccaggagggggtcagagtcaatgctatacagtttgttactgttgcagtgaccctattttagccttgaccctggctaatctgagaaagcttgtaaaatggggataataatatctattgcccaggagattgtaagacccaaatgggataatgcttacaaaggccctcacgttataggaagttgtgacagttgtctaaagtacagtgcctggcacatactacgtgaagcaataaataaatagtagtaatggggtggtggttgctgttattaataagaataatgaaaataataagcagaattttcagttcatggaatgttgctctcagtcattgattagataaatgtctcccttttcctgagaacattcagggccatcagagtagtaaaatgaggattaaaccactggcagaattcaatgagccccaggaactaataattatcctggggcaaaggactttcccattcaggcttgccagtaccttggctggcttgtgagtactgccgtgggatagaatacaggccaggaatccgcatttctcacatttggccagaaggtggtgctgctgctttatttgagtcaggactgcccaggctcctggctgcggaggctgctggcgtttatagcatttacaaactgagaggctgggttggtttgaaaaggatagaggcagaagggacatttgctccagctccaaagttgttcattgcttcacagcttctttaatctgatagcctcaccttcaatgccatatacctgacaacgcataaaaacaggtctccaccatgaacaatttgtctgtttccaaatcttcttgatactggcttttgacctctaaacttgtttcttgtttacagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtcc

SEQ ID NO: 3619 - DNA, 37277 bp, human
gcaaagggcctcagccccgccctactgactgtgaattctacaacatatggagcgcctaccttgtgcaaggcattgtgggtaagtccattcatctctctgggctttccatttcctcagcttcaaaatgcatgtactaatcctgccggctttacctccctcctagggctctgtgtctcagccacactggtctttcaatttctgcaacattctcggtcttttctcgccccagggcctttgttcgtgctcctgcctggactgcccttcctcttgcttttggcatggaaggctccttcctaacctttcagtctcagcttaacgttacctcctgagaagagccttctctgaccacccacagttagatgcctcctgttcctctcttacatttcttttattagcaatgcttccttaaccccatttactgctctgggtaattatgtctatttatatttgtctatttatggtatgtctctcccactggaatgtaagctccaagaggacagggaccttgtctgtgtcactcagcaatgtgtccctctcctctagagtggtgcttggcacatagtaggctgacataagcaaaaccatctggaaaatattttcttcctgaggttcttgccagacatatggttgctgagggaaaaattatggcagaactgtgtcattccataggaaaaaaaatcaggctaaaagggaagagtttgttgaaaacagttctgttttagaaaccagtccttggagtctcatcgccagacacagtcttatgaaattaaacaaaagaaataaaaagcataaaaagctaagtttttattgggtatttactatgtgccaggaactgttctaagtgttctacacagattatctcatttaatcctcatcataacccaatgacgtcaactctattattagctccatttaacagatgaaggaattgaggctctgggatgttaagaaaagtgcccaaggtcacacagctagcaagagacagaaccaaaagttgaactcaaggcagtctgagtccaagtccacaaactaaatcatctatgccacctgcagcccccacctcatgttaccctacacctcccacgccacccccaggcacgattctactacagcactggccacattgcagaacaggggtttgtttacttgtctgtccttcctactagacgaggagcttctcaagtgcagagactggatcttattcatttttgcttcccctgtgcctggaagagagcttgttctggaatagctaaccaaggaatattcgttgaatgagcaaatgagtgagggagtaagtgaatccatattccttaatattttcaggcttcaggcttatgggctcatgtgtatttccctggtcaagcatagcactgggcacaagggtattctggtgcaagaggtgcctctcaccacagggtacaagaaggactagctctggctgggtaaaccaaagcagtgttccacagagcaaggggcttgatccagaaggtttcattttgtcatcggtctaaaaagtagctggacctgtttaggacttaaacaaactttcagtgttccaatcccatctcaaatcctttgcagaatgaggcagggtgtggggaggtggtggtggggcagttataaataaacaaatacccacaaaccggctggttttttaaacagaatttgcttcagtcagtgctgcaccacattttcccaactggcctccgtcgtgagaacaagtgggaactttcatactgaatggctttatttttattctgaccagatgaatggcaggagttttggctcgggaggcaggtttccgatcctcagcacacagtttgctgccctactgtgccccgtccatcacacacagcgccctgcacaacatacccagtcattgcatctactgcctcagcccttgaaaataattgggtcattgttttattacaccagcgagagagctgcaagcctgttaggattatgtcattgatatttgcgtgaaaaggcaatcatgatatgctggtcatttaacacagctgggaatgcaactgtgttgtcattgtttaaggttctcatccagcccctctgacttttttgcacagcccagcccgtgaaaatggatcactctgatgtatgtcacctttaaaatgctttctagcccttcaagggaccaagcaggatttaactcttttcatgcacttggactttgctgcttgtaggcacagcagtctgaaggtgagagatgcttgcttttcatacttgtgggagttgtacaccctagtggcaggatgctgccatacagtgtcatttgttcactaactgctgatcagagccaaggacaattttggctcaagaacaaatgagacctaatgtctgtgagggaagactatgtagataagtcacgggtcagagttgtgttgcgacttgtattgtgtgctagtttcagtaggacttgtgctttcattgcaattgtcagtatgcttaagcaggggtctctgctaatgaaattcgagcatatttgcatttatcgacaggtattactgatggtagaacatcttatttccacacaaggcaatgagtaacattgattatagaagtgtaaacaaagctcaaattcatgtgccaatttgtctatttcaactcatcgatcctcttcttccactggcatgctagcctgagttttatggcataaggccattaaagtattcttcaaaggaatctgttgcagacacctgttcatccctcttctggtcccggtccttgccaaaccagctctgcctttgccaaccaccttgaggtgtgacaggaaaagctgacccaataagggagtcaactgaagggatggagtggcttagatgcaaatggccaaatcccaatggccatggctataaggaacacaggttcctgaagttttcttggcaactagctctaactgctttgccttctgagtgctttggtatttgttttattctaagttcccagttttgatctatttttgccttatggctgcagattccctttctggaaaatggggctctggctgggatcaaatcagagaacacacccagacttggcatagtgcctggcacagagtaagtgctcaacaaatggtagctgttgtctctttttccctgtccaggtttcttctggttctgttctctgtacctccagtattggcccagaaccaggaactgttccctcccctgactggcaagtcagattacctggccctcagacaagctgggctcccttttctggcagccttttgttgtccttacctgttgccatgtgccactcagtgtaaccacaggcagacctctgccaattgctgacattaacctattgaatcctggcagagaagaataagtttgcagactggaatttgcatgtctgggccagatacgagaccaggaggcaaagccatatttacctgttctccccagttgtggcaaatcacccacattctggttaaaaccagatgtttcacacccatgactgcaatgccacacatcaaacagttgcttacaaagaacacaaagtggttttcacatcgcaaatgtaacttgcaggtcacttctcaaatttcctcgcagcagctaccatgcctgggtatttttcccttaaaaatgacaaccttgttgggtctcttgtagggactttcatttggaagccctgggagaacttatatgctctttccaagagggtctctgatggctttaattcacatggagttaatatattggaaaagaaaagagatcttccccaaactcacctgctccttgaaaatgctattctgttgccttggcgaacagccaatccaaacattaaaaaagagatagagaatgcaggaatcctaaatgctattctcagtgcatgtccaaacaagaactgggggctgaggggcaaagaacagaaagaggagaaaagagtttttgtagcctaggccgtgagttgatcccaccccgtcatgtcctgtacccttcacgctcataaagaagacagaggaggccgggcgcggtgtctcatgcctgtaatcccagcactttgggtggccgaggcaggcggatcacctgaggtcaggtgttggagaccagcctggccaacatggcgaaaccctgtccctactaaaaatacaaaaattagccgggggtggtggaacatgcctgtaatcccagctactcgggagtctgagacaggagaattgcttgaacctgggaggttgaggttgcagtgagccaagattgtgccattgcactccaacctgggcaacaagagtgaaactcggtctcaaaaaaaaaaaaagaaaaagaaaaagaaagaggaaggagaaggagaagaaggagaaggagaaggagagaagaagaaggagaaggagaacgagaagatgtggtggcatcatgacttctctgctagggttaattgctcagcctgagaggctctccaggctggcaggtcacactagagccaagagtgaagggtccattcagtaaggtcactgccatgatcagttctcaaccactttaactcagtttttctgttgctgctttgttggttagtggtttgtttgtttctacccatttgggagaagggtaggaaaggaactaaggtgatcaactattccatatgtgtcaggccctgtacttgtcttttcaaacacttattcacactctgagggactctctcaggtccagcaactgtgtagctatgatgtgaaatagcagcttctctctatgcattcactgggaatggtttgttctgatcacacaattttttccagttcttccgacgttaggtgttgcatggtaagaaacaggtggttaattattgagacagttcttatttggaattgtctcttcctccttctcctctcaggcagatgctaaaggatgtctgtagttttttcatggcattttgctaaagatgcacattcattaattcatcaaatagctttttttgagacattattatgagtgaggtgttgtgctatgatatgctttatataccatatcttatttcatcctcaccacaaagctatgaggtaggtactatcattatcttaattttacaatgaagagactgaggctcaggaaacataatgcaaggtcacactcagttaataagttgagagctaggattcaaacccaggtttatctgactcagttacactacacttcctccacatagcacattgtgggcccgtcacagctcttgaggacaaaattcatccttagaaaagttttcttactccactttttgctgatactactgctgctgttgctgctgctactactattactactactgctactgtttctcctcctctatttatccagaactgcatttttccagcactcctaggtgctttgaacccagctaccagttgtagagttcaaacccaggcctgcatgagtcccttgcacccattctacttttctgcactgcttgtaatgtaacacaggaggtatgggacatccataactcaggtaggtaattgacttcaagcttaacattcactcaccaatcatttattgagcacatattagataagcaacctatggctcctgccctggagttgttcataagaccttccaggcagacagctatgggacgaatacacttgaatttattaaatctacctcaggcaaaaaaccaagcatgtaattataagtagtatatcagagtatgtgtaaatggggttctgtaaaatgtttgaaagaggcaggcctgggttagtggtgagaacaaggatcaagaaggctctgccaccaaataacaacatgagtgttgtcccgttaatctctctgggcttctgtttccagatcaaggacctcaaaataatagtcatagtcaccatttattgagtgctttactgttaaccaggcagtatgctaggtggttttcatttagtcttgacaacagtattctcgctttcccttttctacagctgagactcagagacattaggtaatgtctaggtcacacagctcttcagtgaccagttgtttctatgtcagaatcctcttataatcactgagttgtatcgcttcccttgcctcctgctcccaagtcaagtattctctactatgtcgcctgaaaattaaaattaaaatcaaggttaatcttgttcaactgagccaagaggataaacattagaaatagcaattagtaggtagaaatgttgccaggaagagctatacaaaagcatagaaaggcaaccaagggagttaatgatgggggtgtggcaggggttgcatgttgatgggtaattggatcctggccagctcttaccttcttccttcaccttcccactccgcaatttctcaggcttctctagagagcacaacccacctagagacagcctgtgttgccacaggagggcaccaggccaggaatggcaggcctagggcagtggggctctgggctgggaaccataaataaccactttaatgaaaaccagctttggccaaaagccttatcatttcttaagaggttctgtgcttcttctaatgacctagttacttgagaaaggcctagcctaacatatacaacaacaataatagttgccctatagtgagtacttactatgggccagggcctgtgctaaacactcactaattcatttaatcctcacacagccctacaggagcaagtactattatttcccccacgttacagagcaggcatcaggctgagagaggctaagtcatttgctcaagatcatatagctggttggagctggaatttgaagcctgaagcatctagttccagggcctgagctctttaattcctatatttaatgaatgtctgtcgaaggaataaacagatgaatgaatagacaaatgtattcatttcatttcactttaacaaacatttattgagtgctctgtgtcagctcctgtgctaggcattgaggatttataagtttagtgcgtgcgtgcgcgcacacacacacacacacaaacgcacacacacacacacacacatcctgcatggcccttgctctccaggggttcacaaaagcattctctattgtggcttgatttcttctggagagaagtaatttgaatgtcttgaacagcagtttttaatgatgctattaaatttaacctaaagcgggggttttgcaccggtgagcaaagtgtttcaaatgagaatgtgtctttgattaatcatcgattcagccagagaatagttactaccagaatggagctgcaactcctattatattagctaactcttcttccatctatcatgtctctatcttgtcgaaccctcccacgatacaaaagttatctgtaccctaatggacaattatcccatccatcattcctgctggtcttgttgattgctggtagtctgcttgcccacggaggagacttacaaatagtcatgaccagtgacgcactggaaaactgctcatttttagacattttaaatctatgtagaatgaattatttttcaggctgtacttaagctgcatttgctttgttggttatgtaagaagagatatgaattccttacctatgcgtgagacatggcgtctgaatatttttaagttcctgtgggcagcagccctatacatatttgttaaaatgatgaaagaataaagtaaacatacctagagtaattccagaggagcaggcttcatacctggagctcgggtgggtggccatcatgtcagggtagtcaccgtcttccttttcctttctaagtactttgaggagaatcccaagttgattagggtcaaggtgaggactcatggtgctgaaaatagggattgagtggacaatgagagatgcctgttgaattccctgggactattgctatgagatttgagggcagaaatgcccccctctcccatgtcctaccctaagcctggtaacacatttaactttttgttacagtaactaccatgcctagtaaaactggagtcactggttgcccagggcaaaaacccaagagttgtagttcactcatctttatttctcacctctacattcagccagtcactaagccctgccaagtatatttcctaagcattccttgcatgtcacctcttttctccattcctactgccagggctttagttcaggactcctcccacctccagacatctcttgccttgattcctacaataccttctggttttctcaccttctctccttagtcctctgtgaccattctccccaaagtggcctgagtgatctttcaaacatgcaaatcaaatcatttcacacctccatcccctccacttaacacttgtaaatagcctcacaacacctgagacttgaggctctcaaaatgtgggtcctggggccagcaacaccagcatctctggcaacttcttaaagttagagtacgtactcattagagtacctactgaatcagaaactctgagagtgctcacctgactctgtgtttaacagccctacaggtgattctgatgagcactcaaatttgagaactggcaccctagagccatggttctcaatcctggctgcacattcaaataaatggagggagcttttaaaagttctaatgcctctcctgcagagtaattaaatcagtttctaggggtgggatccagtcataagtattgtttttaaagttccccaggtgcttctaatatacagtcaaggctgagaactactgctctataggatgaagtccaaactccttagcttggcatttaaggtctatctctttggtcataaccacccccaacactatgctcttgcttgttcattctagaattcaatcacagggagtcatttgcaattctcttagagccacacatggtctcttacctctgtgcatttgcacacatcattcccactgctgtgcccatcccttcctccctcccttcacccagctaacaccatctcatctacaacacatagctcagaagacacctctaaggaacagttttccccgcctgtccagtctgggttagatgcccctcctctgtactcccacagcgtccacaacatagcactggatacattctcttgttcttctctggttagttgtctactttctctaccagtctgagagctaggatccccacctggcacacagtagatgttccatgattctgtacatcctgttccctctttttggagtgactttctgtgccttgtctgtggccttcaggatgcagctcagatatcacttcttgggaatctcagaattctctgtctggaccctttctctaggctcccgcaacaatctaaatgtaatctgatcctagcccttagcacacagggctatcaggctgccatagtctgtttacttatctgcctccctcactgaactgtaagtaacttgaggttagggacagagccttgtacattcctgtatcccagctcctagcacaaagactcacacattataggtgctcagtagccataaccatctgcagaacgaataactgaatcaatgatgaccttttcctcttctccatatcatcagccactatttctgtccaggcccccgttgctttattgcaatagccttctgactatttcccatctctcctttctctgatgccatctgaacactccccccctctccaagatgtggctttctaaaaccacagtcaccctatccctcccctgctcaaacactttcagtcattcctcattgtctgcagggcaaatatcaaagtggaattccagatccttccttcccaagagtggtctgccttcccaaccatacctccccccattcccctatggaataccagccacatcatctgagggtcctggtgcaaaacgaaaatgtggaaccccgtgttaaaatataatcaaggatttcaagatagcagcaaaggagagcattaaaccaagcatagggctcttctgacttcagggtccgatgcgacggcacaggtctgcccctacgtgtatccagcgcactggccaaatgcacttgctcctccttcaactgctctgtaggttcactttctccacggcttttgtcaggctgttccatctcttctaccccactagccaattcaaagcttgtcttccctgtagatccaccctgttcttcaagaattgctcaattctcatctcctactgttccagaccacagtagtttctaccacacagcctgatattaataattatttttatatgtgtgtagtcttgcctgtctactgaattttaagcttcttgagggcaaggactctattttgttcatcttttttttttatagacttagcatagtactttgtaatcatctcacttgttgaatgactcagggaagaaataatacaactccagtcactgagtttgccaaaaaacagtagacactgcaaacctgatttaaatccctcattattagctatgcaacattgaaggagtcacctcacttctctttgccatctataaaacgatgatacttagagaaaaagtgtttttttttttttttgttttgtttttttggtttttttgtttttacagaggcttgctctcttgcccaggctggagtacagtggcatgcaatctcggctcactgcaacctccgcctcctgggttcaagtgattctcctgcctcagcctcccaagtagctgggattacgggcccatgccaccatgccctgctaattttgtatttttagtagagatggggtttcaccatgttggccaggctggtcttgaactcctgacctcaagtgttccacctgtctcggcctcccaaagtgctgggattacaggcgttgagccaccatgcctggctagaaaaagtaattttttgttagtatcttgttctttggcaatgttttcaaaatcttttgttttttaatacatgtaaaacttattttatattttatatcacctaattgcaatacctgaggtctttgaagacctgattctgttttcattgtttctggcttcatcgtgttctttgtaattttggattatgagttcatgttcaacctgactttatccttggtaatcctatgaaaactgggtggtgggcatgttcttccagggaggatttgtgtttggttcttccaagtgcatcagggcactattaatccaggagttcttccagtgaattgtttagtcccaaaggcaagggccatgtcttctttggctatatgatcccagggcttaactcagggacttgtagatgctcaacatatatttgctgattgagtggatgaatgaatgtggtactttaccgcttcttttggaagcccaataagaattgtgacctctggtattaacaaagaacagtaggcacatcaggaaaataataattactaacatttattgagcaatgattatgtgtcaggtatcattctaagtgctttgtgtgtattaactcatttaattctcactatgatgctgtgaggtaggttactattattatcttcacattacagaggaggcaccagactcagacaggctgaataacttggccaaggtcacatagctagtgaatggcggaacacagatatgaacccaggcaccctagagacacatctacttaccaccttgtattggagaagaggtcaacagtagtgacagaagcaatagagtggaaattttcagtactgccaaaactatgagagccatatagtccacaccaggcatgaaaaggaagctggcatggtcttgtgttgtcagttaacccttgtatatagggttttcatttcctaactagagaaggaggagtttgaaagcacgaaccatgaattacagctctttgaaatgctcaacatagatttgctgagtgaataaatgactgttttgaaattaaacacaggagtgctttgaataaattactttgcatcttgtatgtcaaactgaaattggtgagacatctttcaccttgtgttaaaaactaaaaatccctagatgtggtcataacatggctggttataatgacaccttgcatttgtacttgtgtatgatactcaggactccctgagaaaaggaatgaagaaacttggattttgccttcataggccctgaggctgtcaggaaccaagggccactgtgtttgtaatccattcctttggctgctctccaaatctaggaagacctggaggaaaggggggctttattttctatctttgccaagatcaggaaataatttgtgaactctcagtaaacattctgggggccttccctctaacactgctttggtggaataatatctccagttttcaccaatcttggttcaatatttacctgggggtttgcagtgatcatggggacagggctccaacatgaagtgaaggttcatgagaaggaaaatgaggggaaggctgtgtgtgtgtgtgtgtgtgtgtgtgtgtgtgctggctgagggatgaaggtgggaggaataccaggattctgaagcaatgagagtgggattgggagagagagctcatgttgaagaagaaataactcaccagttcacatgggctccttttcaagggtttttctttatataaacaatttgcctggttccaattagaagcccacattaggcagttagctccaatttggcagttcattcttaatttggctttccttatgggtgggagggagggctgacagttaaaaggttgatgggaaaaaccttggtatcctggtgtgaagacagaccctgggatcagaaggttgccctgatgactttgccaatgtgttcattgcccctgtcctgctggggcgcatacagcaggcccttctttctcatacgcccttgacagaccaggactcactgctagaaaacccctggggaagtcattgctgaagactctagtgtggggcacattaggtttgaggagcaggggaaacattcaggcagctggcaaggtctgggctaccaggagagatttgggagttagaagcatattaggtgagagttgacactgtccaaagggagtatatagaaagaaaagcagaggaaagggctcatggagtcattacagcctgtgaggtgggaacagggtttgggagtactaagggtttggggagggtttatgtgtttattcacccattcatttattcaacatttcttgagctttatggcagatgctgagttgaagaggaagctggggatttaagagggagaagagttaagaggggatccctgggtggatccagatgaaggagaagggaggggctaagtgcctaggctcgctcttgccaggagagcacatctgttaacacaaagctgcatctgtatctcagccagctctcttccatttcatctcctcctctctacccacacttgcaagacggggagccacatggcggcttcctactcccttgtaccactacaccccctgccgggttctttctaggcatttagctgtggcatcagcagcaccccttctgagagatcaggcaatccccaagggtgagtggtagtggtagtggtggggagggttgatagcttcgagagaagagctggagaaggcgctgtctggctgtaattagccccagctgctgttgtgaggcagcgttgggggccgtcaggagtgtacatgcatgtgtatgaacctgtgagcgtggcacctcattgctatcactctatttttcactgtattgtgtgctggctgcagcctcgctgctctgaaacccctcctgtccctgaggatcccgaaagacagagtgttccacaggcagcaccagcttgaatcactaatgctattaagcaggaggacaacaaatataggcccccatatgtcctggatatgcaagtccctgctctctctttccccacccctgcttcctgaatgtttccaagtgagtgaagtcccagcacttgaaattagcaacacctcacttctgcacagccttttggcaaagagctttcacagctgccatgtcatgcatcctcagacgcttctaggagaagcattttataggtgaggaccctgtggttcagggaggtggagagatttgcacaggctaacccagacagtcagtggcagacttgtgtccaggaagcaagtcctcgacctcctggcctggtggcccatccccagcagagcactgccaagagggctgctcccgggtggctccagctgctgctgtctgtgagctcgtgagaacctgtcagctgtggctccaagacctgcctcagtgattgctgaaaacgctgagagtgctgaaaaccaggaccctcaagccgagcctgacgtcacatagttgattgagtacctgctatgtgcccaccactgtgctggtgcttatgggagacaaaacaggggtagtgcatagcccgtatcctcaaagaagtgataacttgaatggggaaacaactcttagataccaagtccaaaggcaattccaagcacttctctctcttccactaagcagtctgttgtcagtgacaatgacacaggaaccccttctgaattcatctgtcttatcgcaggcctggggtaggagaggatgggaggatgactaggaagggtaatgaggaagggcagggagatgggggaaggaagggaaaaactggagctcctaataaacaccaggcacattgtgaagtttatatgttatacataggtcatttgtattatgcttatcatacatgtacatgaatatatacacccaaacacatacacaaacacatacacaatcactttccagggattgactcatctatttggctcactctcaatcatgaaaagagcttaggacagtgacacttttagaaagccctgaatgagtgttaactagcctttcttcttatcatgatcatcttcattgtcattatcggcatattatataaattatctcatttatttcttctaactacaggacttagcaactattatttttatttccagtttacaaatgaggaaaccagtatcttattttatccaagcttgtgggtactgagaatataaagaggaattcaatatggttctaggcaaactttggggtcttccctatctagtgggagggaccgaggcacacataagccctcatggtccaataggtgctgtggtagaggaacgtatctggggaagttgaggaagtctccacgaatgaaggaggcttgagcagcatcttgagggatggcaggttatgtcaggaggaacagtggaggcaggggaagacattccaggcaaagtgagcagtatttgtgtgacagggcctagtgcatgtttcaaagggcaggacaattgtagctgggtgcaccactggcagcagcaggaggggagtggacgagtatttggggtcagctattcagagccctattggccaagctgaaggttttgttctgtgagcaagagggagccactggagctttttattaaggcagattcgggacagactaggaagacagtccttaccagggtgttgaaagattggagggaagagaggccagctgcatgcggaccaattgggagaccatctccagggtctgggcaagaagtggaacaggctctgaaccacgaccgtggcagtgagagccgagaggaggggatgactcaaggcacatgtcaacaggtagaaacctcagggctggctgtcatggggtcaaggagagggaaaaggtgacaaggaccctgaggttccagcttgggtccgtggtgatactgtcaactgaggcagggaacacaagactgttagtagagagggagagtgaggggagacagatgacaaggtctgtttggacttgctgggtttggagtgctggatagcggacatgtccagcaagaaactgggaatcttggctttgagcccagctgagacatgggggctggaaagccaccacagtcaagggatattagttgacctcaggggactggatggggtttctcctctcccattttactcatccagggcaagggctagggacagagccaggtgaataccagtatttaatgagggaggtggtgggggacaccagcccggagtgagaagacactcttctttggaccttcccagaaacatcatccctttcccctcatgatcatggtccttgttccagggctgcactcaggccagtgacagaaggaagggagggacagagggagaaagggaggaaagaagggagggaaggagggaggggggaggaaagaagggaaggaaggagggaggggggaggaggaaggagggagggagggggaagaaggagggagtgagggaggaaggaaagggaggaaggagggaaggagggagggaggagctctgtgcacagaactcatgcctgcacaggggccatgaagcaaggacaggacagtcacttcagctctggagttctttagtgtgggagtatcttctaacaaaacctaataaattaacagctgtgggtttggggcagcaaggacaaagaccacaactctacagtgacccctggagcactcagtgccactgactgcgtctccactgctgcagagctgggagcacattcatgacagcatttttcaagctcctgtctgtgcaaaccacagctggtctcctaggagtcctaacactttaattagacctagcaggtcccagaacaaaatcccataatccccaaatctatagcaacaagttaggcatgagagttttagttacattctggatgtaagagaaccctaactgccactttctttctgagtctccaaatgacctttgaccaatctctttaccagaaatatttatctagaatggccttggtctctgacaccttgaggacttctactgatttctctgttaaatccctggaaccacaccaataatagttctgaacattttacactcatcatctcatttattcctcacaaatattataaaccctgtttatatatatgtgtaatatttatagtaacaagagtagcagatattttgctgaggggaggcatggttctacacaggttacatgaagtaattcataattccacatgaacagcactatgaggtattattactgtctccatttcacaggcaaagagcaaatcacagaaagaatgagtaagttgttcaaggtcacacagcctataagaggcaaagcctgccggtgtggctccactgtgctattaaccagtaaggtcttctatagccccaactagctcaaaatggttctaaatgaagaatcgctgtgcgttttgcacctcagactgctagcatcgctgatttaggtctggagtttagataagtgaaactactcagggtctttgtgaagtatctttagagctgctgcttggacaagactgggtcaggacttcgaaggcatttccatgtgctcctggagagtcaggatgtaggctgggattcattatgcgacccagctgtgtgactttcctccccaccccttacccccattcaccaagatagaatgcactgtttcttaaggtgtggcttaaggagagctctttaaacatgcagattctagggctgaagcacaaacccactctgtatctttatagagataactgctggaatatgcattttagtaaactctcaggctgaattactttgagaatcatcagagtctactttgacaggatataggcttgtcttctgattctagaagtaccataagcctaactagggatgcttcccactcctctttcttgctgagcagagaagcaagggggactggaatgcagagaacatgctgagggcatgcctgcacagaaagctgagctccttgtcaccacataccttgaaagagtggactctgtatccccaggagaggatggggagggacagagagagaaagctatggaaagcctctggaagccttagtaccctggggcccagacaagggagtcccctgagggaggtagagagtggggctgttggaggaggagagcagctatgggccagcagcctgaggagctgagagtcacagtgggagtgactgtggcttcagagtgatgccatagctgcagtgagctgtacaggaaccagagacccaaagttttctgtagggcttcttttgctttgttagtgcttcaggagttggatccttctggaccctgatctcccagaagtgattccatttcgcctctaggaggtgggtagcaaagctcagtctgtggctggggaaagccaaggaagtgatttcacgaatctttagcagtgaatccacctatttagttagcaggggatggagcagatcagaactagcgagaggaaaggcttaggaatgctctctagtgggactgagaagaaaaggtgagagggtgacattaactggaggagatggtgagcccctgacccctgcagttgtgagacttgcactgagtgggatgatctgctgctataacctatcctcaggcaatgaagcataagcagagagccaggagtgttaatcattgctgatttttattaagcatttcctttgtactggacactgtactgggctgtacatgcatcatcacattcagtcttcacaacattatatgatagctcctattactgtgcccattttacagatgaggtttagataggttataccacttgcccaaggccacacaactagtaagtagcagagccagaatttgcacccaagtggttttaatccaaactgtgtccactaggccttaggaaggagcccacatagagctttggggatgctgcattcttgacctgtggctgtaggtgggcaactcctcttcataccttatagctcttggtaaatgaagtgaatcactgtatctaccatgaatctccttgggaatgagttcaatgcgggtatcagaggaagcaaagggtgggaagggggtctcaaaagtctaaatcttagtgtggtcccctcctttgacctactctctctgggctgaagaaatgccaggattgagggggcagcagattgttagatctgtttgttccatctactgaggcctcataacatttttggagcccttgttcagtgactcaggtaattcagcctgagggtacctttgcagggagttcccctatctcttatcctgtgttagtacatgagattattcctccttcttgtaccccagttacattaagtgggtcttattccccaaatccgtagtctctgccccaataagttgcctgtaccccattttagcaagaatagaatcttccctttctgccaacagagcttcttggcactttggccttgcctggttcctgcttgcagactcctgttctgaggctcatgtttgtacctagaatgatttcatgttcctcctctctctttgtccctctatcagaacctgctttcacgatgggagatttaagaggctgatcctcccaagaggttggcattttaactgatgccaaagccctgagtcaaaagaattatatacttaaaaattttcaagcccttgggagcggatggagagattggaaaggccaatggaacattcttaatgctcctggaatgccacaaggtggacataaaattcaggcttctgccaagacaggacttggattatttttgttataatcagaatccgtaatctgcccccaccccagcactcagggctttgatcaaaagtcttccagacaatgaacctctatgatccaagtatcattttctcagagctccttagaaggaggagagctaagaaacttcatgaattaccaaggaccaagcaaacaggcggtagtgaagtcagaaacaaattcctcccgagactagttttgtcctatagcctgaaaacaaatccggtctccaccagacataaggtggaattcctgtcttgattttttttttagcactgatattaacatttttcttctcaaatcctcttcagaaccagcccttttagaacacaaattagaagctgtttattttgtcaatcagagaaactgaaggcagccagccttggccaaaggaacatcttatcctttgcctttgctaaggacaatgttccttctattgtgctctgtggaaataaaagggcaaaatatgcttgccttcttttattcttattcatggctgagggtcatatgaaagttcagagaagagcacagtttttagtatgggtcgtggcaggttttccagatggcttcctagccaagatatttctcccgctcacctccaaacaagttatgtacccctaagaatgatttggtctcagtgttaggggaagagggtaggtagcagggcctggctttgtcatcctgggctattttgaggggacttcagcagtccccgacagaaggacaagaggggctgattctccctttgtgagcagccattggagctgcttcagggactgacaagccggccagagacaatgtcctctctcaggaaagcagtaaaaacatcagaaatgctcctttcctggggagcccttagttattttggcctctctttccattaaaataggaaagcattgaaagggaccattcgtgggatagcgtggagcctccccattgtggcagcatttctaactgcgttgagaattaaccatattgctcttcctttttaccatggaggagtttctagatttttatttataccctaccgcttaaaacatctttcactgtttcagcaaattgcagcataaaagatggagaagccagcaggggctgtgctcacaataatagctgtggttgcatttaagacattcaaatgccaagggtgcacttctcccattaagtccaacataagaaatcaggtgtgcacaacattgatgaacagaagaccccaaaggacaggtggagtttctggtatgctgtggtgggggcggtggggtggtgagcttgggaaagaacgaacaggcattttcattttccaaactaagaagcagtttcgggcgaaggggagccgtggggatgtcagaaattcttctaacgccatggacctgcccacacctgagtcagataaagatgaccttccctaggccctgctttcctctccccctccccaaaagacagcatgagcatgagtaagccgggtacttacaggtgcagaagaatttggaacaggaaaatggagcttacaggctcccgaatgcctgccgagtcagttgcatcagattaggaagtgatgatcctaagaataagatgtttggaaaatcttgtcccccgaaagccccctgctttgtcttctcagcccacatccaaactcagaccacccccaggatgtctctcatcctgccagactgcctggtgcctccgtgccccttaccgtgagggtgctggcagccacactgcttctttgagcctgtggcccggcaaggtagtcaggctcatgggattaggttggcaggagcgactgtcctctaaacgattagcccagagaaagagagagagagagagcaagcaaacccgaaaacgggtccagggtagagagctccaggtccttagcatgttcctggcgtattccaaaagtggcatccacagcagagaaagtgtcccaaaatagctcaggctgccaatgccttgctgaaacctgagaaagaattgctgaatttaaagatctgggtcgctgtgggtgtgtgatcaaagtgcagatttgttggtaggaggaactcaagccatgagcttaggagtgacatgaggtcacttgggtcacggcctgccttcttgtttccaacttgctgaagttggtggcagtgtcagagagctcctctgtggtgaggcaggggtttggaaagaggtcctaaggatgctgttttcatgcccaggtctctgatgcgctaacaatatgaaatagcagtgccctgttttctgcatttcaaacaaaggaactgatactatgcaaaggtttctttaggttattgctccatgtctgatgaaattcccttttcagtagatttttcatttcttttggcctttggcataagtaaatgtcagcttcttaaaaatcaacagagaagagcaaacagtagggtctctgtgattttcttgggatttgagaaatcttccctccctagcttctaactggatcatgtctgtacattgctgcctgtggtcctggaaaggacgaggtccacccagacatgctgtctcatttttatatttgctgagatcttgggacactctcctttcatcaggtatgtcaaaaaccttaggattgtctgcagagagtgtggttcagtatgtggaaaggtcagcatatgtcattcttggactggccctggggtttaagaagaaaaagcccagaatttggtttccaattccagctctgcctgtcttttgctgtatgaatttgggcaagtcacttctcttctctggacctcagtttcctcttctgtaaactgaagacaataatcttcattctaattctaacccaaatgttgtaaagagtaactcagagagttgaaagaatgctataaagggcagggtttggcactctcagtaagtggtgacatttttcagttcttcaaaggtccctgattggtagccactacctgcatccacatgcctatggcgagcccaagacatcccacagtactaggcactatgagcttcatgtctaggagtctaaatagtttccactttcagttgtgggaattttggcaagtagctcaatgcttagtagctcagttttcccatctgtcaagtgggtatacaaactaataataatacaggtccacaatcccttatctgaaactgttggagctagacatgttttacagttcaaaatatttggattttagaaaagcaatgtggtagatataacatatatatcacaccttaatgagatccaagataatacccagtgatcaaactcactaatatttctaaatgggataaatgaatagcctcatgtcaattcaggcccagttttgccaccaaatgagcttgccacagaatttcagttttcagaagctttgggatatcagagaggcacataggaaattgtggacaatgaaggaagttaatacttatttcgtgcatgtaatgtaccaggcattgttctaagtatacattaactcatttaagtggcccaataagcctgtgaggtaagcagtattattattatcatccccatttcatagatgagaaaactgagattcagaagttaaatcacttgcccagggtcccaaagccagttaggagcaatgctgggattccaacccacacagttcagctcttatccaccttctctgcctaacccatggggttaaattgaggctttaaatgcctacagggactgagcaggtcgctgaaaaagtaaaggtggccttatgggtactgaggcaaactggtgagcacgtgcctcacctacagggagcaggttgttgagctctggctgattgttgctatattggaatttggatcgaagtctttctctctctctctctctctctctctctgtgtgtgtgtgtgtgtgtgtgtgtgtgtgtgtgtgtgtgtttcagaaaagccagaaatccagctttctatctgaaatttcctgacttttaaatgttggcaattaattttaaaaaatgtttaaaacgttgtacgggtcaaataaactctgtctgcagtctgaatttagcctgtggctgccagtttgcaagctctgcaatgagtaaatagatgtgaaagtgctttggaaacttaaaaacgtgctctagaaacagaagagtctaattttagggttatatcttgttttttccttgactgtggtctagttttttaaaaacttgtattcccgacctgatggagatgaaaagtcagaattaaatagagacttcagtgaacttgagtacttcattcctttggcaggctggataaatgagaagcctaggtgtactggatggactaagcctcagaattcttgccacacccacaagccccttctaaggagtttccatccacagaccctagctgagggaagtagcagtttcttatgaataggtgactattcttggtaccacgtgaccctgcttcccccagcaatagccacttgagccaggagagggcatctgatccatgagcagtcactctataggctggcaaacagcctatgaaggaacctgggatgagaactttgcccagcaagtacagttactgaatttggaccaatgagagtttctctcttggggagtttgaataccagacctagaaagagtgagcaattggcaacaggggcagaagctgaacacagagaaggcaggcagcagggaccccggataagcaggaccaggagagattactgaacttcaactatgtgccagattctttacacgttgttttgtttaaaacattcaaagaacatgcgaggtaggtactgttattatgcctgttttacagatgaggaaactgaggtgaactaacttgaagtattgaggttcaagcccaggcctgtttgaagttaaaatgagagtgtaggaaccccaaagccagtggttctgaaactctagtgtttcagaatcacttgggttaaatgcaggttccttggcgtcaccccagacctatattgaatctgactctttgtgggtagagtctccctccccctacaaatctgtgttttagcagttttcccagggagcacttgatgcagggtttccccaccacacttttattttgagaaatgcagtttcagagggtatggcaagtactgtgtactgtgctacctttacctacacaaccaaggtcaatgtcaacagatgtggtcaaattccaatttaaagtcttttggaaatggggccaattatgtaaagaagagggcattagtttgttctcttctctcatcaaggaagtctacattattaccagttatttgagagaacagaagattgggatgaatgcttagtagttgtaaacacgatcggatctgcacttcagggtgggtgcaaagctagcatatgttcactaagcattttccatgaggtgcgtaaactgtagaaactcagtgctctggcaacaaagaacatgagagaaaattaccaaatgcagatagacatattgtaaaccgtggagcttaaaatgtaaacctacttgctaggctgatcatagaggttcttctcagccccagagaatttgtgtaagaatcctgtccatgcctttatttacaccattgattaaaaatgctaatcaggagaggatcaaggctatggacctccttctaggttgttgcagaactcccactctggcaatggtattcagctggttttgaatttttctgctttaagaactatccctgggaagactagtggtctgaagtttgcttggagagtctcaagccggaaactgatttgtggtccaaatgcttaatggcatcagacacttattcctacaagagaggcatgtggtccaaggggtggcacaggtcaaatgtgatggccaagtcccgcctcagcagggcttgaatccgcacttggcaacttttatttctctctgtccattcctgtggatactttatctgtgttaatgtcctcatttaggctaaggtcaaactctgttcttctctcttctggccagaaagacttcctgttttacaggtatatgatcttatctgtgttgataccttaactgtgagtgattccctaaagcaggtccttggacaagtgcccatcctccaggaaaattgcagcagtccaccgtgcaatgagaaagcctgaggactaggtagtaaatgtttcgcagagaagagaaatctatttcatgtattattctttattctgaggttatttccttctcttttggtgttgaaaggaagccccttctttttagaaaatgatgatttgtggttgttctgtttcttaatgattttacttgggaaaataaaaatctggaagttcaatatcagtccctgaaattttgggttgcattagctgcaagtctgggaacctggtctaattttgagtgttctgctagtacctctaggtacctcctattgccacttgtgttctaagtgcttataaattacctgcttcgcaatctgcagcagaatctctccgaggattgacatcaagcttacagctttggagtttacggtatactggtctgtagtttccttatttaagaaaattgggacactgcccatttgcagtcctctggtatccctcctgttctctctgattccacagatccttcagaccggcacctaatgcaaggcagttccgtttgctcttcttataatgttcttttccctatagagttggacatgcatatacatgttgtttggggaatttgcagcacatccaatgaaagcataattcccaactaacagtcaaatccttttctttggagctacccagaacacacctaccctctcttccatatgacagcccttcagagacttgaagacagtgtgtgactctcctgtgagttaagagcactggctgagtcagacagacccgagtgacaagcccagcttcgctccctctcagcggtgagagccaaggtaagttacttcattttaatttctctctagttcagttctttagctgatttagaaaatgggagtaaaaaagccactttgtttgtttatcgttcaataaataagatgaggtatgtaaagtgtttaacatagtgcctggaatagtaagcactcagtaaatgctagctatttccccctctttatttataaagagccggtgcgcattttaagtgtcagggctgtgggggaggaaggaagtggggagggcttctacttccctgaatgatcaaggaaggaagaagatcctaaagtagaccaggtatttctttagccttaggttgtctgttttcagttatctggatgcctatttgctaggacttggggaaagaatattgttgagaatctagggaaaggcttattttcaacagctggaaagctatttgttgacatattgaaccgtctcttgtttattcttatttccctgagcagctagccatgcaatcccctaaactcaattaccttttgtgaggcggcaggagcatgacacctcctagccgtattgatcagtgcagactgggtgggacgtgagggacctgagagatgctaagcggtaaattctgggcttttccttccttagaaggcctctcttctctgtgttcctagagactctggctttaatagaacggaagtctatgcctcacatgggctgagcatgcaagaaccctctctcagtagcctccttagaagcaggctgatgaaaatagtcacaatgggtcagaacttggaaccctggggtgaccagtgctagcatggttttctaactgcagctctttgcacacactgggttttgcaagcaattgaatgatatgaactctgaatgccattgcagctagagaaagtttggaaggagacacacccaactgtgaacagacagaggaatgggacttgcggggaatggggggtggggcattttcaggagtttagctttgtctgtacggaggatttcaagtctttatcctaagaatatattcctagattacttatggaattactaaacataaataaaagttagagaaagaagaaattatttttaaaaacaaaccaaaaataaaacacaaaataaagtggtacaaccattaagcttgtcggggtagaaagattgcttgggtcggggggtggatgtccgggattcctagagagagcttgcaaggagaggagtgaaaagggcttgagaaagaaccctagggaaacatatctttaaaaaaaataaaattaacttttattagtttttttcttttcgtattatgggtccattatagaccaatgagaaaatacagataaggaaaatgaaaattaaaaatcccctctaatcccatcattcaactgtggtcactgttggcgttttggtatatatccttccagattttttttctatgcagaaatctacatatttatctttatgataatcagatcctcatgtacacattagaatatattttcaatggctacaatagtggctgctacaattgcaccatgattcgtttaatcattaaacaagttgtgttctaacattagacacttaggttatttccaaaattgttgcattagaaataaacaacagtgccctgtagctgtgtgacattgggaaagctagttaacctctctgttcctctgttctcatctggaaaatgaaggtgctaatagaacctacctcgtagtatgttgtgagtgtcaaatgagatcatataggtaaagcacttagcacagggcctggcacagtaaacgttagctttaattgttaggtgtgttaataataataatagtagttgttgtgaggccattgttaatagaatggctattctgtgacttttttttttttttttttttttttgctttgaagggagaggagagcgactggaatttttcttttgagtagtatgctatagtgagctctggagtcacacagagctgtgtgcctttggtcatgtcaattcatctcatggaggctcagtttccttacctgtatactgagaatttaaaggacctagctcacagggtaattgtcaagatcaaatgagataatgctggtgaagccctcagccccattcttggcatatgggaagagttcaagcaatatcagttgttgttgttattattactacaaggattcagccatttgtagtaagaaagtttccttgctttgtggtgtggggatgtaggggagatggcagtgagaagagtactccgagtttctaatcacttgtctgattacaaagagataaaaatattttggaaacagaatggccagggctgaaatctgggatttaaaaaaaattattattattattttatgtgaccgtggtcacatagacttctccaagcccatttcctcatgtataaaatgggaatgatctcagtgcctaccttacaggtgttgctgggaggtcggaattatataatgcatatgtagtgcttagcccaagtgctcagttgttgttggtcgttaattatgaggtttataacgacctgaatgcctcccttgtcaaactctacatccctatacctaggctacttgaacttcacctggaggctttgccctatccaaggctcagggaccaattctccccttagactgagggtttctccccttagactgagtgcaccagttcaggaaaactggagtactctggtaaacctttctgctagctctactctgaccttgtgccccagttctagaaagcaggctgtagccatgtttgtatgaacaagccctcagctggtatgctcaaggctggtgtgcttttcttgctagctgtctgaaatccatggagcctttctgttgaatcctagccctatggcagggataccggtcgctggatttttctccgtgtctgtgaccctggggtaaattgtcttcgttatgatcaccattacagggctctattaaggtgtttgcttgccagcccccactgtccatcctcccaaaccctctttccctgcacctgaacctctttgaacgtttctgatgctgctccactcaatctccagcctcagtttctttccctcgagccctctgcctgtgcttccatgtcatatcagttgcagtgcctgggtcccaggactcctgtgtctgttcaactgcagagggcacgtatcttgtttcctgagccaggacccttttcatctcatctttttaattgtgtcaatctcctcttttctttgggcagagtggggtggggcataggctggtgggactgttgggggcgacagggaagaggggtggagttgcataggccaagtgctaaggcggagcttctggaggactgtcaagtgaaaggcggccagaggcaaatgtcagagcctatatagaggcaggaatctgggaccagagagacagagcaagcagtagcaagtcaggagcagtggggcgggtgggcgggcaggctggctggcgggcaggggggcgtggcaggggatagcaaagggagattgcagagaacagctgttggtactgggtcttactttaatgaactggctgggcacgaggtataagttaattggccagagtgaaagagctaggggcgcaaaggatactctctccctcttctccgtcactggcaaggtaagatctttctgggttttgcctggtgggaaactgtggcatgttcagatatttttctgaagatgggaggtggaggtctatggctgcttttttgactcatctttcccattgcaccaattattacaattattacaataaccagggtgtcagcaggaggccagcatttcttttatgacaacccatcttggggttgtccaggctggagacagaggcaggggtctcggtagtgtgactgagtaagggggagaggtggatctttatagcaccttggtgaagagtagggggctctggaactggatggacccaggaatctatgtgactgcaggcaaactattaagcttctctgggtctgaattttctcatttgtaagataaaggaagagtacaaccgaaatctcttagtgttgctatgggaaccacatgagatgatacatgtaaagtgcctagcagagtgtttgccagtcagtgcatgctaaagaaatgttcactgttagcgtttctgttgcaggttttctcattattatggaatcacaattccatgaggttgatgacttttgtgacattgtcccaaagtagcaagttttctgcttttggcatgggcaggctgtggggacatgtcaacattgtgtaatatttgcattggcttccaagccgtgtgtccaaaagccccttctgggctgcttattggagcaggctggaggggtgaggctctggattgcccacccccatggcatcagagaaacttgaaacttggacatgccagacactgggctttaagtgacccatgatctgggatgtcagagaaataattgaatgcaagctcagggatgccaaacactaggcaacccccaggagggggtcagagtcaatgctatacagtttgttactgttgcagtgaccctattttagccttgaccctggctaatctgagaaagcttgtaaaatggggataataatatctattgcccaggagattgtaagacccaaatgggataatgcttacaaaggccctcacgttataggaagttgtgacagttgtctaaagtacagtgcctggcacatactacgtgaagcaataaataaatagtagtaatggggtggtggttgctgttattaataagaataatgaaaataataagcagaattttcagttcatggaatgttgctctcagtcattgattagataaatgtctcccttttcctgagaacattcagggccatcagagtagtaaaatgaggattaaaccactggcagaattcaatgagccccaggaactaataattatcctggggcaaaggactttcccattcaggcttgccagtaccttggctggcttgtgagtactgccgtgggatagaatacaggccaggaatccgcatttctcacatttggccagaaggtggtgctgctgctttatttgagtcaggactgcccaggctcctggctgcggaggctgctggcgtttatagcatttacaaactgagaggctgggttggtttgaaaaggatagaggcagaagggacatttgctccagctccaaagttgttcattgcttcacagcttctttaatctgatagcctcaccttcaatgccatatacctgacaacgcataaaaacaggtctccaccatgaacaatttgtctgtttccaaatcttcttgatactggcttttgacctctaaacttgtttcttgtttacagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggaggtaatgagggggaaatccgctgaaggtttttgagcagagaaatgaggaggtcacgacagggaatacatcctgcttccttgagtagaattgggaagaggcaagggggaggcatggagctcctagaccattaaaccccagcagtttcatcaagtgagcatggctctgcagttattttgggtatattaactactttgaggagcaatgtcctgcccaagttactgagaacgtgggatagttgaagtactaattcttctcattatgagggaactggatgggctcagttccaattctccccttgttccaagtccaattctaataaatgggtcttttgggagctggggcccatctacagcaacatgtgttgtggagtcaggtcactagggaattagaatagcctactccttggtcacactgtatgcaagtgagataaattagcaaagtgtcttgatctgctaagtcacagaacttatccaggcagaacacccgttgccatagtaagtgtggctcttacctctgttgtctttttctcactcccagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctgccctgacaatcagagtagggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaagtaaacttcatttatgaaaaaaga

SEQ ID NO: 3620 - DNA, 243823 bp, human
ctctttctctgggctaatcgtttagaggacagtcgctcctgccaacctaatcccatgagcctgactaccttgccgggccacaggctcaaagaagcagtgtggctgccagcaccctcacggtaaggggcacggaggcaccaggcagtctggcaggatgagagacatcctgggggtggtctgagtttggatgtgggctgagaagacaaagcagggggctttcgggggacaagattttccaaacatcttattcttaggatcatcacttcctaatctgatgcaactgactcggcaggcattcgggagcctgtaagctccattttcctgttccaaattcttctgcacctgtaagtacccggcttactcatgctcatgctgtcttttggggagggggagaggaaagcagggcctagggaaggtcatctttatctgactcaggtgtgggcaggtccatggcgttagaagaatttctgacatccccacggctccccttcgcccgaaactgcttcttagtttggaaaatgaaaatgcctgttcgttctttcccaagctcaccaccccaccgcccccaccacagcataccagaaactccacctgtcctttggggtcttctgttcatcaatgttgtgcacacctgatttcttatgttggacttaatgggagaagtgcacccttggcatttgaatgtcttaaatgcaaccacagctattattgtgagcacagcccctgctggcttctccatcttttatgctgcaatttgctgaaacagtgaaagatgttttaagcggtagggtataaataaaaatctagaaactcctccatggtaaaaaggaagagcaatatggttaattctcaacgcagttagaaatgctgccacaatggggaggctccacgctatcccacgaatggtccctttcaatgctttcctattttaatggaaagagaggccaaaataactaagggctccccaggaaaggagcatttctgatgtttttactgctttcctgagagaggacattgtctctggccggcttgtcagtccctgaagcagctccaatggctgctcacaaagggagaatcagcccctcttgtccttctgtcggggactgctgaagtcccctcaaaatagcccaggatgacaaagccaggccctgctacctaccctcttcccctaacactgagaccaaatcattcttaggggtacataacttgtttggaggtgagcgggagaaatatcttggctaggaagccatctggaaaacctgccacgacccatactaaaaactgtgctcttctctgaactttcatatgaccctcagccatgaataagaataaaagaaggcaagcatattttgcccttttatttccacagagcacaatagaaggaacattgtccttagcaaaggcaaaggataagatgttcctttggccaaggctggctgccttcagtttctctgattgacaaaataaacagcttctaatttgtgttctaaaagggctggttctgaagaggatttgagaagaaaaatgttaatatcagtgctaaaaaaaaaatcaagacaggaattccaccttatgtctggtggagaccggatttgttttcaggctataggacaaaactagtctcgggaggaatttgtttctgacttcactaccgcctgtttgcttggtccttggtaattcatgaagtttcttagctctcctccttctaaggagctctgagaaaatgatacttggatcatagaggttcattgtctggaagacttttgatcaaagccctgagtgctggggtgggggcagattacggattctgattataacaaaaataatccaagtcctgtcttggcagaagcctgaattttatgtccaccttgtggcattccaggagcattaagaatgttccattggcctttccaatctctccatccgctcccaagggcttgaaaatttttaagtatataattcttttgactcagggctttggcatcagttaaaatgccaacctcttgggaggatcagcctcttaaatctcccatcgtgaaagcaggttctgatagagggacaaagagagaggaggaacatgaaatcattctaggtacaaacatgagcctcagaacaggagtctgcaagcaggaaccaggcaaggccaaagtgccaagaagctctgttggcagaaagggaagattctattcttgctaaaatggggtacaggcaacttattggggcagagactacggatttggggaataagacccacttaatgtaactggggtacaagaaggaggaataatctcatgtactaacacaggataagagataggggaactccctgcaaaggtaccctcaggctgaattacctgagtcactgaacaagggctccaaaaatgttatgaggcctcagtagatggaacaaacagatctaacaatctgctgccccctcaatcctggcatttcttcagcccagagagagtaggtcaaaggaggggaccacactaagatttagacttttgagacccccttcccaccctttgcttcctctgatacccgcattgaactcattcccaaggagattcatggtagatacagtgattcacttcatttaccaagagctataaggtatgaagaggagttgcccacctacagccacaggtcaagaatgcagcatccccaaagctctatgtgggctccttcctaaggcctagtggacacagtttggattaaaaccacttgggtgcaaattctggctctgctacttactagttgtgtggccttgggcaagtggtataacctatctaaacctcatctgtaaaatgggcacagtaataggagctatcatataatgttgtgaagactgaatgtgatgatgcatgtacagcccagtacagtgtccagtacaaaggaaatgcttaataaaaatcagcaatgattaacactcctggctctctgcttatgcttcattgcctgaggataggttatagcagcagatcatcccactcagtgcaagtctcacaactgcaggggtcaggggctcaccatctcctccagttaatgtcaccctctcaccttttcttctcagtcccactagagagcattcctaagcctttcctctcgctagttctgatctgctccatcccctgctaactaaataggtggattcactgctaaagattcgtgaaatcacttccttggctttccccagccacagactgagctttgctacccacctcctagaggcgaaatggaatcacttctgggagatcagggtccagaaggatccaactcctgaagcactaacaaagcaaaagaagccctacagaaaactttgggtctctggttcctgtacagctcactgcagctatggcatcactctgaagccacagtcactcccactgtgactctcagctcctcaggctgctggcccatagctgctctcctcctccaacagccccactctctacctccctcaggggactcccttgtctgggccccagggtactaaggcttccagaggctttccatagctttctctctctgtccctccccatcctctcctggggatacagagtccactctttcaaggtatgtggtgacaaggagctcagctttctgtgcaggcatgccctcagcatgttctctgcattccagtcccccttgcttctctgctcagcaagaaagaggagtgggaagcatccctagttaggcttatggtacttctagaatcagaagacaagcctatatcctgtcaaagtagactctgatgattctcaaagtaattcagcctgagagtttactaaaatgcatattccagcagttatctctataaagatacagagtgggtttgtgcttcagccctagaatctgcatgtttaaagagctctccttaagccacaccttaagaaacagtgcattctatcttggtgaatgggggtaaggggtggggaggaaagtcacacagctgggtcgcataatgaatcccagcctacatcctgactctccaggagcacatggaaatgccttcgaagtcctgacccagtcttgtccaagcagcagctctaaagatacttcacaaagaccctgagtagtttcacttatctaaactccagacctaaatcagcgatgctagcagtctgaggtgcaaaacgcacagcgattcttcatttagaaccattttgagctagttggggctatagaagaccttactggttaatagcacagtggagccacaccggcaggctttgcctcttataggctgtgtgaccttgaacaacttactcattctttctgtgatttgctctttgcctgtgaaatggagacagtaataatacctcatagtgctgttcatgtggaattatgaattacttcatgtaacctgtgtagaaccatgcctcccctcagcaaaatatctgctactcttgttactataaatattacacatatatataaacagggtttataatatttgtgaggaataaatgagatgatgagtgtaaaatgttcagaactattattggtgtggttccagggatttaacagagaaatcagtagaagtcctcaaggtgtcagagaccaaggccattctagataaatatttctggtaaagagattggtcaaaggtcatttggagactcagaaagaaagtggcagttagggttctcttacatccagaatgtaactaaaactctcatgcctaacttgttgctatagatttggggattatgggattttgttctgggacctgctaggtctaattaaagtgttaggactcctaggagaccagctgtggtttgcacagacaggagcttgaaaaatgctgtcatgaatgtgctcccagctctgcagcagtggagacgcagtcagtggcactgagtgctccaggggtcactgtagagttgtggtctttgtccttgctgccccaaacccacagctgttaatttattaggttttgttagaagatactcccacactaaagaactccagagctgaagtgactgtcctgtccttgcttcatggcccctgtgcaggcatgagttctgtgcacagagctcctccctccctccttccctccttcctccctttccttcctccctcactccctccttcttccccctccctccctccttcctcctcccccctccctccttccttcccttctttcctcccccctccctccttccctcccttctttcctccctttctccctctgtccctcccttccttctgtcactggcctgagtgcagccctggaacaaggaccatgatcatgaggggaaagggatgatgtttctgggaaggtccaaagaagagtgtcttctcactccgggctggtgtcccccaccacctccctcattaaatactggtattcacctggctctgtccctagcccttgccctggatgagtaaaatgggagaggagaaaccccatccagtcccctgaggtcaactaatatcccttgactgtggtggctttccagcccccatgtctcagctgggctcaaagccaagattcccagtttcttgctggacatgtccgctatccagcactccaaacccagcaagtccaaacagaccttgtcatctgtctcccctcactctccctctctactaacagtcttgtgttccctgcctcagttgacagtatcaccacggacccaagctggaacctcagggtccttgtcaccttttccctctccttgaccccatgacagccagccctgaggtttctacctgttgacatgtgccttgagtcatcccctcctctcggctctcactgccacggtcgtggttcagagcctgttccacttcttgcccagaccctggagatggtctcccaattggtccgcatgcagctggcctctcttccctccaatctttcaacaccctggtaaggactgtcttcctagtctgtcccgaatctgccttaataaaaagctccagtggctccctcttgctcacagaacaaaaccttcagcttggccaatagggctctgaatagctgaccccaaatactcgtccactcccctcctgctgctgccagtggtgcacccagctacaattgtcctgccctttgaaacatgcactaggccctgtcacacaaatactgctcactttgcctggaatgtcttcccctgcctccactgttcctcctgacataacctgccatccctcaagatgctgctcaagcctccttcattcgtggagacttcctcaacttccccagatacgttcctctaccacagcacctattggaccatgagggcttatgtgtgcctcggtccctcccactagatagggaagaccccaaagtttgcctagaaccatattgaattcctctttatattctcagtacccacaagcttggataaaataagatactggtttcctcatttgtaaactggaaataaaaataatagttgctaagtcctgtagttagaagaaataaatgagataatttatataatatgccgataatgacaatgaagatgatcatgataagaagaaaggctagttaacactcattcagggctttctaaaagtgtcactgtcctaagctcttttcatgattgagagtgagccaaatagatgagtcaatccctggaaagtgattgtgtatgtgtttgtgtatgtgtttgggtgtatatattcatgtacatgtatgataagcataatacaaatgacctatgtataacatataaacttcacaatgtgcctggtgtttattaggagctccagtttttcccttccttcccccatctccctgcccttcctcattacccttcctagtcatcctcccatcctctcctaccccaggcctgcgataagacagatgaattcagaaggggttcctgtgtcattgtcactgacaacagactgcttagtggaagagagagaagtgcttggaattgcctttggacttggtatctaagagttgtttccccattcaagttatcacttctttgaggatacgggctatgcactacccctgttttgtctcccataagcaccagcacagtggtgggcacatagcaggtactcaatcaactatgtgacgtcaggctcggcttgagggtcctggttttcagcactctcagcgttttcagcaatcactgaggcaggtcttggagccacagctgacaggttctcacgagctcacagacagcagcagctggagccacccgggagcagccctcttggcagtgctctgctggggatgggccaccaggccaggaggtcgaggacttgcttcctggacacaagtctgccactgactgtctgggttagcctgtgcaaatctctccacctccctgaaccacagggtcctcacctataaaatgcttctcctagaagcgtctgaggatgcatgacatggcagctgtgaaagctctttgccaaaaggctgtgcagaagtgaggtgttgctaatttcaagtgctgggacttcactcacttggaaacattcaggaagcaggggtggggaaagagagagcagggacttgcatatccaggacatatgggggcctatatttgttgtcctcctgcttaatagcattagtgattcaagctggtgctgcctgtggaacactctgtctttcgggatcctcagggacaggaggggtttcagagcagcgaggctgcagccagcacacaatacagtgaaaaatagagtgatagcaatgaggtgccacgctcacaggttcatacacatgcatgtacactcctgacggcccccaacgctgcctcacaacagcagctggggctaattacagccagacagcgccttctccagctcttctctcgaagctatcaaccctccccaccactaccactaccactcacccttggggattgcctgatctctcagaaggggtgctgctgatgccacagctaaatgcctagaaagaacccggcagggggtgtagtggtacaagggagtaggaagccgccatgtggctccccgtcttgcaagtgtgggtagagaggaggagatgaaatggaagagagctggctgagatacagatgcagctttgtgttaacagatgtgctctcctggcaagagcgagcctaggcacttagcccctcccttctccttcatctggatccacccagggatcccctcttaactcttctccctcttaaatccccagcttcctcttcaactcagcatctgccataaagctcaagaaatgttgaataaatgaatgggtgaataaacacataaaccctccccaaacccttagtactcccaaaccctgttcccacctcacaggctgtaatgactccatgagccctttcctctgcttttctttctatatactccctttggacagtgtcaactctcacctaatatgcttctaactcccaaatctctcctggtagcccagaccttgccagctgcctgaatgtttcccctgctcctcaaacctaatgtgccccacactagagtcttcagcaatgacttccccaggggttttctagcagtgagtcctggtctgtcaagggcgtatgagaaagaagggcctgctgtatgcgccccagcaggacaggggcaatgaacacattggcaaagtcatcagggcaaccttctgatcccagggtctgtcttcacaccaggataccaaggtttttcccatcaaccttttaactgtcagccctccctcccacccataaggaaagccaaattaagaatgaactgccaaattggagctaactgcctaatgtgggcttctaattggaaccaggcaaattgtttatataaagaaaaacccttgaaaaggagcccatgtgaactggtgagttatttcttcttcaacatgagctctctctcccaatcccactctcattgcttcagaatcctggtattcctcccaccttcatccctcagccagcacacacacacacacacacacacacacacacagccttcccctcattttccttctcatgaaccttcacttcatgttggagccctgtccccatgatcactgcaaacccccaggtaaatattgaaccaagattggtgaaaactggagatattattccaccaaagcagtgttagagggaaggcccccagaatgtttactgagagttcacaaattatttcctgatcttggcaaagatagaaaataaagcccccctttcctccaggtcttcctagatttggagagcagccaaaggaatggattacaaacacagtggcccttggttcctgacagcctcagggcctatgaaggcaaaatccaagtttcttcattccttttctcagggagtcctgagtatcatacacaagtacaaatgcaaggtgtcattataaccagccatgttatgaccacatctagggatttttagtttttaacacaaggtgaaagatgtctcaccaatttcagtttgacatacaagatgcaaagtaatttattcaaagcactcctgtgtttaatttcaaaacagtcatttattcactcagcaaatctatgttgagcatttcaaagagctgtaattcatggttcgtgctttcaaactcctccttctctagttaggaaatgaaaaccctatatacaagggttaactgacaacacaagaccatgccagcttccttttcatgcctggtgtggactatatggctctcatagttttggcagtactgaaaatttccactctattgcttctgtcactactgttgacctcttctccaatacaaggtggtaagtagatgtgtctctagggtgcctgggttcatatctgtgttccgccattcactagctatgtgaccttggccaagttattcagcctgtctgagtctggtgcctcctctgtaatgtgaagataataatagtaacctacctcacagcatcatagtgagaattaaatgagttaatacacacaaagcacttagaatgatacctgacacataatcattgctcaataaatgttagtaattattattttcctgatgtgcctactgttctttgttaataccagaggtcacaattcttattgggcttccaaaagaagcggtaaagtaccacattcattcatccactcaatcagcaaatatatgttgagcatctacaagtccctgagttaagccctgggatcatatagccaaagaagacatggcccttgcctttgggactaaacaattcactggaagaactcctggattaatagtgccctgatgcacttggaagaaccaaacacaaatcctccctggaagaacatgcccaccacccagttttcataggattaccaaggataaagtcaggttgaacatgaactcataatccaaaattacaaagaacacgatgaagccagaaacaatgaaaacagaatcaggtcttcaaagacctcaggtattgcaattaggtgatataaaatataaaataagttttacatgtattaaaaaacaaaagattttgaaaacattgccaaagaacaagatactaacaaaaaattactttttctagccaggcatggtggctcaacgcctgtaatcccagcactttgggaggccgagacaggtggaacacttgaggtcaggagttcaagaccagcctggccaacatggtgaaaccccatctctactaaaaatacaaaattagcagggcatggtggcatgggcccgtaatcccagctacttgggaggctgaggcaggagaatcacttgaacccaggaggcggaggttgcagtgagccgagattgcatgccactgtactccagcctgggcaagagagcaagcctctgtaaaaacaaaaaaaccaaaaaaacaaaacaaaaaaaaaaaaaaacactttttctctaagtatcatcgttttatagatggcaaagagaagtgaggtgactccttcaatgttgcatagctaataatgagggatttaaatcaggtttgcagtgtctactgttttttggcaaactcagtgactggagttgtattatttcttccctgagtcattcaacaagtgagatgattacaaagtactatgctaagtctataaaaaaaaaagatgaacaaaatagagtccttgccctcaagaagcttaaaattcagtagacaggcaagactacacacatataaaaataattattaatatcaggctgtgtggtagaaactactgtggtctggaacagtaggagatgagaattgagcaattcttgaagaacagggtggatctacagggaagacaagctttgaattggctagtggggtagaagagatggaacagcctgacaaaagccgtggagaaagtgaacctacagagcagttgaaggaggagcaagtgcatttggccagtgcgctggatacacgtaggggcagacctgtgccgtcgcatcggaccctgaagtcagaagagccctatgcttggtttaatgctctcctttgctgctatcttgaaatccttgattatattttaacacggggttccacattttcgttttgcaccaggaccctcagatgatgtggctggtattccataggggaatggggggaggtatggttgggaaggcagaccactcttgggaaggaaggatctggaattccactttgatatttgccctgcagacaatgaggaatgactgaaagtgtttgagcaggggagggatagggtgactgtggttttagaaagccacatcttggagagggggggagtgttcagatggcatcagagaaaggagagatgggaaatagtcagaaggctattgcaataaagcaacgggggcctggacagaaatagtggctgatgatatggagaagaggaaaaggtcatcattgattcagttattcgttctgcagatggttatggctactgagcacctataatgtgtgagtctttgtgctaggagctgggatacaggaatgtacaaggctctgtccctaacctcaagttacttacagttcagtgagggaggcagataagtaaacagactatggcagcctgatagccctgtgtgctaagggctaggatcagattacatttagattgttgcgggagcctagagaaagggtccagacagagaattctgagattcccaagaagtgatatctgagctgcatcctgaaggccacagacaaggcacagaaagtcactccaaaaagagggaacaggatgtacagaatcatggaacatctactgtgtgccaggtggggatcctagctctcagactggtagagaaagtagacaactaaccagagaagaacaagagaatgtatccagtgctatgttgtggacgctgtgggagtacagaggaggggcatctaacccagactggacaggcggggaaaactgttccttagaggtgtcttctgagctatgtgttgtagatgagatggtgttagctgggtgaagggagggaggaagggatgggcacagcagtgggaatgatgtgtgcaaatgcacagaggtaagagaccatgtgtggctctaagagaattgcaaatgactccctgtgattgaattctagaatgaacaagcaagagcatagtgttgggggtggttatgaccaaagagatagaccttaaatgccaagctaaggagtttggacttcatcctatagagcagtagttctcagccttgactgtatattagaagcacctggggaactttaaaaacaatacttatgactggatcccacccctagaaactgatttaattactctgcaggagaggcattagaacttttaaaagctccctccatttatttgaatgtgcagccaggattgagaaccatggctctagggtgccagttctcaaatttgagtgctcatcagaatcacctgtagggctgttaaacacagagtcaggtgagcactctcagagtttctgattcagtaggtactctaatgagtacgtactctaactttaagaagttgccagagatgctggtgttgctggccccaggacccacattttgagagcctcaagtctcaggtgttgtgaggctatttacaagtgttaagtggaggggatggaggtgtgaaatgatttgatttgcatgtttgaaagatcactcaggccactttggggagaatggtcacagaggactaaggagagaaggtgagaaaaccagaaggtattgtaggaatcaaggcaagagatgtctggaggtgggaggagtcctgaactaaagccctggcagtaggaatggagaaaagaggtgacatgcaaggaatgcttaggaaatatacttggcagggcttagtgactggctgaatgtagaggtgagaaataaagatgagtgaactacaactcttgggtttttgccctgggcaaccagtgactccagttttactaggcatggtagttactgtaacaaaaagttaaatgtgttaccaggcttagggtaggacatgggagaggggggcatttctgccctcaaatctcatagcaatagtcccagggaattcaacaggcatctctcattgtccactcaatccctattttcagcaccatgagtcctcaccttgaccctaatcaacttgggattctcctcaaagtacttagaaaggaaaaggaagacggtgactaccctgacatgatggccacccacccgagctccaggtatgaagcctgctcctctggaattactctaggtatgtttactttattctttcatcattttaacaaatatgtatagggctgctgcccacaggaacttaaaaatattcagacgccatgtctcacgcataggtaaggaattcatatctcttcttacataaccaacaaagcaaatgcagcttaagtacagcctgaaaaataattcattctacatagatttaaaatgtctaaaaatgagcagttttccagtgcgtcactggtcatgactatttgtaagtctcctccgtgggcaagcagactaccagcaatcaacaagaccagcaggaatgatggatgggataattgtccattagggtacagataacttttgtatcgtgggagggttcgacaagatagagacatgatagatggaagaagagttagctaatataataggagttgcagctccattctggtagtaactattctctggctgaatcgatgattaatcaaagacacattctcatttgaaacactttgctcaccggtgcaaaacccccgctttaggttaaatttaatagcatcattaaaaactgctgttcaagacattcaaattacttctctccagaagaaatcaagccacaatagagaatgcttttgtgaacccctggagagcaagggccatgcaggatgtgtgtgtgtgtgtgtgtgcgtttgtgtgtgtgtgtgtgtgcgcgcacgcacgcactaaacttataaatcctcaatgcctagcacaggagctgacacagagcactcaataaatgtttgttaaagtgaaatgaaatgaatacatttgtctattcattcatctgtttattccttcgacagacattcattaaatataggaattaaagagctcaggccctggaactagatgcttcaggcttcaaattccagctccaaccagctatatgatcttgagcaaatgacttagcctctctcagcctgatgcctgctctgtaacgtgggggaaataatagtacttgctcctgtagggctgtgtgaggattaaatgaattagtgagtgtttagcacaggccctggcccatagtaagtactcactatagggcaactattattgttgttgtatatgttaggctaggcctttctcaagtaactaggtcattagaagaagcacagaacctcttaagaaatgataaggcttttggccaaagctggttttcattaaagtggttatttatggttcccagcccagagccccactgccctaggcctgccattcctggcctggtgccctcctgtggcaacacaggctgtctctaggtgggttgtgctctctagagaagcctgagaaattgcggagtgggaaggtgaaggaagaaggtaagagctggccaggatccaattacccatcaacatgcaacccctgccacacccccatcattaactcccttggttgcctttctatgcttttgtatagctcttcctggcaacatttctacctactaattgctatttctaatgtttatcctcttggctcagttgaacaagattaaccttgattttaattttaattttcaggcgacatagtagagaatacttgacttgggagcaggaggcaagggaagcgatacaactcagtgattataagaggattctgacatagaaacaactggtcactgaagagctgtgtgacctagacattacctaatgtctctgagtctcagctgtagaaaagggaaagcgagaatactgttgtcaagactaaatgaaaaccacctagcatactgcctggttaacagtaaagcactcaataaatggtgactatgactattattttgaggtccttgatctggaaacagaagcccagagagattaacgggacaacactcatgttgttatttggtggcagagccttcttgatccttgttctcaccactaacccaggcctgcctctttcaaacattttacagaaccccatttacacatactctgatatactacttataattacatgcttggttttttgcctgaggtagatttaataaattcaagtgtattcgtcccatagctgtctgcctggaaggtcttatgaacaactccagggcaggagccataggttgcttatctaatatgtgctcaataaatgattggtgagtgaatgttaagcttgaagtcaattacctacctgagttatggatgtcccatacctcctgtgttacattacaagcagtgcagaaaagtagaatgggtgcaagggactcatgcaggcctgggtttgaactctacaactggtagctgggttcaaagcacctaggagtgctggaaaaatgcagttctggataaatagaggaggagaaacagtagcagtagtagtaatagtagtagcagcagcaacagcagcagtagtatcagcaaaaagtggagtaagaaaacttttctaaggatgaattttgtcctcaagagctgtgacgggcccacaatgtgctatgtggaggaagtgtagtgtaactgagtcagataaacctgggtttgaatcctagctctcaacttattaactgagtgtgaccttgcattatgtttcctgagcctcagtctcttcattgtaaaattaagataatgatagtacctacctcatagctttgtggtgaggatgaaataagatatggtatataaagcatatcatagcacaacacctcactcataataatgtctcaaaaaaagctatttgatgaattaatgaatgtgcatctttagcaaaatgccatgaaaaaactacagacatcctttagcatctgcctgagaggagaaggaggaagagacaattccaaataagaactgtctcaataattaaccacctgtttcttaccatgcaacacctaacgtcggaagaactggaaaaaattgtgtgatcagaacaaaccattcccagtgaatgcatagagagaagctgctatttcacatcatagctacacagttgctggacctgagagagtccctcagagtgtgaataagtgtttgaaaagacaagtacagggcctgacacatatggaatagttgatcaccttagttcctttcctacccttctcccaaatgggtagaaacaaacaaaccactaaccaacaaagcagcaacagaaaaactgagttaaagtggttgagaactgatcatggcagtgaccttactgaatggacccttcactcttggctctagtgtgacctgccagcctggagagcctctcaggctgagcaattaaccctagcagagaagtcatgatgccaccacatcttctcgttctccttctccttcttcttctctccttctccttctccttcttctccttctccttcctctttctttttctttttctttttttttttttgagaccgagtttcactcttgttgcccaggttggagtgcaatggcacaatcttggctcactgcaacctcaacctcccaggttcaagcaattctcctgtctcagactcccgagtagctgggattacaggcatgttccaccacccccggctaatttttgtatttttagtagggacagggtttcgccatgttggccaggctggtctccaacacctgacctcaggtgatccgcctgcctcggccacccaaagtgctgggattacaggcatgagacaccgcgcccggcctcctctgtcttctttatgagcgtgaagggtacaggacatgacggggtgggatcaactcacggcctaggctacaaaaactcttttctcctctttctgttctttgcccctcagcccccagttcttgtttggacatgcactgagaatagcatttaggattcctgcattctctatctcttttttaatgtttggattggctgttcgccaaggcaacagaatagcattttcaaggagcaggtgagtttggggaagatctcttttcttttccaatatattaactccatgtgaattaaagccatcagagaccctcttggaaagagcatataagttctcccagggcttccaaatgaaagtccctacaagagacccaacaaggttgtcatttttaagggaaaaatacccaggcatggtagctgctgcgaggaaatttgagaagtgacctgcaagttacatttgcgatgtgaaaaccactttgtgttctttgtaagcaactgtttgatgtgtggcattgcagtcatgggtgtgaaacatctggttttaaccagaatgtgggtgatttgccacaactggggagaacaggtaaatatggctttgcctcctggtctcgtatctggcccagacatgcaaattccagtctgcaaacttattcttctctgccaggattcaataggttaatgtcagcaattggcagaggtctgcctgtggttacactgagtggcacatggcaacaggtaaggacaacaaaaggctgccagaaaagggagcccagcttgtctgagggccaggtaatctgacttgccagtcaggggagggaacagttcctggttctgggccaatactggaggtacagagaacagaaccagaagaaacctggacagggaaaaagagacaacagctaccatttgttgagcacttactctgtgccaggcactatgccaagtctgggtgtgttctctgatttgatcccagccagagccccattttccagaaagggaatctgcagccataaggcaaaaatagatcaaaactgggaacttagaataaaacaaataccaaagcactcagaaggcaaagcagttagagctagttgccaagaaaacttcaggaacctgtgttccttatagccatggccattgggatttggccatttgcatctaagccactccatcccttcagttgactcccttattgggtcagcttttcctgtcacacctcaaggtggttggcaaaggcagagctggtttggcaaggaccgggaccagaagagggatgaacaggtgtctgcaacagattcctttgaagaatactttaatggccttatgccataaaactcaggctagcatgccagtggaagaagaggatcgatgagttgaaatagacaaattggcacatgaatttgagctttgtttacacttctataatcaatgttactcattgccttgtgtggaaataagatgttctaccatcagtaatacctgtcgataaatgcaaatatgctcgaatttcattagcagagacccctgcttaagcatactgacaattgcaatgaaagcacaagtcctactgaaactagcacacaatacaagtcgcaacacaactctgacccgtgacttatctacatagtcttccctcacagacattaggtctcatttgttcttgagccaaaattgtccttggctctgatcagcagttagtgaacaaatgacactgtatggcagcatcctgccactagggtgtacaactcccacaagtatgaaaagcaagcatctctcaccttcagactgctgtgcctacaagcagcaaagtccaagtgcatgaaaagagttaaatcctgcttggtcccttgaagggctagaaagcattttaaaggtgacatacatcagagtgatccattttcacgggctgggctgtgcaaaaaagtcagaggggctggatgagaaccttaaacaatgacaacacagttgcattcccagctgtgttaaatgaccagcatatcatgattgccttttcacgcaaatatcaatgacataatcctaacaggcttgcagctctctcgctggtgtaataaaacaatgacccaattattttcaagggctgaggcagtagatgcaatgactgggtatgttgtgcagggcgctgtgtgtgatggacggggcacagtagggcagcaaactgtgtgctgaggatcggaaacctgcctcccgagccaaaactcctgccattcatctggtcagaataaaaataaagccattcagtatgaaagttcccacttgttctcacgacggaggccagttgggaaaatgtggtgcagcactgactgaagcaaattctgtttaaaaaaccagccggtttgtgggtatttgtttatttataactgccccaccaccacctccccacaccctgcctcattctgcaaaggatttgagatgggattggaacactgaaagtttgtttaagtcctaaacaggtccagctactttttagaccgatgacaaaatgaaaccttctggatcaagccccttgctctgtggaacactgctttggtttacccagccagagctagtccttcttgtaccctgtggtgagaggcacctcttgcaccagaatacccttgtgcccagtgctatgcttgaccagggaaatacacatgagcccataagcctgaagcctgaaaatattaaggaatatggattcacttactccctcactcatttgctcattcaacgaatattccttggttagctattccagaacaagctctcttccaggcacaggggaagcaaaaatgaataagatccagtctctgcacttgagaagctcctcgtctagtaggaaggacagacaagtaaacaaacccctgttctgcaatgtggccagtgctgtagtagaatcgtgcctgggggtggcgtgggaggtgtagggtaacatgaggtgggggctgcaggtggcatagatgatttagtttgtggacttggactcagactgccttgagttcaacttttggttctgtctcttgctagctgtgtgaccttgggcacttttcttaacatcccagagcctcaattccttcatctgttaaatggagctaataatagagttgacgtcattgggttatgatgaggattaaatgagataatctgtgtagaacacttagaacagttcctggcacatagtaaatacccaataaaaacttagctttttatgctttttatttcttttgtttaatttcataagactgtgtctggcgatgagactccaaggactggtttctaaaacagaactgttttcaacaaactcttcccttttagcctgattttttttcctatggaatgacacagttctgccataatttttccctcagcaaccatatgtctggcaagaacctcaggaagaaaatattttccagatggttttgcttatgtcagcctactatgtgccaagcaccactctagaggagagggacacattgctgagtgacacagacaaggtccctgtcctcttggagcttacattccagtgggagagacataccataaatagacaaatataaatagacataattacccagagcagtaaatggggttaaggaagcattgctaataaaagaaatgtaagagaggaacaggaggcatctaactgtgggtggtcagagaaggctcttctcaggaggtaacgttaagctgagactgaaaggttaggaaggagccttccatgccaaaagcaagaggaagggcagtccaggcaggagcacgaacaaaggccctggggcgagaaaagaccgagaatgttgcagaaattgaaagaccagtgtggctgagacacagagccctaggagggaggtaaagccggcaggattagtacatgcattttgaagctgaggaaatggaaagcccagagagatgaatggacttacccacaatgccttgcacaaggtaggcgctccatatgttgtagaattcacagtcagtagggcggggctgaggccctttgccttccaaatcggactgagatttcccaccacaactaggaatcagctacccagggagactgaaacatacagtcgtttttgttggtgagtcataggcaatgcacattagagtgtggggtcgagtggccccagctgctgcctgtgtgtgtaaagggcgggggtgggctcaggccgcggctgaagctttttagcatgtttatgatgagctgaaagaactcactgcttaatttaaaatacggctcacacatacacatacaattcagcagctggaggagctgccaggaaatgagaataagtgtagaaaattggaggatcaggaatatcaggtattcggctccgtttcccagctcccatgcgctgtctctgatcccataaggtcccatcttccctaacaaactctgggaggtcaagacatggttggagaccgtggcagtttggggaagggaggcctggccagagcccttaatgctagctacactgattgccccacccggccttaagcttgccggccttcctctcgttcatgttccttgaaatctgacggctggaaaaactcatttggccctgatcactaactgcctatgctagctgctgcttttcctgattgtgtgtatcttgcctcctcaaccacacgggggccatcggcacacacttgaggaattgagttgttttcttttgtattcaccgcagctctcagcacagtagaatttacacagtgagagactcgagtgtgtttgctcatgggttgcaagatagtatcatttgaaaagcctttggggcagagtacctgctcttaattaaaaaaataagaacctcaacttgacaaaaatgtgttagaccatcaggcgtatctctggtttccttcacattgttcctctacacccagagtccccggcctgcatgccggatgaacctacagcctctcaatcaaaatgctccacaagtcatctctttgggttctttgctcagaatatcccttctgactgggatgccctctctcccaactctaccaatcataaccccatctcacccttcaaggccaaatgtaaatgccatctctggcatgaagcttttgcaggcacaattcattgctcttgcccctgaacatggcaccctgtgtctacctcttttatggtacaggctggtggactggaatgacctggtttcaaattccaactccatcacttcccaaggctacctccgttttctcttctagaaaaagggataacaacatcagcctcaatgggatgttggaagttgccagtaaaataatatctgcagcctgcatagcacaagacttggcctccagagctcagtaagtgttttttgtcatcatcatcatcttcatcacctctggggagcagaagaatgtaatagttccagaactggtttggtccattcttaaaaatgtgaccttgggccagtctcttccactctgaggctctgtttcctcatgtgtataaaatgaagtgataatagtttacccacctccatcacaaaacctgctgggaagatgcaaagacataataatgtaggcaaggtaaactgctaagcacagggcttatcgcataaaaaaaaaatgctcatttgcgtctgcacacccctacaacctagaaaactcctttaagggcacagacaatattttacttatctttgcatctcttgctgcctagcctagcccagaacctctgcagctggcagacccacaataaatcattgttgaattgaattgaaaacccaaaccagatgtgcctcctcccctgtcaaatgaagctttcaagctggcaggttgggcctgctgcctcttcactccccctccctccaagctgagcagccgccattgtctaggcctggctctggggaatgaggcagtgcctgccgagaggagggattcagagtgggtaaggatagatggcactaggtgggatgagtgcggtagggaagagcactctgtctgttcctgatgaccccaaacagactgcctttgaagggggctatcctgaagtctctgtcgaatgaaaagtagtgacagtccaaaagcccttcgccacccagcgcctagctgtggaggaaacccagctctcccccaaaaaccgaaaattggaagtaaatgaagatatcgggagaaagcttcctcttcctttagcaaagatagtgatacagacattcagagaggttcagctctgaaatcataaggccaggatttgaagctgagttcactggcaccatgggcatgctctaaccactgggccaccttgcctctaagctagtcttgctatagaaggacaggagtatgttttcacccttcccaccaaccccacaggacgcttagaagcagagcgtatggctttaatggtggaaaatactttaaaaagtacaaatctgttacaaaactacaaaaagaggcccatgtcttcagtgtttctgagccagagctatgcagacagggcacagggggtagcatgctaaccagcacagagtcaaggtaatgggccacacacctgaacatggccacttggattgtaactctagctctgtcacatgctagcctgagtgaccccgggcaagtgattcaacacccctgtgcctccattttcccacctgtcatatgatattaataatagtacctcctcacagggttgtctatgagaagtaaataatctaacatttttaaagcagttaccatgtgcccgggacatggtaaacattaaacaacggttcgttaaatcaaaataaatacatacctctgtccctttgtagccagactagtctagaggcactgttgccaaatggttagtgtgtgcccatggaaccagctgaactcggcttcaaatcctggtctcatgatttcagagctgagcctctatgaaactcagtttgaccatctctaccatgagaacaataacagtcccttacccacaggctgttgagagttttaaatgagatatctccaaagtccagaacacagtgccttgccacggcagagtgagtaagcacccaattaaggcagagtgttaatcatctgagtctgcttcccattttttttttttttttgcctcttctgggttaagttaacccacgatatatagttttggaagtcttgcagcagtaaagggaacaatttcatcattttgccaatgaaattcctaaacattttattcaagagccagaaaaggcaaacatttttggtcatttctaaatcaatgaagcatggacaatcagtttccccactcagcaaacctgactcccaaagctatagaagtcactttgcaggacaaaattgaaggaatgagtattttactgcaaacaaaagccatctttgtttgcggcccagctttgggagaaaagaaatacctcaacccaggagcttggaaaattcttgaaagttatctttttattccagcaaatccaacgtaattggcaagattcctgaccatgcaaacctgagtcagaatgagtcgcctttacccacccatctccccacagcacccagaacccagcagagtacactgggcatcaatacatattggttgtcgattcctccatgggagccccaaattccatttctacaatgtctgctacattgccaaaacaatccaaaagcagcactaaagaacattttgaaaatggggaaaaaagcatccatcactcaccactctaacacaactcttagttttgtgtggaaagttctcttccagtctttatccatgtgcagacatatttttatagcactgtagtcatagggaaaaactgcagcagcttcagccaagaatcagataccatacagctcatgtcactaaactttccaagtgagagctttttcttctctcattcactctattcattcattaattcagtcattcaacaaacatagatttaaccatggctctggtgctacggccctggggagtacagagatgactaaggcacaatcccagttctcaagatgcttccagtttaatgggggaaacagagaagacagcaggaaattataacacactgggataaacatgaatgctgtgaaagcacagaagaggagcatttaaagtgggcaggaaagggtgtggaggatggggaggcagagaatatatatatatatgctttcttctttcttcagaagaaagcaaggtgtcatcaggtggccaaaaatagtactgtgtgactgcatgggcaagtggtagtggatgcagtgagaaaggaaggacagggccaaatcattaagatcaaaggtttctgtttcattctgaagactgaggggaagctctggaaggactttaagcagagtagtagcactgtcagatgtgcattttagaaagattgtcccagcaacagaatggaaggtagattgtagggcatgagataggtaacaggggacccatttatcagcttgtcacaataattcatcaagataaggaaggtctaaacgaatgagatggcttctccacatacaaattgtgtcacgttagtgagtgacttaacctgtctgtgcctcagcttcctcctctgtaaagcaaaaataacaagagtattgcccttgcagggctgctggcaggattaaatgaaacactgcatgcaaagcacctggcacagtggctggtacctagaagacactcgatacatatcacttcccctttcccctcatcctttttcctccacttcaccctttcttaaaggctggcatggtatggagcatggaagtggccaaagcagactctaacccagacagtctgactccagagggcagtggagaaagtttgcaagtgctattgtcaggacagttacttagaaggattgtttagctgagttgagggccccgctgaggttggaaactatgactttctggtgggactaaccaacaaagtgatgggattttctccagcaatgttcctccatctgggcataagcacagaggaggaaactgtcagttaaatttatccagacttaggattttgcctcatggatgcagcagaaagacacagggcaagggaattggggatatacgcaagattctgaaagcaaacagacctgacttcaaatctcatctctgctgtgggactttgggtaagtcactcaacctctctgagcctcagtcacctcattaaaaggaaaaccacaatagtatcttcctcataaagttattgtgaggataacatgagattactgaaatgatgtcataagatgggtagtatatgcctggcacatacatattagttgttattcttatcatcatcatcatcatgttccaggatggagagggaaggtagtaaggtgaaaggggctgatgggatggaagaaatggatggagggggctcaaaaaactggagagcctcctgaggtaaaaagaagagcgttgaggccagccagcaaggtgtagatggtagggggttctgactgatgatgaagcatggtaaggctaggatgagagtgtgtcctgtacatggatcacggatgtccaactcacccagaatgatgtcaggacttggggtggagaagaagacaatgagccagatgtcgaactcttcgttgaatgtgggggtgggggggggttgaccaggaggggatggttataaagaagcgtcaacgaggagagaagtagccagatggcatgagaaggaggagttcttggctgaggacggaggactaacagcctggaagcaaacaggggaagctagagcacagaccccacctcccagccctagggtgcctgtagtgtgggagtgtggacagtgtccactagagggcgctggtggcaaagccgtgagatccgccgtggagactcaggtttcagcacttccaggcccggaggtagacaatagtgctctgtaaaatttatccagggtgtagggggaattgtttactgcaaggtgggggcttccagagggtactgagaagagtgagagagggcggtagtggggaggtggatgagtcggggtggcagggatgggagcactgagcagtatgaggatggtatgggagaggacagatgacgagcagggaggcttaacgtttgggctgtggccaagaactgggggatgtgaagcctggtgggattaactgtcctcggaattccaaacggagcttttttttccctttacatcttttgtttattataaaagtagcacatgctagtttcaaacaactctaattattgctcaagggaaaatctacctctcctattctactccccagtgttgacagtctgtctatccttccagtcttttcctgtatgtgtaacatataatacccttaacaaaaatcagatcctactatacttactcttctgcaacttgcttttatcacaatactatattggagatatcattgcacatcagtatttaaagatctagcttgtctttatttgtggctacatcgtcattgtcatcattatactagtagttggaatagtaatgtgtagcaattattaaatgctctgtgccaggtcctatctgaatatttcatatgaattatctcatttactcttcacaacttcatgaattgttacttttcccattttacagatgagaaacggcacagagaggttagaaacttggtcgaagtcacacagctcataaaagctagaggaggaagtcaaacctaggcagtctaaccaaggctcaaactcttaatcattagcatagtaatgcttagtatgtcattattgggatgtattataaatgatttaaccagtccttcaccgaggtcatttagttttttcaatttgctcctatttacaaataatgtttaaatgaacatccttatacatggagcattttgcaaaggtaaactcctaagacaggaattgctgactcaaataacatttccagttgccctccagatgtgcatcaagagtgaatgagtgtgctgtttcaccagattctcacaaaccctgggttttagtgaccttttaaatttttgccaatttgagaggtaaaagctgacatctgaatcatctcaatattgttttaatttgcatttcttaattattactgattggtgttccttttaatagggcataggccctttgcctttcctctgtgaattgcctgttcattattctttgagcatttttctagtgaattgttcattatcttctcattggtctacagaagctcgtttattccttccttcaacaagtatttattgagtacctactgtatgccaggcaccagtctagcactagaaatataatagtgagtaagcaaaacctgagctttcatgaagctaacatgtaagcagaggaaataatagaaaaacaagtagctaaatcatgtcattgtaaatcatggtaagtgctgtaaagaaaataatgcacttcttacactggagctggtggagtattctgaataataaaccattgtcttccttctatgttgtgactttatcctggtttatatgttgcctttccactttgcatgagatatctttcaccatactcaggttgttaaatttttgcatagtcaaatctatcattctttttcttcatagattctacagtttctcgttgctttgcaaagactccctacctcaatattctcttatgccttcttctaatcttttaatggtttctctttttaacatctaaatctgacctaattggattatattttggaataaggagtgagataaagattcagctttatattttggtggcaggccggttgtcacagtaaatggcaccatgtattaaatggtgcatccttttccccagaaatggtgaggctgaagcccagagaagggacgactcttgcccagggtcatgtagcaaattagtggtgaccaaactcttcccagatcttgaggctactgacttccatgccagtgatacaaaactgaactcatcacagctccattctctggtgcacttgaacagtcttccctgacccacgccaaggttcactgtcggaggccacagtatttttcctttccaataggccccctgacttctcttgctcagagatacaagtgcagtgacccatggcagctctgctgcttataaataggaagacacttgctgatcgctgctgaaatacctcacattaaggcagctttggacacagaagactggaggcagagagcagatagatttgccatttaggaaccaaaataggaagtgcctaattttaaataaagagatttggcattgttttcatccagttgctgatggagcagctgccatcgtggagcttttcaaggaggctgccttgaattgcgccaaaatgataagcttgtggcttggaggctgctgggacttgtcccaaggccccagctacgacatatctaggatccaaaaggttatcttgaaacgacaggtgactacatcaccaccaacgcagcttgacctgacatcccatttcacttaatgtttcccttctccctccatgcttcccaaagctgtggacattttgtctgtggaaagctgctacccccaggagacaagcatctgggagagcatctccacagaaaaagaaaagtaaagtgggagttgaagtcattcaggctacttgagacaacaatttttaaaagctcctattttccctcagttaccaggagattttcggtcaaagtgttcaaagaaaataggtggataattacctccattatttcacttggctttctatggatagacatcgtcaaagatattggcgagttcctcttgtcctactaatcttgatgggtattttgttgattcacttccaaactctgaagtaaatgtactgcttattataacgaaaaacaacctttaagatgccctctgtcctctacctctaggcagagtgagcagcagcttgtacagtgaaatttaaggtccttcttcccacactaataatgtcagatcgtcccaccaccaatacaggggaggaaaaaccctgagttccatttccaactctgccatgacttgctctgtgacccgaggcgagtcatcatccctgtcggtgactcagctggctacccataaaacgagaaagtcagtctgagtggtttccctaactgggttcctcatcaaaatcaccagtgatactgttaataatatgcagataattcaagtcctcatctcggacttactgaatcagactctgaggattaggagccacactgcatctgtatttcaacagcattcctggtaattccattgtacagccaggtttgggatctagtgaaccagatgacctcagggtcccttctgctcctgacaacaggtggttcaatacctccctctgtacttatgtaccatatctctaagtgaggtgctgccccctgcccttcttgctaagtgggagcccattctcttatcaggagccctgaaggctttagccattcctttgtcagatatttagcagttacctttgaggacaggacccagaaggaaggagtacacgtattattgatgggatcaggggagtgaaaaaaaaaaaacagcagcagcaacaacagaaaaatgggggagctggatctgcctgaaggccaagacagcctgagatcctaatgggggcatggagggcattgacagattatacgtacaatactcgagcctcattttccctggtatcctctctgtcttggccagacaaaacaatgcaaagaggtacagctaagctggaaaacagccctctttttaggtagtgaggtctttgggcccctacgattgataccagcaagtgagaatgtaaacacaactctcttcaccactgggaccatctgacgtcagtcccttggctccagcatgtctcaagataagaggactgtaggaagccctgggccttgacattaggacgctctagctttgaggcaaactctgaactatggtttctcttctgataactgggatcctgccttcttttggtgatcaaaagtccccgtctcaaaaaaaaaagtccccatctcctgccagttttatataccccgactatgctgacctacatgcctgactccagctgtgtgcttgcatccacattcattattcattatttataagcacctcagttaattaggccaaacggaagcaaaacacatggtcctggccctcacgaagccatcaggctagcacagtggtgttcaaccttatcagacttaacatcctctcttttataataaatctgcttttgcttcacccctttactatcctgaaattaaatttctaggtactataacctacctacacgcataagttcaaaaagatagctatatgtcctgccacataaagagaaaataaagcaatacataataaaacactatgtatttaactctgtaaatgctcacacaggactacattgaatgattaaatgaagtagtcagaagcttgtgcctttatatagaatccccatgaatgcaacagttatggacacaaactgatatgttatattgattaattccaaaagcaacatcacaattgttgacatgatttcctgaaatggtgaatgagtctgtgtgatcctctgtaaccatgtaatcttccatatctttacagaatagttgattaaaactgtggggtcggggcaggggaagcaaaaccctttatgcttaggtataaaacatttatagtaaaagtttagataattagaaaagcagttttcagctccatggaagtccagcagaacattcaaaaattattcgggatgctagactatttttcattttgcaagtctgtcgtgggcgttggagaacatctagcatccccatttccagtcctctgaataccctcttgcattttccaaaagtcccctagggggcagtattgtctcagttgagagccaccagtctagtcattcagtttctgtggaactgggattttgtctggttcttcccaggctcccaactccttcacccttgcctccaaggactagagtcccatccttgctactagcacctggcaggactcctaagcctcacctgctcctgctcagttcagctaggctgggcaggacttctgctttcaccaaagccaagtgcttctctaaattgatacctgttgttgccactctctttgggtgccccactaaactcagctgcagttgagtttcctgctccatcccaacagggtgcattttgcggcatatgccagctcttccactctgaacttccaatctccagccccctgacactatgatcacccacagacccaggccgttgatagtcagtagaacaggtccaactacagcaaggtttgaacttgtgcctcaccagaaccctgtggccttttgccttcagctagatccccttctgatattgaaacaggaaagaattatcttctgcaaatagaaagaaaatgagagtcagaccttctgttagggccctcttctaccagcctttaaatagttttcttgtcagcctcacacagatagccccaaaccatttgagaagccagcacagctccctgcaaagcactgtagcaaaaggactatgtactctggaatcagatggacctgagttcaagtccagggtctatctcatactgcttaaagacaaagaaattcacttagactctctgagctgcagtttgctcacctggaaaaatggcaacaataatgaatgtctggaaaatgcttagcacagtacctgccacatagtaatctgctagtaaatggttgttatttgtattattctagcaatcacatggtatgtgctgaaaagtggcttctgctgaccttacctgtcctatcctatatatttgcactgtatcttctagaccaaggcagagtttcctgtgaggctcactaggatgaatctgcatcctgggttgaagttccaacagtgagaaataccaagctggtaaaatctcaaggactctcttcacccagccattgagaatgtatttttattttttctattctgtctcattccacaaagaaaatcttttatgtagcattgagcaaaccaggatggggaagcagaattaactagaaactatacttaaacaggttcccactttcctataaaattcaagaattgtctgcaaaggtgactggtgaagttggcggcattgttaatcacctaaagcagcgtttgcgcaataccagagctttccgaggaaaaggagaaaacacaatcaatcatccaggtgccaaagaaggcattcagctcctgtgcagagatgatattaaaaagttacctcagtgcaagcaactagattaagacaacagacatcttgaaggttctaacctgtttgcttagcattaagaaatggtgttgaacaacccaaaaactattgcatgaaacatccacacattcatcaatcagtcaatatttatggagcacacactacatgccaggcactatgagaactatagaaagcagaggagcataagactttccagaaccaaaaagaggaatgcttttacactgttggtgggtgtgtaaattagttcaaatatcgtggaagacactggagattcttcaaggatctagaactagaaataccatttgacccagcgatcccattactgggcatatacacaaaggattacaaatcatgctgctataaagacacatgcccacctatgtttattgcggcactattcacaatagcaaagacttggaaccaacccaaatgtccatcaatgatagactggataaagaaaatgtggcacacatacaccatggaatattatgcagccataaaaaagaatgagttcacgtcctttgcagggacatggatgaagctggaaaccatcattctcagcaaactatcgcaagatcagaaaaccaaacaccgcatgtcctcactcataagtgggagttgaacaatgagaacacatggaagcagagaggggaacatcacacaccggggcctgtggggcgtggggggctaggggagggatagcattaggagaaatacctaatgtaggtgacgggtagatgggtgcagcaaaccaccatggcacttgtatacctaagtaaccaaactgcaagttctgcacatgtaacacagaacttgaagaaaaaaaaaaaaccactttccagaaccttccttgaagaacttactatccaatttggggagtcgggggtggaggtggagagaaaagaacaaatctctaaacaaagcaatagaaagcccttcagctagggttttcagagtaggctaacatccttttcattgctgtaattacagtctcataaaattaagcagaccagatgttctgtgatttggtaaaagagaaaatatagtcaagcttattaaagagactgtttgactttacaaggacttgcacaccatggttcagaaccaggtgttggtgtcaggtggatctgcgtttaagttctggctcctccacttactagctgggtgaccttgcccaggttgtctaacttctttgggcccgtttcctcctatggaaattgagggtaatagcaatacctttttggaaggatcatagtgaagattaatagagataccttatataaaacacttagcatagagcctaccacacagttaatgttcccttaaaaagcagcttattataattattaaaagagagagaatgactattgctagcatttgccaaggacatctggaaactctgaaagaaaatttcagcctcttctattagcagtggggacaggtttccctcccttctggagcactaacattcttggagaaacagccagctggatatggtaagatggtgaggtaaacaaagtgtttctccaaaagttccataccttctcctcccaggttaatttggcttttacgctgctacccatttgctcagaaggggctcctttcagccattgaggccctctctgggagctcttggttatccaattttaatgttcccctctttacaagctccctttgcaatttggcattctacatcttcttccctgagggataacaacacaagaaaggatagaaaaattgcaacgtgacctttttaaaaagaatgacctgtatgcaaaatcccaacagcacctcttagaaaatacatttacacaaaaccccatgaaaggctctgactcatgcttgggggggggggggacacaacaagcacacctgaatatatttttcgaatttaactgacaaaagcgtatctctgaatctccatcacagtatgtatagtttccaccccaaaagtaaacactttaggctattaggagaaatgacaatggccgtttcaacagaatgcggatgacagaatttgcttccgaaaatgctactatgtgtattttcttgtttcctggttattaatataacacattttgcctctgagtgaaatgtttttacttatgccaagaaaaatcgtgagttacaggaagtctaacaggcttaattagtgagtttaacttaatccggtgattttcagcaaccctgacagagtcaggttcactccctgaatttaatgggaagtggtcagaaatggcctttagcaaccttatgagagaaaaggcacatgatgcgcacaaacaaggccggttctcccaaggtaaaaataataggctgaggtaccgtaattatcaacagtggtttttgtatacaggtgcctactgcatgtgttacctgttgctttcagctttcgtaattacagtttcttatgatcagacagtgctattttcccttcctattaccaaccagcatgctcaggtgaaagttgttcatgcccctggagtttgtcctgcgagtgtatttttaaaggcaaagcttcttagcccagccaaatgaaactgatcggaaaagcaccatagaaaccagaggcctattatgtgtaatagctgggctctttgcagccctatcctaagcactaggccacaatttcggaaggaaagaacctgtaaagacttcagaagacagcaatgaagacgattaagggattggaaaagaggatctaggggaaaaggttaaaggtattaggattataaggacgatttagcctcaagaggaaaaaaaatgaaggagcctgaccaactgttcttcctcgctattgatggcacagaataaacgaatggtagcatgacgtactttagtttagatgtaagaaagaacatgacaacaagtctccggaatcactaaagactgttcgttcttcattcctaaaacattagtcgagcttccaccccatgctggactgtgtgctgagcactggagaagaagttcacaggctaatgagggagacatgccaaacagatcattataagacagtgggaggcttagtataattgaaggaattcagaatgctttggacttttaaaaggcgattgggtgtatacagcacatatatatcacctccagtggggtctgaggcagtacccagtaatcaagtacattgatatttctggagcaaaaacacatgaatattcacacagggtgtgaaaaataaagactataaataacctcatgtcagttcaagttgcgctgccaaatgagtttgtcataaacgtacaaaggctctcagtttccagagcttttggggttttggaatgatagctatgaggctatgagtctgggtaaggggagtctggccaagcaccaagacctgggaatgacagggagcttcagaatgtgggcagagcctgtgtctctaatgtgccccaattctgctgccctggtatcatggacgtgtttggagaaggatccgggcatgtgcatgtgtgtgcgcgcatgcgtgtgtgtgtgtctgtctgtctgtctgtgtgtgtctgtgtatacagcaggaggaagctccttgctgctcctcaggtcaagtccactttcagtggctcctagcaacatactttgaaggaatgaggtctttattaaccaaataatcagtaaatgggttttgttattgttttcaaattatttagctccatagtacctatgaatatgcccacaaattttgtagaataagcatcctctgtgaggtttgcaatgtgtggtagaatccctggggctggggggtgtcacatctctggccttcctttttcagctgtgttctgtgaagaacaggggcagggaaagcctggcctctcaactccctctctcatacctactcccaaggatggcagggcctgcctagcaagtgataaagaaagctgaaaagcctacagggaggggcacctgagcttctgcttatctggattggggaacacccaattatcctctaccagccaagcagcttcacgtaggggctaacctcccttaaaggggaacacccagtgaaccctgtcacaccctcagaagttgtttgcttcctgaagaaaagggggcagtccttgagttcattcttctgttcctaatcatgaaaggagacacccccctttcaggacctattttcttttgtcacttacccccaaccatcacctacacctaagctcaaaaaataactaaagccctctttttgtctttagacctccctccaaaagcatgtccttctctctggactggtcctcctctccaccctctgggaatccaagcccacatcatttcaggatgagatcagcctccagccactccctctgaggcctggcttcccaaccttggtgattccaaagcacacatctgttgcaacacacagggctcgcccctaggcaaaatggagccggggacacagctctcagtcagctgagctcccacactcacataccccatccatgctagcacagccttcctcttccgtggggagtaggctccctggaacccttccgtctcctctccctgacaggaaaggctctgatcaaggaatttgcactcagatataaataataaccctgccttaccaaggcaaccctgacagacaaaccttgcaatttgactcaaaggaattgtatgccgaccatgacggtttctggcatcactcataggcaaaaaacaaatatttataggcaaggtgagccttcttcatgctcatcagattatgatgtagggctgccaaggcagctcttgtcttcttgatctaagatagaccatagcaacattcctcagagcaagggactctgtttcactctgttttccgattcaaatcaggtcatgcagtttgatatcaagagagattatctgaaattgggattgacctggaaagtgtgggacagagggttgccaaaggttgagcgtactggtgggagggagttgggaaaggaaagggagactttgaagaaagagacttgttggtgagaagaggaaaagagaaacaaggaagcgaagagagacctggatggttatgggggtgaggcagaagactactaaaaattgatttaagggaacagttaacatttttacatgcttattttgtactggacaccgtaagtgtgttatctcatgtcatcctcacaacacgtctaggagatgagaactattattagatccattttacaggggaggaaacgaaggctcactgagattaactgtgggaaatcatgcaatcagtgaatggcagagccaagattcaaatgcttattgatctgactccagggccctcagccatctgagaaaggggccaaacaccctttggttgtaggagaagcctccatggtgtatcttgatagaggcccccagacaaccccttccccttaccacaacacagaaacacctacatgcctcccgtgggagctacctgctcctaagctaaagattgctttctgggaaggcaccaataaatataatatgtgctctggaaaaggttaggttaaggcagtttaccttcagaaaacacaaaccagaggtcaaggtcttagaggagttaggaaggagaagctctcagcaggatgggctgcctgtaggagccatagtaggtgttgcagcatgtaggtggcactgtagtactgagtccccgagacacactgggagtctgaagacactaaagacaaacttggcttatttcaccattttgcccagagctgactctgctcaccatacacacaagcgagggaagagtgcacagtgcaagggagctgatgcaggtattggagcctacgttcaaatcctagctttgcagcctacttgctatgtatctttgttactcctctgaatgtggcaagtcactggtctgaattttccactttcatctgtaaaacgaggatgaaaataaaaacatcgacttgagacgtgagattgtttgtgtaaatggttcagcacaatgtctggcacttaaaagaaattcattaaatatcatgtccacctaccctgctctcaccacctcttggaagaaaagggagtccaaatttaaaagccctggaagtagcctctaaagatgacgaagaactgggagcattcattgattcatttaccacataagccctgaatccctcttttgttccctagagactcagacataaataaaatagtccctgttctcaaggggctcacattcaagtgggcaaagatccaacaaactcttgccataaaatataaaacattataatagagataaattcaggagggccatgagggtacctaagggcactgagaaagcttcacagagaaaatatttgcgagacaagcagcaattgttaggcagacaaggaaagagagtgtattccaagtaaagggaatagcatatgttaaggaacaaaacatgacagatttaagtggagctggaacatcagttcagaatgtagtgaggactggtgagagattacactgtaggaggagtcagaagaggtagggtattactgagcgacacttctgagcagagaaaagatgctattcaaaatttatgataaccaatatggcatgggcattaaccagttagaaaggactcagaacaatacggaaagccatattggggcctctaaggaagggattccttatatttagaatagttttggcaactgaagtgaatataggtagataaataatggattggctatcactgaggcttccatgttgtttgaacatttagcctggcaggaacagtaatatctggcatacaagatatctactcagtggcacataatactattttgcagaaacaattttagaaattgcacccaaatgtgtgtgtaagagattatttactgcgctgccaaaacttgggtatctattcagtagaatgtcagggaggaagattacagcatctcagtagtcctctaagcacacagagcacagccacacacataacatgtccctaatcaatgttgaattgctataatgaagtcggttgaattgaatgtctttccgttgaaatgtgatccctgtcaatttctttaaaatgttgtatctcataattctaattaactcacctcttccccttatcttattcattgccttcgctaataatgtcagatattcttaggatagagaaggaacattttttaattatcttcgaactccatagaactccctcttagttaattatcttcttattctccctgactcatccatggtcatcccacactatagtcttatgctagcatgggttttattgtctgacctgttgtttttctgagcctcccaagtgagagaatcagtaatgcaggctagccgcacaatgagattatattaatcatttatttgtaagtgaaccaggtcgcctttcacatcagctctcctaacatgtcaatttgtatcacatctaatatgagacagcccgaaaaaatcagttccatctaagtaaggaactgtgaacaaatctttttaagaaaattagtaagaacaaaaatgattttttcactccagtttagtcttaatcaaagcagtgggaccagggtcatctccacctgctgtgagcgcaaattcaacattgtgtttgcaggaagtgagaccacagggtttaggctttggagccagaccagcgtaggtttaaattccagttttaccacttgctcactgtggaccttaggtaagtttttaaaattcactgagcctaggcttctgcatttctaagtttggggttgaatgtgcctaccttgaagggttgttctgagaattaaaagtaaggtacagaaagtggaatgtgcttaggagagtgcctggcagtgagtagacactcattatgtgatacactgtattatattattgttgttattgtgagtccattgtaaaccagaaagaacaagagaccatgagtcaggagcctgagttctgttcttagctgtaccactaatgaggcagagacattcactgagaaacggctaataggtaacatgagttccaccactctcctagtcaacatatatggcaggtatcaataatcagtcatagcatttttttcctaatgagcaaaaacatagatttagaatcattctcagcacggaattccaaacagcctctactgctcaattaaagtcggcaaatgaaatgaaacttatttgccttccctagattaaatggtcttagatgtatcttttagtgttaacatactatggatctatggaagaaatcctctctgataatgtttacaacccaactatgaggtgaagtgaagggttcaaggttcagagagtgacttccaatataatgagtcggaaacaaataattcaacttggtggtgtgatacagttaagatctaactggatttatgcctgtttcttctgctgtgtcctagttctatgaccttgggcaagtcactaacctctctgagccccagtttcatcatttgtaaaaacagacaaaagatgattttgtaagatgttaacatcaggagaaactgagtgaaggatgcatagggattctctgtactctcttttcaactgtcctgtaaatctaaaagtattctaagatttaaaaatttattttttaatgggaagaagggcatctgccttgaggagttgtggagagtaaatgaaataaggtgtgggaaagcacataaatagtttgatgtctttcttttccccctcccagccatctcccttcatctacacattcaaacgtgtagaacacctgaggaatcaggagatatgttttctggattgtggtgccagcgggttcacctgcctgacagcactgcagttcagagcctggctgccaagctgaaaccctgcaggcaagaaggttgggtttacacagtcctgggagccaatgaatgcatcacacattgccagaaagcaaaatggccggcctgcctttgttggagtcagcctatgcgtgggaggaggagggatggagcatgcaggaggaagtgaaataagaggactgggctagaatctggatgctaagacttgcaggtagtcaaggaagcgggttcgtgctccacccacacccttttccttaagggtctttcttgtcagctttagaatcattttgttgagtaaatgcactgtttccaaatagaccctgacatatccaaataagttagttgggggtggcagggaggaggagatctgtgctgtccccaggcctgtttgcccccccaagtccattacttccttttcacatctctgctcttgtagcagggaagctgatggggcaggttggcctttgcaggctgttccccaggctctgatgggtttggccaatggaaggcactgttaggatattagaaagcaaaagggagagagaaaccagggtatttctctccctccccctctgcttcatgtggtgtccccagcagtgactgtgtctctttgtggctctggcactgctgaccaggttactgtggctcaagtttctactaagtgtcccagccctgaggttctagccaaggaatggtagcagctccctgctgtgactaatctctaggttgcttcattgtcctctgcttggcatcacagcttttccatcacctgtgtgatcaattccctgcactgaatcccttttcccttaaataaatactcagtgatttctattttcctggttggactcagactgatcagtcatccactagccaacagcaatgattccttctttccactagccagtttgtattttggaatacaaggctctgagagacttacttggaaaatgtgggtgggatatcaggggagtggaagaggtctagagaattagacatggagatcaagctcaggagagccaagcatctaagagtaagtctttggaacaagaaggaggcaggaacagaaaagcagttaagctagtccttctgcttctcacatttgccctgtcccagactgtggctgctctgggagtcatctgctttggcagagagcaagtccaagcctagaaagacaggagaaatgtgggctccggagtcagctccaggaacatggaaaaaaagaagagaaaaactcacgggtgtggccagcctgcctgtaggtgattgttgcaatccagtcagatgaggaaaacaaacataggagtccaactgatcccatcaatcaggctgtcctgatgggctaagtgcaatgacttcaacagcaacagaaaacacacggtactgtccccaggacacgagtcccttcatttaatttccttgcaaactgtatttggggctgtatagacccagccacagtgcttgagtcccatttatcagccactaattgactgtgtgaccttgtacaaggcacttaatagctgtgtgtcgccattcttctttgtaaaacagggagaggggaatctggccccctgcttacctaaaagggcacattgtgagtacccaatacacatcaaactgtaattccagctctgaggaggtgcaagagcagatgcctgagaaatgcttcctgttggggactgggaaagaaagtagaatggaggaactccagtgtagtgctcaagagcatggtttgaagggaattattgttagtttggcgatgggggggataataatttcgtcattgtatataaaaatatccctatttttgagttgcataatgaaacatgtggggtaaagcataagagggaaaaagaaagagagataggtaaagctaacatggaaaatcatgatagatgttgaatctgggtgatggatacttgggggttcattatactatattttttacttttgtgtatgtgtttgaaaatttccataataatttttttcaagcatgtattttagagtcagaccagggttcagccccattcattcgggcaacaaataggtatgactaatactggatgccaggccctgagctttgactcagtggtggtgggtggacagggcacaaaacaggtcaggtcaggattccaaagtgaagaaaaagcatttagatattagataatcaggcaaaaattgaaaagtacccacttcacctctctatgttctttgtaaagtacttttctgcttgaaagggcagagttttgtctgataagttcttccataagccctggaggcaagaaccacccccagcctagaaggacactggagctgtctttttctggcctccagtagcagccagcagctaggcaggcctggagccctccatgttggagatcactgactgctggtgtgggctgcattaccagtgccctgggcaactcatgtaggtcccccatcctcattcccaggagatttcagggcctccttaggtcacaagcaaattgccatctcactccctcccctgtctctccccttcaaacacgcacaggattaggattatgtaattgaaatagaaaaaaaagaaaaagaaaaaaggttgtctcaaaagttagacctgtatttcagtcccggctttaccacttactatcaatgtgactttgagcaagtcacctccaggctctgagcttttgtatcctcttctgttaaatcgtgacaaaatggtacttcccttgtaggattacatgaggattaccaaggaaatgcaggcaaagtacttagcacagtgccaggtaggcggtatgccctccaaaatctgggcactgctattgttcagggagaggagaggaaacagtctagcctctgccctggtgaagagggaaaaagacatgagttgaggtctgggagtcacagcctggtgatgaagcatgcaatggtcctctttaatgtgggctttgagacaaaagatcagattcatctccccactaggttagggatggcagaagtggagaccctctggtgtgggggcaccctcggaatttagaggacacccaaaaaggaaagccagttctgagcccattgccaaaaggtttggcttcccacaaagcagcccctgaaacaacctacatacactccccaccttccatgacaaatgctttgcccacatcctggcagtttatctagaagcagccctgaagctaagcaggttctttggccctgtaacagttccagatcccaaagctccagctgctagctcaggatctgggagtataagcctaggctagtataagcctgaggctggcacaccacagggtgagtcacacacagccccactgttccccatatgctgactggacatatagagggatggcctcctcttcctggaggcctagtagaatgtcacagaagctagtgctgcaacttacagattccattttccagttgaagaggcagaagcacggagaggttaagtgagtcatccaccaggagcagatgcatgtgcaaaagcaggcaaggggctctaggcctcctcgtcctccaaccagccttcttgccctttgctctctgctgtctctgagtacagtaagtcctcactgaacgtccttgacaggttcttgggaactggactttaagtgaaacaacgaataacaaaactaattttactgtaggctaattgatataaacaagagttaagtacccacagcatatttctggtcacaaaaatatcaccaaacttctaaataaagatccaaataccagcctgggcaacatggtgaaaccctgtctctactaaaaatacaaaaatttagccaggcatggtggcacacgtctgtagtcacagctactcaggaggctgaggtgggaggatcacctgaatcctgggaggttgaggctgcagtgagccgtgattgcgccactgcactccagcctgggcgagaggagtgagaccctgtctcaaaaacaaacaaaaaaacaaacaaacaaaaaccacccaaacacttctaatattaaacattaataagttaattaaacattaacaataagtgtgagctacacatacatttaggaaagattaataaaaacaagtaagagaattatttgcctaatttttggtgaatcaatgagtgacagcggttgtagcaatggcgggtcaggtcaaggaataaacatttgcaaagcaaaatcataaggagcacctcctgccacccagcagttccagaagaatcacaaaagcgctcattgagcgctttcctatcgtgtcatttattatcatggattcgtatggtcattgtgtactttacgagttttcattttccaataatttgtattcactcattcagttattttctaacccgctgattccagttcagggtcacaggtggccggagcccatcctggcagcacaaggagcacaaaaggtgggaaccaccctggtcaggacgccatcctgtccatggacagtggccctggggaaaaccaaattttccccattaacgtgataactaaatggctttgaacaaaacaatgttattcaaggacctgctgtataggattgtgccaagcagttctcaggccagggtaggccaagaggaggatgaagagagaagagggatgaaccctagaagaagaaacttttagaggcaccagtgggatgatgatatggcaaatagcacaggccttaggagtgagggacagagggacttggagcctggtttctgctcttcctggttgtgtgaccttgagcagtgtattttatctcactgagcttcagcctcttcacttgtaaactgaagataatagtatctgccttgtagggctgttgtgaggatcagagatgaaaataaagcacctggtacatagtaattgctcaataatcataatgatcaactagtgtctgctctctgccaggctctgggataagcactttacataacaactatgaggtaaatactgttattagccctttgtgtagatgaggaaaatgagggtcctggaagttaagtggtccaaaatgacccagctaattaatgatggtaccaggatttgaacccatgtagttggacttcacaatcagctctcttaagttctttacttcttgccttgtttttgtggaagatgcagtctccggtgggaagcaggcccaagagggacaatgtgcaaattgtgcaaatgtggtcttaatccaggaagcaaggcagcacatgtccccataaagaagtttcaaagggaaggccaaagcccaggcccttgcatctgttgcacatgtctttagccatatgctttctaatccacccacaaactcacaacgccagctcaaacactcaaactcacatatacataccatcaaatctttttattgctgtctctttaatgcttccctgcctttttagtttcatggaacacaaagaaaagtatatttttcaggcctaaagggtgtaaatgatcaatatcttggtacatcaattgagtcactttactgtaacccaaagtacagcactttgctgtaacccctctatatactctaggcacaatgatctgaatagaaacttcctgtcaaacacaggctcaaaaggcactcttgcgtgagcccttgtaaatggattaatgtatggtattggcttctttaaaaattgtggtagaaggctgggcacagtggctcacgcctataatcctagtcctttgggaggccgaagtgagaggactgcttgaggccaggagttcaagaccaacctggacaacaaagcaaggccttgtctctacaaaaataaaaataaaataaattagccaggcatgacggcacatgactgtaagtcctaactacttgggaggctgaggtgggaggatcactcgagcccaggagtttgaggctgcagtgagccatgattacaccattgcacacagactgggtgatagagtgagaccttgtctcaaaaaaaaaaaaaaaaaaaaaacctgtggtagaaatttgagcatttaaatctttcactacattttgggttctggacccattttctcccatgtacatttgaagctgatagttgaataattacttgatacttaatgtgatgctgtacatttttagacatgctattttaaatgtcaaatcaatatgaatttatttgtcagtctttcatacaagcatggatcataataaactcatccgtgattcatgagaatgtaaaatatactctcatgggaactttatcttaattcaatattattggtcttttaaatgaaacattatgttttcccttttgaacagagttcattggtaattgttcatcagaggagaagcatattattttttcacatttttttaagcctttgacaaaatcagggatgaaatctggctatgtgtctgtgatgccaaaacatctggatgaattaaaaaaggggaagatgatgctgttcaacgactatgctgttcggtccaagtactacttgccaacatctgggtgtctggcacaagagagttgacagtatgtccttttcatccacatgttatggctttgtatatatagatggtttctcactaaagacaacttagatgcctctttgattagggaatacaccagaagtttaaagtggaagtggtgggacaaagagaaaattacagcagaagacattcctaaaacggttctgccactgccatagagtcgtagcctgagcaaaagccagaggtaggaatgtgcaagatttctacataaagtagtactgggaagctgcaataatgatatagaaaattgtggctactatacaaatcatagaaaggggaagagaaatcttcaatgtaccacttaccagaaaactatttactctaaatcagcacttattaatccatgttcactgtaggctgatgtggtgcccccaagcatgatggttgggaaaacaatgatttgaccatgaattcagcagtccagggcccatgtggcagtcacatgtattcttaatacactactcaattgtagctcagaattgagttggtggacattcacagcctcagtgtgaatgtggggaaaaccaaacaaggggatttcattccataaaaccaaacccaaaaaagctcagtagacaagctgaaaatcagcctgggagaaaagagctgtcagtatgccttttaatactgaagatcactagaaaataacccaaagtcatggaaggaaggaaacaggcaaagagaaagagcttcaaaattattctctccattcccaatcccagagtaaatcaggcaccttttgaagatgaagctacgctgaataaccatgttccagatgacaaaaaatgggtatgagagggtagcaaccagctgctgttcaccactgaagctggttcaagaataaataattttcaacagacgtgggaaagaaaggcatactgcagaaagggtttacaagggagactcaaggagcttccttcttgaaagcccttatgatcaaattctagatgaaaaaacaatttcaccttcatgactgataagtttgtttgactggattaattagctgcttggttagagtgaccagataatttagtcattacagctcaacccctcctgaaactaaacatgatctaaggactcagcaaagccatctctattttgctggatgacagcaagtggaatttctatttagccctctgttttttggatctacagtagtggagagtcccctgatatcctctgggcatattcagttcacctaggtacatgagatctgatttcaagataaaatatttaaaaaaacacttctggctgctacttctcaaatattgtggctaaaagcagtgttgatgttctcgtcattcttttatgcaatcaaataggtaatcagagttattaaaatatatgtatatatttaaatgcaattaaatattattttcactttgaaatttaaaaaaggcagaaagcttgtaaacatttattttattttttaacttgaattgacccttgtgtttaaaagaaatatgatttcatcatggatctacaagggactccatgttgcatatatttatgtaccttgtaggaattcagtaaatataattcagccttgaatcccatcagtttcttttcaaagatcgtttaatgtaggcaggtattttatttaaatatcaatgtagatattttatggcatcctcccacatacaacttgcaatgtttctccattgggtcaagtttgtatcttgttcaagtgaaaaaaaaacaactaatggttaattgggggacaaacacacttcacacacttccaatactctgtggtaaacaagcgagctgactctgtccttggtgaaataaaactttctcctagagccaggaatcaaataaacacaggatgtgtctatgcttctcagccttttcttttcagatggaatcatggtctgcaatgacctgactgtctgacttcttatttttccttccttccttctttctgctgttcttcctttcctccctgccccgcctttcctcctttcatcccttcctctcttcttccttttctccctttctactttctcccttcctcccttcctttctatcaaactctcagcataaggcttctcatatttctggctttgaaggttgaatacctgttacacaaggtaacatgagaaaaaaaaaacaaaaagattgaataaccttaagggtatggtaaattagatttaaaaaaattgattgtgtgagattttatttacttattttgggtggagctactggctgctaccatttgcaaagggatgataaatttcaatcatacccatctttttcatgggagcaagccaacttgtggcagacctaagtggcagagacagaacaaaatcccagatgttttgactcccagtgcagtgctgtttccactgttgcaagcaacctcatctattgataaaatattgtggcatttcaggtgtaaaccaatgaaggtttcctaaacaacattttacaaaaaaacagccaagtgttaacgaaggatctttggtcaactaattctgaatattctgcataaattaataaaataaatactgcatattctatatttccttggagatttgcagtgcattcattcattcacattttaaaggctcttagaagccgtaaagaatcctgttcaattttctttaattcaaaatgttccaacatctttctctatggatcctttttaatctcattgcctacctattaatatcttctagggttccacagtgcacattttgggaaacactagtaaaatgaatcaggaatatgtgaattaaaatatacttattctttggacactgcttaaaaagatatgatacccctggtactggaatctgaccattctggtttcctagccagttcacactctccccactacgtacatcacacagtttcctcatggactttttgcttccagttgctaactgtgctcagatttctctaattagctactcttgagccaactacttggcagagcaatggttcttaaagtgtggtccctggaccaggagcatcagcatcacctgagaacttgttagaaatgcatatttgtggaccccactcacttcagacctactgaaccagaaactcaggggtgggatatagcaatctgtgttttaagaagccctccaggggcttttgatgcatcctcacgcctgagaaccactgatctaaggcaaggctttaaataacttttcctatatctgctattatttcatccttcctcttaacattcagaaaacagccaagacaaagtaaggtacatcctagcgccatgtgcctacataatgatctcctccctgtccctccccagtatctatgccaagcagctgccccacaaactcattgcaaagctgagacttcttaaaggtaccagacctttgtctctgaacaatgaacacattttaacacacccaggtttggaaggatggttacatactgagttcttcagaatcctatcaatcaataacaaataccacctgagtgcctatttagtacaaagcattgtgctccacgtcatgggctttcatagaaaaacttgatgtgggcccctttgcagtttgggatgttacaatgtcatttaagagagataatgatcaggctgggcggtggctcacgcctgtaatcccaacactttgggaggctgaggcgggcagatcatgaggtcaggagatcgagaccatcctggctaacatgatgaaaccccgtctctactaaaaatacaaaaaaagaaaattagctgggcgtgatggcgggcgcctgttgtcccagctacttgggaggctgaggcaggagaatggcgtgaacccgggaggcggagcttgcagtgagccaagatcgcaccaccgcactccagcctgggcgacagagtgagacaccgtctcaaaaaaaaaaaaaaaaaaaaaagagagagggagataacgatcatatcaaaaatcgtccaacaacacaaagcagtgattaggaagtgccagaagaatgctactaaacaatatgcatccagactgtaaagacagattgttgaaagaacattccgttgagaagtagagaacatgggttttagccctccctcttccagttaatagccctgtggcctgcagcaagtcaaattctctgtgggttttagttgatattctaaatcaagttgtaaattgagggtaatattataataccatacattcccaaagtcagggaatagaaacagatgcactcttaagataccttttagtctaagaactatgattctaggaagtctcaaactgaattctgcatgtgcaagcagggttgccattggccatggtcccagagaatgcatgttccaatgcagggtagccaggtcttctgatttttctagagaaactggaaattaatattttatgtgaaatttgtccagttaaatgttttagcagctagttctaatattttaattggaccaaaccaaacgtgtctgtaagccagatgtggcttgttaactttgttaattggtaacctctggactagacagaggccacgtaagtcttcattggaaaggtgggactgtggggattcctgcagaggttgaaaagaaatggtggtatcaatttaatcactaagatgcctcacctcaaaaacagtcaatatttttttctctccaagtctttgtttagtattacacaggcatggcggtagttaattacagactgcttagatcccttctccttaaagcttcccctgaccacctcagccccaagtgctttctccctcccttgagttcccatagcaattcttttccatgcaattcatttggaaattaatcatatagtgctctgtggcatcttttctgttgtggtcctgaactgctatttaaacatgttataattatttaagtttccacatgtttgcatcttctcttctgtgttatgaagctctttgagaatagaggttaggtcttattcccccacagtgcctggcacagaggagaagcttgatctgttttgaatttaatttcaaaggagtgcaggagcagggtagtgtaccatagggtgcatcaggtgattttagatctcattctttctaatacaatctgtcatctttattatatgcgaacttacaaatttctatttaataataatagcttcaagaaaatgaaaaaaaattacacagaatgacagaatattcacaaacatatatctgacaagagatttgcatgcagaatatataagaactgttacaactcagtaataaaatgacaacccaatttaaaaatgggcaaagaatttgtagggacatttctccaaagtagacataagaatggtcaataaacacatgaaaagatactcaacctcattaaccatcagagaaatgcaaatcaaaaccacaatgagatactactttacacacagtaggatggctataataaaaaataaataaaaaataaaataaatataataaaaataataatttaataaaataaaaataaaataaaataacaagtgttgatgaagatgtggaaaaattgaaaccatcattcccactactggagggaattttaaatagtgcaggctctttggaaaatagtttggtggttcctcaaaccattaaacatagtgttaccatatgatccagcaattccactcccagatatatacccaagagatttaaaaacatatctttacacaaaaacttgtaaatgaatattgatagcagtgttattcatactagccaaaagatagaaacaatccaaaatgtcaatcaactgataaatggaaaaacaaaatatgatatattcatataatgaactattattcagccttaaaaaggaagtaagctctgatatatatacaacatggatgaaccttaaaaacattatgctatgttctcacttgtaagtgggagctaaacactgggtacacatggacataaatatgggaacgatagacactggagactactagacaggggaggaagggaggtggacaaggcccgaaaaactacctattggatgctcactgtctgggtgatgggatcagctgtaccccaaacctcagcatcatgcaatatacccatgtagcaaacctggacatgtacaccctgaatctaaaatggaagttgcaattttttaaaagacagttatgctaagggagagaagctagtcacagaagaccacctattgtatgagttcatttatataaaatgtccagaagaggcaaatctatacagacagaaagtaggttagtgattacctggagctgggaagggggagagggagcttcagggatggaaacggctaccagtgggtatgagattcctttttggggtaatgaatattttctaaaaattagattgtggtgatggttgcacaactctgtgaaatactaaaaatgactgaactgtacactttaaataggtgaatttattgagatataattcacatagatgaattatatctcaataaagctgtttttaaaagctaatatttatatagcacctactatgtgccagacattcttttaagtgttctgtatgtattaactcatttaaccctcacaaaaccctaagaggtaggtaagtacttttattgtttctatttgatagatggagaaatgaaaggatgcaaacgttaagtgatttgcctgaggtctcacagctagttggtggtggagctgggattcaaattcaggccatctggatctagaatgttatgttcttcaatacagtgctacatcagaactgaatagtcaacacttgttatttttctattattctgctggaactatgatagtcttaggctttcaaagtgtcttctctgcacagacttgggctacactagatgtgagtgtgggcaaagttgattagcaaataaaccaaacaaagggaagaggcaacagaataagaaagaggagtgaattcatagccactctgattccccaggagttttgcacctctttattctgcccatttcaggaagggtatgcacctcgcacctaatatgaaagatactatgtccaatgagctatggtggggggttcgggcaaatccttacagaaaagctcttatagtgactcagccagccacatttgtcaccttctggaggatggtgacccagttcagagtgagccatgatacagaatggagatgactcacattttcctctggattcttaggaacaaatagagtatctgcctggattcccttgatcctcaagttccagaaaatggctgggttcattcattcaagtaaaagtatttattaagttaaatgcaaagggatacaaagctgataataaaaaccatttagtgagttcttattatgttattatgtgctaggttttacatgtactaagttatttaattcttaaaatatccctgtgaggtaggtactcttattatcatcctcattttatagatgaggaaactgaggctcaggaagattgagatcatacaacaattatgagcagaatcaagatccaaacccaaatctctcagatttcagtgcttttttcagtataatatactgaccccaacaaatacttaatgagcccatacttaacaccaggcactatgggggagaaagtaatacaaggtttctgccctcaaaacactataaaccagcttggaagacaagacacagacacagcaaaagttaagtaatgctataatagtgctatataataacacatgtatattacatatacaagtaggttatatatacgataacaataaaacaatagaagaaatgatgatgtataatatttactaacatttgcaatgtgtcaggttctgttctaaaggttttacaagtatcatcttatttattttgttttatacatgacgaagctgaagcaaagaaaggcgaagtaattggctcaacatcacatagcttataagtggcagagtaagaactcaaacccaggcagtctgcctccagagcccatccctttagttgttatattgttttgccatgataaggatggtgctatcaaagggatatggaaaaatgctatgagagctcaaaggacgattaattaattctatctggaacagtctggaaagagttcccagaagaggcaatagttgagcagggtcttaaaggagagtaggaatttactggcgagataagaagagtaaggatgttctaagcagaaggaacagcttgtgcatgaatttctgcaaaggcttgatttatctgaggaatgttggaaagttcagtatgactggagtttagggtatgtcaggattgtgaaggggtggggagaagcagtaaaagtggaagatgaaactggagtggtaggctgagtaataagaaagtgaggaccttatatacagtagaagaattcataaaaatgagctctaatatgatgtctactgtaagattctgccactttttatttacccctgatttggaaaaaggcccctttcctctctccaagcttgggaaacaaattttgctaagcaaagataggagttcttgaagggaggagggtatgaagtttatactctttggaaaggggatgggccatggtgggaaagaagactggtgtgggcaagcctcctgggaagaagaccctcatatattcaactgagaaagggacagatagccttctccaatctaccatcaggttgggtgcaatcttaagtaactcatcttgtatacacacactctgggaagaggggtggttctgagatgaggaggaaaaagctattagttggctttttgcaagagtttctcatcccagacttagctccttagtcgtctcttcatccatgggtctaggggaaccctttgattccactcccactgcatcatgtaaaactgagtgagttctactgtaccttataggccatgggccaccaaagaaggtttataagcaagagagtataggaagctcaatactggggcagatctaagcctcaattagagggaggaagaaacgaattagaggcaggaagcctggtccagctgagaaacgacatggaatttaattaacacagtggccccgtgagtggaaatggggagaagggctttgattcaggcaacccttctggggtagacttgtaggaatgagtgacaaattgaatgcagaggaaagggaaaggagaaaaagagaggactctaagagataacccactaatttgccaaactaatgaccagtgggaggcttgtttacaactcatctacttttagcatggccttctaatgcagggagactgccttggttgtcagactgggatgatatatcaaaaccagctatgagttacacccttccttcctatttcctttctatttttccttttagtttaaccctcaaatccatggttctccccttcatcctttttagtttctcttctgctcttttaagaaagtgtcattttcacaagcttcatccatgtctcccagatcctggctgcctttgtttcttattgttggtggtggtgtttgggttgctgggttttttttttcctgtacaattggaacgttgcttattcgccttctgttcaataaagttcgtcatgacccattgtgctctttcttcccagacttgtatataattatcttgtgtttgtgtgtggtttgtttcctctgtttttttccacatggccttctgaattttcactaaagtattgaaaaacaaagagagaattctgaccaaagcataggcctggagtgaataaagaattcttaggaaagaatttttaaaaatactgtcaacagcatagattcagacttgaattagattaatctgtctaaaatgcagctgtttaaattttttttaatttttattttagattcagggggtacatgtacaggtttattacaagggtgtactgcatgatgctgaggtttgggcttctattgattccatcacccagatagtttttggagtccttaatgtctattgttctcatctttatgtccatgtgtacccaaggtatagctcccacttataagtgagaatatgtgatttttttttgcattaatttgcttaggataatggccttcagctgcatccatgttcccataaaggacatgattttgttcatttttatggctgggtagtattccatggtgtacgtgtacattttctttatccgatccactatcaatgggcacctatgttgattccatgtctttactgttgtgaatagtgctgcgatgaacatacaagtgcaggtgtctttttggtagaatggtttattttcctttggatatatacccagtaagaggactgctggatcaaatggtatttctatttttagatctttgagaaatctttaactgctttccacaggggctgaactaacttacattgccaccagcaatgtatacacattcccttttcactgcaacctcttcaacatctgctgtttttgacgttttaataatagccattctgactggtgtgagatggtatctcactgtggttttgattcacatttctctgatgattagtaatgatgagcattttttcatgtcttttggccacttgtatgtcttcttttgaaaagcgtctgttcatgtcctttgccctcttttcaatggggttgttttttgcttgttgatttaagttccttatagatgctggatattagtcctttgttggatgcatagtttatgaatattttatccagttctgtagggtgcctgtcgatattttcttttgctgtgcagaagctctttggtttaattagatcccacctgtcaatttttggttttgtttcaattgcttttgatgactcagtcataaattctttgcctaggctgatgtccaaaggatatttcccaggtttccttctggagtttttatagtttgaagtcttacatttaagtctttaatcaatcttgagttaatttttgtatatatggtgatagccagaggtccagtttcaatcttctgcatatgccagttatcccagcaccatttattgaatagaaagtcctgtccctgttgcttattttttatcaactttgtcaaagactagttggttgtaggtgtgtggctttatttctgcattctctatcctgttgcattggtctatatgtctttttctgtaccagcaacatgctgttttggttcctgtagccttgtagtatagtttgaagttgggtaatgtgatgcctccagctttgttcttttggcttaggtttactttgactatttgggctcgttttaaattccatatgaattttaaaatctttttttaaatctgtgaaaagtgacattggttatttgataggaatagcgttgaatctgtagattgctttgagcagtatggccattttaacaatattgattcttctaattaatgagtgtggaatgtttttccatttgtctgtgttgcctctgatttctctcagcagtgtatgttaattctccctgtagagatctttcacctctttggttagatgtattcttaggtatttaattttttttgtatggctattgtaaattggattgcattcttgatttggctctctgattatattgttttcctactacaaaatcttttattgtcccttcaggacaatggaaggaagttcaagtttctaatccttttgtgttctgtccctaacacaattttgcaaccttaattcctactactgtcctatgtgtagctacattttcccatgtctgtacctttattcatactatctttctcaccctgccccattcccatctgttgaaacaccacctgtaccagaatgcctgggaaatctgatggggataaggaatcagacctgtgtttcaaagtcagatttactacttattgcctgagggatcttgggcaaatcatttcctctcacagagactcagtttcctcatctgtaaatgaggattataataatctcttccaaaagttgtagcaagaaataaattttatgatatatatagatacatctacacagcactcatcaaatggtagatgctcaataagttattaaattgatatatttaggggatttgaaaagaccactcaaaggccatccatgcatttcaaatcacaaatccctgaattttagttcatcggtattgggaagtctgtctaaatgaaaaatggtatttttttgcttccccatttaccattgctttcctcatccttcaggagtatgtttacatgtgcatgtgcatgtgtgtgtgaaagagggtatgtatgtgttagagagggttgggtatttactttggcagccacatttcagaatgagttgaaaaaaccagacttgtttttaaaatacgtaaaatcacatgcttgggaagttgagtcactttaaagaaggcccagagtggatccagaaaagaaaaatgggactgagcagaaagccatgagaggctgccatgttctctagttctgaagtcacaacttgtcatttagggaagagtctcttaaaatgaaggtagcagcctaacagaagacttctgtggcttagaatttcaaagaatatgaaaagaataactgaaggcaagatatttttttcatttttctctgtccctcttggagaaagaactaatatcagatgaaaatcagaatctcaccaaaccatttactaagaaagtaggccaagtaaagactctccttgaaagctataatagaaatggaaaacaatcaagaatggagcactagagagcaattgaaaggtacactgaaaagcagatgggggtggtatgataacgagtatcatgaaagagctagcatgttcttaaaaaatcagggaaaggtctccaaactttatttgagtagtgagaaaaatggtgggaccagagggccagagtgagcaggccccatggagaagctgtgcttgctgttaggagaggttaatgtttcacgagactggcagacgcagcagtgggcagcaggggtggggggtggacgggtgtccagcaggtgccatttcagtgtcttctccatggagaagctgtgcttgctgttaggagaggttaatgtttcacaagactggaagagccagcagtgggcagcgggggtcggggtggacaggtgtacagcaggcgccatttcagtgtctctaaggaccattcaaatgaaattggtggcatgtgtcttgggcattaaagaatgaataggctgatgaacggagatctctgtggcaggcagttaattccaggtgaaagaaacactgatgctggaaagtatagggtgtgctctgaaaacaaagaatggtagtttggcaaaagctaaagctatatgaagacaagtaatgggaaagaagctagaaaagaaagataggcaaacatataaacatagagagcttcgaatgccaggatgaggagctagtacgttactcattaggcaaaagggaaacttcaaggatcttttgccaaaagctgtggtttagagagatgactggtagctatgtttaggatactttggatatggggagattggatgtggagtggctgcttaggaggctatcgcaacagtcaaggagagagtagatgaagaactgaactagggtactgccccaagggatggagtggagggagaaatgtgaatgaaaataaacatctattaaaataagcaattattcaatgaacttccagcattaaggaccttcccatacccaaagataggttatgatggaaatatttcacatttacagccccaaagctgagccttgtagccaaaaaaatgggcagaataacgcaagatttatgtaagtatcaaaatgaatgtccacaaggaaatcagaatcttgaagaaaaggacaaaagatgagaggtttttgagatggaggtagatattttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggggcccgctaccacgcccggctaattttttgtatttttagtagagacggggtttcaccgtgttagccaggatggtctcgatctcctgacctcgtgatccgcccgcctcggcctcccaaagtgctgggattgagatggaggtagatattaaaattcaaactccctgtacaaatcaaaaatgtgtgcagatgtatggcttatgcaatctagtgaaaacagaagttatgatagcagcccaaggccaaataaaaagtaatttttcaaacaaaagcaaaagaaatgttccaccagtcctgagtaagaaaatactgtgcagcacatggacatgggcggggaatagtacataatagttcgagccttttacaagttaattaatagtttgattggagtgctttttattattaaaagaaaaaaagaaagccaagaaattcagtgatttactgcaatgttctcttagttctcataccattccttctatgttgcataagggacaatgaagttcctggaagactgtaggtatcggtgtttcgctattctggccatttcacggaattttaaagaggtgggatggtggggtttgcggacaaatagaaagatattaagattgttgctattccaagtgactaatgcatatagcgctactgggcagaagtgaattttattcttagtcctgatctcatgaaatgtccttgtgggtaaaacactcaactagcaggattccaagattggacttgggcagttatctcctgtaagtatcttcaaggctaggggaaaagcttgagggccctgttctcctggagagtttattgttattactgtctactagtggccccactccactttcacccactgcctaccactactgcagtgctgtagttagtagcactagagcgggaagtggtttccatgcccctaggtgggtccggcagatttggctattcgtccatgaagtgctcaaggaaaggcaaatgacccaacgtcataccgtccccactcccagtggtttataaacacatccaacagttaacatttatggagggcttacccagtgccagatacatttgacttgcctccttccccacacctctgcaaggcaggtactgtgatcatattctagatgacagaacagtcgcagggaggtttaagtgatttgttcaaaggcaaatagctagctagtaattgccagagctaggatttgaacccacatctgtctaattcttttcattacacttcacctccactaaaagagtttcttttttgttttcttctgagtgttggtgctgcctcatagggcagagcatgttttcagtgccccagatgatcatggcaccatggctctctccaaatcctcttgcagaattctctctcatctgaagcctctaaggtgtcatgtcagctaccttgggatgctcccttaactcacttgggctaatagaatagagccatggtgtctcagattaaggccatctggtcctgtgcatcagctcatgttgacgcctcactctgacatccctgtctggaggcaggctaacttctgcttgcaaactaccagccaagaccagcttcctggacataaggccatttcattttgcactgggccctgcaaattacatagcgatcctgcttctagtgatgagaaactcattagctcaggaggcagcccattccttctttgaattgctgtctcttagcaaaggcatccttatggtgtaaagaaatctatttatctgcagtttttttcccactggcttcagagacaaaaatatctgggagaaaatgtctggttctgaaaccaccttaccatggttttaaaagcaagtcatttaacctttctgaatctcagtttccacatcactaaaatgagaatgtgactaccttctttgaagggtgttctatttttttaaggacagacaggacatagcattactgtatgtagtcaatgaatgctaactataactgacatcaatattagccctaccataagcacattgaatgcaaatgacagaacatggttcagaacacagattctgatgttttatttacctcactcaaaatgtcttatacttttccttttcttcttactttccatgctaagaaaacttgaaatcattagcccacttatgatttcacccttaaagtactacaaatagcattctaatttaatttttaaaataataattgtgagtagtagctgtagtattttaccatcggattgctcagtgttttaagttcatgtaatatttccccatccctgatttcatttgaagtttataataactctgtgaggcaggcagggcaggctctaattgattgattgattgattcattcattcattcattcattcatctattcatccaatatttactgagcccctactacgttctaggccctgtaccagtggctagagatacaatgatgaacatggcagatctggttaccaccctttagagtttgtattctaggttgtttgcagaggaggaaactagcctcaatgtttaagtaatctgcacaaagttgtgcggttagtaggggtagagctgagactagaactaaagtttcctgttgctcattccagtgtatattccactttctcattccatctcttgttctcctgcatccagcatctttctttctttcttatatttcccactcaactctaaagaatcctgaatttgctagtagattattctgcctaaataccatttttagtcttgcaattccagttttattacatttaattctcactagtcaggcagtttaacatcaagtcaccctagtgtccctgagctgtttgctaagcttgcctacttgctatataacctatccagtaacccagaaacaggagaactaggggcctgcattacttcacccagccttcttgctctttcctgggttagttagcctttcattggccagtcagaaaacatataatttcctttaaaaaggctgaagggacttccaattgcccatgtataatatcatatgcagacactctccctggcttcttaggccctccataatcttgccccaccccttcccttgaaccttatctctttactcacccaccctccacatatccaccccaagctcatttcctatcctatggtctattcatgcaccttatcactcttcttacctccatcccacaaacatagaagctgtcctttgcaccctccaccgaaaataaattctatgcagcctaagtcctacttcctttatgaaaccttctttaacagctctagctctcagtgatctcaccaatgtcttaatagccctacttctaagttttaaagattaattgcctaagtacatgttaaagaggacctcatttgacagcctttcatttgaaaaagtcctggggattttaattggtcttatgctcaatagaaatcaatagtggtgatgcagtcacaaatatataaataaatagatagctgggggatccaatctcaggctgtactaaaataaatatatgtccagattgagagaaatactactagactcattaattcactcactcatgcatttaaaacatattcatttttttaatgtgcatataccctggcccagaaattccattttaggaatctattctacagaaatattttgcaacattgtttgtctatagtaggtttcaagattttcattttatctttgatgttctacagtttcaccctgttgcatctacagggtatcaatttgtctttattctgcttagaactaggtacatggttttaatctcaggactcatgtcctgttcagttttagaaaattatcagctatttctctttgaatattatctcttcctattttttttctggagctttattagatgaatgtgaagtttcttgttatatcatgtgtgtcttctattttccctttcatatttagcatttttatagtgccatgctatattctatgattatctcggctctatttgttattccatttgttctctcttcactcataacttatttgtagtttaaactgtcatttgactttttaaatatttcattggggctagaactaaaatcttacaatgctcatcccatattttctatattcttcatttctggcctatttatttggtgtacacacaccgaggaaagttgtgctcttgctttatgtattatgttccttttttacatcttgaaaccttcaaacatacaacattttaaagttctttcatacatgagggctacaaaaagatgagaaaaacccaaaaaataaagtcctttcagattactgtattatctgtagtttcttgggacataattctcccatttcttgtatataccaactaactcattccagtcaatttcctcatgtgctttatcatttttttgcatgtgagcttatcttctgcaggaactgttttctgttagaacccttccgtaagaattggactctgagttatggaggtgggtctacaggcggtttttcatttgcctctgctagagtttcattgtgttcctgctctgagccaggttttatgttaagttctcaccccagggtttctgcattatgtgggtactgtgaattttggtttcatactagtgtgcagctcaggtttaaagttttaaacttcttatgggtgagtttatttccacctcatcctaaggaagatgacctacatcctgtttgtagagaagcaatatagcacatttacttacaggcatggtcctggagtcaggatgcctgagtctgaattttagagctgccacctcctagctgcgcaagttacttaaacgttttactccctacttataaaatggggtttataatagtacctaatatcatagggtttctgtgatggttaaataaataaatacatgtaaatcatgtagaacaatgcttggcacatagtaagtactaaataagatttgttattattgtacccctgactatttgggaaatctgcttttaaataataaatggggcagcatccttctactctttgttttatgagggaagcacaattctaactcaattctaagccctacagaggacttataatctcatcctttaaggaatatacctggtcccatttttcctgtgagtggtgaaatgtcaatttatgctcattgctgtgactgtgagttttctcttgtctctggaatctgacagttttcctttcttgcttctggagctcagccatatatttttgggcttaaatttgatccagtatgtctctgtgttttaagttgtgttgcttttaacagtgaaaatattagataaactagctaataatagaggcttgttaaataaattatggtaaattcatcaaatgaaatacaatgcagccataaaacataatgaagtagggctgtatacttacattggctgatatagaaagacaggtgtgttgttaagttaaaaaaaaagcaaggagcagagaaatatgtgagtctacattttatgtacacaaacttaagcctttatgtgcataaaaagatactggaaggatgcacaacaaaaaccattaccactgttacttccagcacggatgtgaagaacggtgccacttttactacttttttcttttcattttaatttttaaaaaataatgtgtaggcatttcttttaaaatcaaataatttgaaagaaataaaaagcaaatatcctccttccttgattttatatcctcctcacaaagcaaaaaagataaccaatactcaccaaacatctacttggccaggaaacaataacgaataggcttcattcccaatcataagaagcccaagatctaaacacagagtgttgcaagaaatgttctcaaagaggtgggggaatagctaactttctcaaagggagtgatatctaggaatgcaccacattgtcctaggagctgggaccttaacaatggggagtacaccaagtacacaagggagttgaaggcattggtaacagtaaaggatctagtaggatattgagagcatattcaacagggaagtgagtggagtttaatgaacggactgtttataacagtgtgagcattgttaagggaaagcaaaaaggatggtgaagcaccccagggagcacttaccaccctgagacctgaaaagccaaggggagaaagcagttaaccagaacctagacagagtagccatagctttagaagatgactgccaaaaaaaagtctgtggctcacagcagatccttctaacaggattcagccaagctgcacccactccataaagagggagccaggagaataaatacgcagactttaacctgtctctgatctccagtcccctgttagtgccttacattggccatatccaagaagaattcagaggacaaggaagccaattcatatggttaccagaggctgggaaggtagtggggggctggggggagttggggatggtcaatgggtacaaaaaatagaatgaataagatctgctatttgatagcacaacagggtgactatagccagtgataactgtacatttaaaaataatttaaggactgtaattggattgtttgcgactcagtgagtaaatgcttgagggtatggataccccattcttcatgatgtgtttatttcacattgcatgcctgtatcagaacatctcatgtaccccaaaaatatatacacctactatgtacccacaataactaaaaatatgtttttaaatgcagtctataaaggtcagtctcggggggtacacaaagaggatgaagaagggtgaaaactggatctttaggggctaacgggaactctctgtatgttcctctcaattttgctgttaacctaaaactgctctaaaaaatagtctatttttaaaagtggatcttgaggggcaagtagagaatattccacaaaggcattttatacagacagagccatattggcaaaggaataatagcaaggaatcttaaggggtatttgagatgcaggcactaccttagtttgattaaattgtcaggcctatggggaggacaaaagtgaattgatagagtgcagaagatgtgaaaagagtatcaacaaactgtacgaggtccaaatttttatatttgcaagctgcctgcccatagtccaaaactggcctgaaaatattttttgtttggttatggatgtgttatatgtgagtttgaatgtgaacatcttagccatgtggactccacaggtcccaccacttgccgttgtctcacatctgatccacttcacttttttaaattaccagcttgccccgatggcatttgaggaagaaacccacattacagcatgtagggaaagcctacaggtttggaaaccatgtcaaattaggaaaagttaagaaaattaagtaattaactttagaaaagggatgacttagaatatgatagtttcctcaggctaaccaaaagctaacataaagaagagagaataggccgggcgcagtggctcacgcttgtaatcccagcactttgggaggcctaggcgggtggatcacatgaggtcaggagtttgtgaccagcctggccaacatggtgaaaccatgtctctactaaaaatacaaaaattagctgggcatggtggcaggtgcctgtaatcctagctactggggaggctgaggcaggacaattgcttgaacctgggagtggaagttttcagtgaaccaatattgtgccattgcactccagcctgggtgacaagagtgatactctgtctttaaaaaataataataaataaaaatttaaaaattttaaaaagagagagacagaatagattcattttatgttgtcccttcatccatttcacaagttacctgttgtatgtcctctatgtaccaggtcctgacagaactgctccaaacagtggaattaggactaaagggtaggtgtttcaggaaggcagattcagactcaatatagtggtttcttactcattttgggtctcagattcctttcaatctgatcaaagatatgggcctgctctgctaaaagatatacatgtacacacgcacacaagtgtcaacatgcactttcaggagattcatagacccattgaaacccatatatggactccagactaagaatctctggagaatacagtagccatactgatacaactgtagctattaaaaagaatgaggtagaataaagtgagaaaaaaagaaatataaaaaatagtgtgtacagtttaaaaatgaattatacacatggagatatgtgtgtataatatacatgctatctctaaaaaattcacaataaactagtaagagtgtttgcctccaggaagggatcttggtggctgggggcagagggagactctagcttttaccttgagtgtgatgacatgccccaggctgatgttagcagaggagcgacatcatctaacttctgtttctaaaaaaattgtgctataattccagtttagaaatgtgggtggcttggaataagttggtagcagtgggagtggtagaatatacttttcactacttgctctttgaacatttggcactttgtatcgtgtacacctaatacctattcaaaaaatgttatgtatcagaaaaggacccttggcaaaaatctttctttttctttttttctttttttcttttactgagacagaatcttgctctgtcgcccaggctgtagtgcagtggtgccatctctgctcactgcaacctccaccccccgggttcaagcaattctcctgtctcagcctaccgagtagctgggaccacaggagcgtgccaccacacccggttaattttttctatttttagtagagacggggtttcactgtgttagccaggatggtctcaattccctgacttcctgatctgcccacctcagcctcccaaagtgctgggattacaggcgtgagccaccgcacacagccacaaagatctttctaggagttaaatagcttcaataatggagcactttgcttaagaatctatggaacttcctggaagtcctcatgtaaagactaaactcactaccagacatgcagtgtcacagagtttggcactgggtgggggattgctgcagatgatgaaggatatctgggtccatctgaagatggcaggaatcttggaattcctattgcacttggaatcattctttattataataatttgaaatttattgagcacctattatgtgccagctaccacattacacactagggatacagcagcaacaaaataaaatccctgccttcctgaagcttatattctagtggtgaagatagacagtaaacaaacaaatcaatattaatatatcagaaaatgacaagtactatggaaaaaaattaagcagagtaaagttgtaggaagcatgcagagagtggcaatttttaaataagatgataaagaaagtatcactgataaagtgtcatttgcacagagatttgacagaagcaagtgaataagcatgacactctatgaggaagaaacatcctagttagagagaaaagcaatggacctctgggagttttcttggtatgtctgagaaacagcaagtaagccatatggctgatctcagtaatcaaagaggagagtgacagggcatgaggtcagagaggtaatgggaatgaaggtagatcatgtagaatcttgtaggtcactctaaagactttggcttttattgtgaacaatataaaaggccacggacggttttgagcaggagcatgacatgatctgatttacatgtttaatggattatgtaatgatccaagtaagaaatgatgctggcttggattaaggttatagcagtagagaagtgttcagattctaaatatacttttaggccaggtgcagtggctcacacctgtaatcccaacaatttgagaggccatggtgggaaaataactttaggccagaagttcaagaccagcctgggcaacaaagcaagacatctgtttctacaaaataataataataataataataataataataataataataataattagccagcactgtggtgagtacctgtagttccaactactgggaaatctgaggtgggaggatcccttgagcccaggagtctgaagttatagtgagctatgattgtgccactccattccagcctgggtgacagtgtgagatgctgtttctaaacaaataaatttttaactattcagctgaaagtattgctgatagataggatctggagtgtgagagaaaaagggagtcaagtcagactccaaggctttggcctaaataaccagaagaatggataaagaaggctgtgggagaagcaggtataaggaaaatagtcactttgaccttggataatttcaagttgagatgccaatcagacaacctagttatcatgaaaatgaagacatacctgtaaaggatattaagaaatagtagctagtgaagtagaaagagccaagaattacatggtgtcctggaagccaagtggaagaaaaaagtgtttcaaggagagagtgataaactgtgtcaaatgccgctgttgggcgaaaaaaaaaggagaacagtaaaatgaccattgaatttaatactgaggagatattgttgaccttgatatgaatcattttggtggagtgatgatggcaaaagcctgactggagaggattcaagagaaaatgagaggagagaaattggaacgaatgagcagagacaactcattccagaatttttgctctgaggaggagagaaatggggctatgacttgggtgaagagaacagattttttaaacattgaagatgttgttcaatgaaagaaaaattgatgccatgagggaagagtgaatgacttgagtaatgaccttgattaggcaaaaagaaataaaatttagtgcataagtagaggagtcagcattcagtggaatcccagatggttcgctcacagtgacaagagggaaggcagagtttatggatacaaatacaaatagattggtgggagttcttttctgacaacttctattttctcagtgaaataggaaacaaggtagcagctgaaagggaaaatgtagaaacaagtgtcggaagtttgaggaaaggaaagatgtaaaaaagccacccaggagcattcaagaatgaatggatgaaatgaatgtagtgaagttagcagatagtactaagggcccatttgaagttagtggtcctgaatctaaagcgagactggttagcacggttataagcttttatccaatctcattcggctgctggggcaggttgggaataaagagagtaggatttaacaacgattggatgtctgttattcaaatcacatgaaagcagagagagcctagggaatctagggtgtatgctaaacagtgactttaaggatggttatagaatctaagctgatcaaagaagaaaatggagacactagggggctgagggacagtactctatagtttagcacgtaattgttctcttaacttttatcatgtaagggctgaaaagtgtccattcttgttagcaagtcactagtcattttggagtagtgttctcataattgcatttttcagaaccactagtccctcaccaccatctctgtgagtgaggtcacaaaaattttcaaatccggtataccccattagtttttggagattcacattacctgttgacctattaaggactctgaatattctcgcagccaggaaaccacatttgactaatccagtggtttgtaacattgcttgttcatggagctctttatgtaatactatcaacatcaatcctcagaaactagtactccatggaatacattttgagaaatgctagcttaggaatcatgttggggattggaagctgacttttaggataaaacctttgttgggccagagtcatagcagcttttctccaagacaatatgcatggcaggaaccaacacatgtcctccccgggccatctctctattctgcagctgagccagtctgcagagatttcggttctatctagttcccctaaagccaaataaacctaatattgtcaatacagctaattccctagttttcattcagctgaagtttcctgatgttatattttcaataattcaagagatagtattgtcacaatgcactggaagcagcatgcatatttactaaccacttccttgtgtcaggcactatgcttggcactttgcatagatcacctcgctcactctttgcaataatattgtgagaaggtatatattattagaaaacacccagaaagatcatgagcaaccagttttcttcagaaacttgttgcctggaagaaggaaaataggtttagtctgtaacaagcaatgtgttttgcacagacagatttgaagccctaggaacactgatagaatcagaatgttggagccaaaaggaaccttagagatcagtttaagatattagagagagattattgcattctccccaaaagttattatgtaaattgtctcaggagagcaggattaagaaatcttgccataactgcctttgctttcatttaaattaagccatatgaaatgatattgtcacatgaactaaagcatatagatcacgctacaagaatgcaataaggtaagtgattattggctggaattgtaaatgaacatttggagtttattctgtatttcaacgtcatggaagcctgatttcaccagaaggcaatggttctcaaacttgaatatgtatcagaattattccagaatcttgttttaaaatgcaggctcctgaccctatcttcagatatactaactcagtaagtctgctataaaggaccaggaaactgacatttttaactagctccccaggtgtcactcagtggaccaccacaataggcggcccacaaactgaccacaatctgagaaagacatccctgggaatattctattcataattaaggtgtgagcaggccagtgtcaactggtcagctagggcaattcccctgcaaagacactgatgtagaggtacaggaagtccctactgtttctagattcccattttcctacagaatccttgtcttaatgtgataatgaactcctagagacatcttccttgtgacctgatgcagggagctgaggctcaggaacaaatatagttggcactacagggaatatttctggatataatattaaggtacacaaaaattccccctgtaagctcttagatgattagacattcttcggtagacttagaatattatgctatcccattatattatggtcacatatatagtaaagaaattagtatggctggcaggctgtgggatgcttatactctaaatggaccttggtcctattcaggatccattcatcagcttcacaggttccaaaactcaattttttccattttagccagggattgatcaggctctaggggacaaatttcacacaacctaaacttataaggcaataatttggaagccaaaatgtcaatttattaattcatcttgataaatcccagtaggaaatctacttaggaaaccaaataaagacaaaaggctgtttgtttggtgggagcagcctgctttagttagtggaaagagccagagttttggagtcagataggctagggtcccagctaggctatacatagtgggttgaattgtgtcaccgcccccaaaagttacatccaactggaactgcaaaatgtgaacttatttagaatatgactctttgctgatgtatgtaagataaggatgtctacatgagatcatcctggattagggtgggctgtaaatccaatgataagtgtccttataagtgacagggcacagagacaagggagaagcccatctgaagacagaggcagggattggaatgatgctaccacaagccaagcaacacctggaaccgctaggaagaggcaaggaacagaatctcccctagagcctttgtagggagcatggccctgccaacaccttgattttgaacttctggcctccagaactgtgaaagtataaatatctgctgttttaagccaccaagtttgtggcaatttgttatggtagtcacagaaaactaatataccactcattccgttttatgggcttaagtcacataacctctctgagcctcagttccgtcatttgaaaatggaactaataatagaattctatgatatcatagagttgccttgaggattaaataagataatttatgtaaagtgtttgactctgtaggcacttgttatatggtgactgttattactggtgagtgaagagatagtatatggtgtgggatgatctgaagagatggagtcatgtagtttattcagtctgatgcatccatgcatcaccctatcagaaagtcaataaatgtgtcagtaggccagggcacagagtaataaaagcaacttctctttctaattatttttatttttctctctataatggtcaaataacttgtttgtacatgtcacaatatcatgaaccccgtcttagttatatggactttcccagccatagcatttccaaggctacagttgtgttttccactgattacattttagagcattactccttaatgacacatagggaggtcccttatctatcagtaaatacttttctgtgggcagccaatctcatttctacagtgggcaatttcttttgtcagcttaagcccctgagaatggcatgtttctaccctatcagttgaccttaattctagagttggtggccctattccctctcagtctgtagccctctgtccatttttcaaaactccacaaattcacagtgctgtgtctactttctcacccacctgtttgtaaagagaaaattccttagcttctgcatctgacactccattcccacccatatagccccaactagtgttacctctggaaggccaaggagatcatgccctattcatctttgtaggtactgcctagtgtgctgcatggcatatggtaaatatttgttgaggtgacaaaaaacaatagataaatcttggctctggagttgggcagacctgagttgaaatgctagcttccttttctgctggttgtggggccttgagcaaattacttcagcttttagtacttcagttccttcatctataaaattatgatagtatatatcacttaggtgttttataagaattaaatgaattaatatatataaatcccccagcacaataccacatacgtagtgaatgtttggtaaatgttagcaatgtgtggaagactatataaaataatgaatgagtgaaagtgcattttcaataggaagtcatataactacaggatatctttagtgcctgtaagagatccaaggaagtatgaaagaacagtcagtaagaactggtaaatacttcatttatcatatttcctaccatgtgattcttaccattaggagtacatgaaagctgaagtttttcagaacaaaccattcacattgaatgcatggaaggaaaatatcatctcatatcataagagtaacagtcgcccagcttctgggagtacttcagaatatgattaagtgttgaaaagcgtagagttgtcaatagaagctattgctagcagttgtttcaaattaattaaaaatactgatttcagcgttctggttttagtacagagtatttgagttattattgttattagagggagtctgagtcaggagggttaaatagacaaatgacaacattaaaggaagtcagatgaaatttcacacattgggagaattgcacaggcaatgaaagcaacttttactttatataacaagcttaagttttagtgtagggatgaggggaaaaagaaggaaggagagttgatatgctgcaaacccatccaaagctagattttgttcaggattctgcaccatcaatggctctgttatatatatatattttttattccacagctttccaatctcccactgatgcattcattcagtaaaataaatcatgtgcctactatatgccaggtactattctagatgttggagatacagcagtaaacaaaagtccttgccctcctggaatttacattctagcaggggtcagtacactatggcccattagctaaatctagcccgctccctgttttggtaaatacagttttattggaacacagccatgctcatctatggcagcttttgtataacaatgatagaggtaggtagttgtgttaaagattacgtggctcacaaagcctaaaatatttattatctggacctttacagaaaaagttttccagctcctgttctagcagaaggagatagatgataaacaaataaatagataaacatataacatctgctagtattcaaagtataaagaaataaaacatggaaggcagatagagaatggcgagaaggcgcttgcaatactaaatatggtaatcagagaagattttaccaagtgggatatttgatccatcacctgaaggacaggagtatgtcaatatctgggttgcatacagcattatgggccattataaggggttttgttgttactgagtgtcagatgggaagccattggaggagttttgagcagaggagtgacatgatctgacattcacataataaaattatcctggttccaaaaaacagtgagagaataataggcttgagtgatggtggcaagaacagaagcaaggagaacagttgagaggctagtgcaatataatccaggaagcagatcattgtgacataaaccaggatagtagcaatgaaaaagtggtcagattctagatatattctgaaggtagaaccaataagatttgctgatcaaataaatgtaggatatgaaagagggaaaaatcaagattgattcctaggtcttccgcctgagcaaccggaagaatgaaattggtatttagggagacggggaagactgtgaggagcaggttttgtgagtgcagcaggttttgttgggggttgtgggcaggggcagttttgaacatggtaagttggagatacctattaggcatgcaagttgatatgtccagcaggcaattgggcataaaagtatggagatacaaatttgtgactcatcagcaaatagatagtatattaagccacgaagatcggagcatcactaagaagataaaggacagaagatatcttaggcttcaagccttcctctacctttcaactccagaagtcagtccgtgacaaaatcctatcaattcttcctgtataatgtctctcaattcaccattttccttccattcccactgctaccattgtagtccaggatctcaccttgtcttacttggcttttacaatagcctcctaactggtttccttgcctccaaatgtcaacttgaaactcatcatctcatttgtccttcccctccaaaaaaatctttctacttctcctgggctctctatcttaaagaatggcatcactattcataagcatttgcttaaacttgaaaatttgaaatcctccttgtcacctccctttcttctactctccattatgcaattctattaccaaaccctgacatttttacctccaaaatataactcaattctgtccaccattctctgtctctattactatcaatctagttcaagataacatcacctcccacctggacaatggtaatagcctcttgactactcttcttccctctagttaatctcccatatgaaaaccagtggaatctttctaaaacagtgctatgcatattttgcctacctattctgtaggtccacagaataaaattcaaaagcccttcatcatttgcccataacttttctttccaatggtatctactatggcttctctggaaattcccctcatttcatccctgtgggcttgtcagtggtctttagacccaccatgaccacagtgtgcccccaatacctagtgcagaccttcccaaacatattacaagtgtctgaggctatgagatttcttctctgtcctcaactgagcccagagacagtgctgttgaaactcctagaatgcttgcctctagatgtcaaactgcttcctccattcagcctagtgtgctttacaaatactatgcttttctctgcatgccatgacacaataaaggttgtgaaggactgctttaatgcacaccattcccagagtttggaaagtgctgctccattctcttctctaagttctaagtacccttctatgccaagttcaagtctcacctttctgataaagcagtctttgatgctacatatccaacctcaaaattcttgtatgatgtgaccagaccactcatttggcacttagtatatgtgctgctatttaactttttatggtgagaccttatctctctgtgttgtctgttgcttaagagcaacaatttttataccgacttttgcacccagggccttaccatacagtaagacactcagtatatttttacaatattaatgaataaattaattaatgaatagatagttaaattccatcagatggtgcaatggacaagaacattagattcagaatcagagaatctggattctagtgcactttgccactagatggttgtgtgagacttcaggaaagttgcttgccttagttgcctcattcacaaaataggaacaatacttcccattgtgacttcccaagttgagatgggataatttatggaaaaaatatttggcagatgaaaagagcatgtcgttcatgagtaatgccaaaagaggcagtgtggaagataaagaatgagctcaaagaagctgcagaaaacattagagggttcatgggtgaaaaaaaagccaaaggggtaagggaaatttgctagcaaagtagacttgcccaggagtgattgagaaaggatgataaacacagaagaaagaaaaatcaagtttctgttgcgaagcagtataacacagccactagatccagactgcctaggttcaaagcctggctctggcacttaaccagctatgtgaccttgaacaagttatttaacatctctgaacttcagtttactcatatgtattatgggggcaataataatgcctatttccagggaagtgttataagatgtaaaggagttaatacttataaagtacttagagcagtgcagaccagtgcctagcatatagagcgttatagaagaacgtgttagataaaataataatcttctccttaccaggcaatactccagtcctcatggctggcactttctcctgggacctggagcagggctcacgaaagttctgacttgctctccagtgggcacgtctcctttccacattccagagcccagtcctctgagcttagcctatctcactgctcaaaggacactatgtttcccagcctacaaagtttcttttcaattctttagcctttttcaaaacccaatagagttccttgtgagaacagataggagtgaattccataagctcccagaagcaaatacagacagtataatctaatcttttagagcaatggctttgtaatcaagcaaaagagagtttgaatcagggctctgtaaatgaccaactgagtgaccttggacaaatccaaggtctgagcctcagcttgcttgtcttcaaaatgaggcctcacaggtggttgtcaggatcaaatgagaaaatggacatgatgcattcagtatagggcctggcatgtggtaagcactcagaaagtgttagctcttatcattaataattcctaggattatgggtctcgattttcccaactctagaatgtaatttaatagcactatagctcttatccactattcctctgtcatctcaatttgacccttccaaactaaaaaggtgcaaaaaaatattcttggtgtgataagttgacaacactctgcattttacactccctttgaggtttatgcccagtttaaaagaattacagagaaagaacccgcaactctaagtatgcttcagatttccatatgtctgtaaatgcctcaaagacagcagtggtcctcttagcctagggtgaacatcaaaatcacctatttttatttttaatttcattaaatataattcttctgataaaatggcaaagaattttttttcaaaatccttgcttttaccctagaaatgatactcctcatgaaacaaatgtccaatggggagacagagggccaggcaagtatattttgcaaaagttatccaagtcagtctcgtaaacacccctgatgtgagagagggactggaacatgcatttggaggatgaggccagggtcttgccttgagaaaaaatccaagaagggcaagtataaccactctgcttcccacacaatgtgggtatgtagaaacatgccctgcacccacagggaagagcatagtattttctcctgcatgcattaatcacagaggatttccctcctatagttatacaagcatcatccttgacacatcagttggagaactgtactcagtgagaatacaagattcatccagctttgaaaatgtaactatatctaacaactggattaaatatatttcatgcccaaagatctaatactatttaaagcctacagcaaggaagaatgattaccaaataatttaattatttttggtttacacatctgtcatcaaagttaatcgtttgctggcagaaactggccatttggtcttgaccatgatcactaatgagtgtgcttgcatttcatatcaaggaaacagtctctcaaatggttctaatcaaataaattaaaagctgaaatacttttaaaaaagtaaaaagtgtaaaaaggcacaatttataagatttatgaagtggttactttttcttttctgattttatgtatatctatcactcaacacttgctgtgaaacatattagatacacctacgttactttggaggaccaccaaatatttgattttcccatgtatttatctaaaaatgttattaaattttcatttaaatctttcaaaaatagagtgttaaatttcatgtatatgtgtgatctatactaatagatctaagctaatgtatacatactcagttctcatttttctatttgcaaaattcaaactaatgaattagtttgaagaaagaagaaagaaatgaagaattttgaaaagtaattctcaaaatgcttaaaaatagatgctaaattcattgagctactcatttcaatattttaatataagaatgcaaaatttgtaatgtagtagttaggtacacagacttgaaaatcagggagaagtgattccattttccttctgctctcttgctaactatgcaacctcaggcaagtaactgcacttctctgagctttagttatctcatctgtaaaatgaggataataatattatatgtcataagggatgtggacattaaatatgataatacttacaaaatattattattttttcctttcaaaactatttttaattgacaaatgataaggtgtgtatatatatatatggtacaatgtgatgttttgatctatgtgtatattatagaaagattcaatcaagctaatgaacatatctatcacctcgctaatttatcattattttgtggtaagaacattaaaaagctattcttttaccaattttgaaatacacaatatattattattaactgtggttaccatgtagtgcaatacatcactaaaagttattcctctagttggccagtgtggtggctcacacttgtaatcccagcactttgggaggccgaggcaggtggatcacctaaggtcaggagtttgagaccagcctggccaacatggtgaaaccccgtctccactaaaaaaacacaaaaatcagctgggtgtggaggtacatgcctgtaatcccatctactctggaggctgtggcagaagactcacttgaacccaggaggtgaaggttgcagtgagccgagatgctgccactgcactccagcctgggcaacagagtaggactctgtctcaaaaaaaaaaaaaaaaaaaaggttatgcctccagtctcactgaaattttatataatttgatcaacatcttccctttccccaaccctcctcctccccactaacctctggtaaccacctttctgttctttgtttctatgatatccactttttaagatttcacgtaggagatcacacaatatttatctttctgtgcttgccttatttcacatagcatagtatcttccagttccatccatgttgttttgaatgatagaattttcttattttttaaggctatatagtattccatcgtgtataggtattacattttctttatccattcatctgttgatggacatttgggttgcttccacatcttgactattgtgaataatactaaaatgaacatgggcgtgcagatatctctttgacatactgatctcaattcctttggatttatacccagaagtgacattgctgtatcatacggtaattctatttttagttttttgaggaacctttatactgttttccaaatggttatatgaattcaccttccaatcaacagtgtgcaaggattctcttttcaccatattctcaccaacacttatcactcatctttttgataatggccattttaacagatgatacctcattgtggttttactttgcatttccctgatgagtatagatgttgagcattttttttcacatatctgttggcaattcacaactcttaagaaatgtctatccaaatcctttgcccatgtttttaaatttttaaaaactttagagacagggttttgctctgttgcccaggctgaagtgtggtggcacaattacagctcactgcaacctccagcctctgggctcaggtgatcctcccacctcaccaacctgagtagctaggactataggtgtgcaccaccacatcctgctaattaaaaaataattgtgtagagacaggggtcttgcttcattgcccaagctggtcttgaactcctgccttgcccattttttaatcaggttgttttcttgtgattgaattgtctgatttccttatgtattttggatattagccccttgtcagatacatgtttcccggtattttctaccaatctgtgagctgtcccttcactctattaattgtttcatctgctgtgcaaaagctttttagtttgatgcaatctcatttgtctaatgttgcttttgtcgcctatgtctgtgcttttgttgcctctgctttttcttgttgccaagaaatcattgtccagaccaatgctgtggatctttttccctattttcttctagtagttttacagtttcaggtcgtatgttcaagtttatttatttcgaattggtgagagataggggtctagtttcattcttctgcatgtggatatccagttttcccaacaccatttattgaaaagactgtcctttccctattgtatagtcttggcacctttgttgaaagtcaatttatcataaatacttgggtttgcttctaggctttctgtcatgttccattggtcaatatgtctgtctttatgcaagtatcatgctgttttgattataatagctttatttaatatacagttatctcttggtatccataagtgattggttccaagacgtcccacagataataaaatccacaaatgctcaagttcctgatataaagtggaatagtatttgtatataacctatgcacatcctcgtgcctactttaaatcatctctagattatttataatacctaatacaatgtaaatgctatgtaaagagttcttatactatattgtttaaagggaataataacaagaaaaaagtatgtacatgtaaagtacagacacttttttgggaatatttttgatccacagttggtcaaatccacaggtgcaaaacccatggatacagagggctcgctgtatgttgaaatcagggagtgtgatgcctccacccttgttcttcttactcaaagttgcttcggccattaagagttttttctggttccatatgaattttaggttgttatttctgtgaaaaatgacactggaattttgacaggaatttcattgaatctgtagatcactttgggtggtatggaaattttaatagtactaattattccaatccatgagcatgggatatctttccatatatttgtgttttcttcaatttatttcatcaatattttatagtttttactatacagatctttcacctacttggttaaagttacttctaaacattttattttttgatgcaattataaataggattttcttaatttcttttttagatagttcattgttagtatatagaaacactgctgatttttgcatattttgtaacctgaaactttactgaatttgttcatcagttctaacagattttggtagagtctttaaggttttctatcattctcaagtacacatggaacactctccatgatagatcatgttaggccacaaaacatgcctttacaaatttaagattgaaattatattattttttctgaccacattggcatggaagtagaaatcaacaacaggagaaccttgaaaaactcataaatatgtggaaattgaacaaaacaatatgttcctgtacaatcaatgagtcaaagaaggaaatttcaaaaggaaattttgaaatatcttgagataaacaagaatggaaacataacactccaaaacttatgggatgcagcaaaagtagtcgtaggagggaagtttatagcaataaatgcctgcatcataatagaagaaagctcttaaataaacaaacattacacctcaaggaactagaaaaagaagatcaaagtaagcccaaacttagcagaaggaaagaaataacaaagattaaagcagaaataaacaaaatagagactaaaaaaatttagaaaacattgacaaaactgaaagttggttttttaaaaagataaaattgacaaactgttagccagactaacaaagaaaaacagagagaagactcaaataaacaagatcagaaatgaaagagaagacattacaactaataccacagaaatacaaaatatcataagatactactatgaacaaccatacacaaacaaattggataacctaaaacgagtggataaattcctagaaaaatgcaacctaccaagactaaatcagaagacatataaacgtttcacaacaatgtctggcattgtgctaagtgaataatgaatgctataagtttttgttattatttctaccagaatgtaagcttcatggtggcagtttttttccaccttctctgtttggtccagtggctaacatagtgcatgttcaataaatatttgttgggtgaattaatttatgtggcagttatctgtctgaaagacttaggggaactgcttattaattattccactgcttctaatcacacttggcagctgcatgagtaattcaaggtgaaatttttaaagaggctttattgagaaataattcacataccatatactctctccattccaagtgttcaattaaatggtttttagtatattcaaagagttgtgcaaacatcaccataattaattttagaacattatcagcaccccacaaagaaactccatgcccatcagtagtcactcccattacctggcaaaccctctctccaccccacccctagggcaccaccaaatgacttcctgccaatatagatatgcttattctaaacatttcttatgcatagactcatacaatagatgggttttgtgactagtttctttcatttagaatagtattttcaaggttcattacatgttgtagaatgtatcagtattccattcatttccattgtatgggtataccaccatttgtttatccattcatgggttgatggatattggagttgtttccacattttggctataatgcagccatgaacattcatatccaagtttttgtgtgaacatgtattttcatttctcttgggtatatgcctaggaatagaatttatgggtcatataataactctatgtttaactttttgagaaaatgccagacaatcttccacagaggctgcaccatttaatattccctttaggttccattttctcctcatctttgccaatatttgttattatctctttttaaaaaaagttatagccaccctagagggtatgaaggggtatctcatggtggtttgggtttgcatttctctaacaattatgctgaacatctttttcttgtgctaattggccatttgtgtatcttctttgtagaaacatacattcagatcttttgccttgcctgtttttaaattgggttgtctttttttattgagttgtgtaagaattatatattctggatacaagtacttatcaaacatggtttgcaaacactttcacatcttattctctgggttgtcttttcatttcctttgattcattaaagtttttaattaagatttagtcagtttatcatttttttctcttattgcttgtgttttttggtgtcctatttaagaaagtatggcctaattcaaagctatgaagatttacatctatgtttccttttaatagtgctataattttagcccttacatttggatctttgctccattttgagttaatttttgtatatagtgtgaggaaggggtacaacctcattcttttgcatgtgaagatgcagttgtctcagcactatttgttaaaaatactctgttttcctcgtggaaatgtctgggtgcccttgatgaaaatctatcaaacataaatgtaagagtttatctctggacccttcattctattccactgatctatatgtctatccttatgtcagtaccatactgattgttgtagctttttagtaagttttgaaattgggaagtgtgcatcctccaactaatgtcttttttaagattgttttggctattctggagcccttgcatttccagatgaattttaagatcatcatgtcattttttgcaaagaagccactgagattttgatagggattgtgttgaatctatagatcagttagagtagtattgctgtcttaacaatattgtctcctgcacaccacgaacatggaatttctttccatttacttatgttttcttccacttctttcaaaaacgtttcatagttttcagtgtacattcttacactttcttggatacatttattcctattttattcttttgatgcaatgaaatcctttcttttcttttcttttcttttttgagacagggtctcactctgttgcccaggctggaatgtagtggtgcaatcatgactcactgcagtctcaactggccaggctcaagtgaacctcctgcctcaacctcctgagtagctgggatcacagggtgcgtgccaccatgcccagctaattttttttattattatttgtagagacgggggtctcactatgctgctcaggctgttctgaaactcctgggctcaagcaaccctcccacctcaccctcccaaagtgctgagattacaggcatgagcccccatgcccagcctggaatcgttttcttaattttattttcagattgttcattgctagtgtgtagaagcacaactgatttttgtatatttctcctgcaaattgctgaatgcttttatttactttaatagttattttgtgggttctttagggttttctatgtataagatcaagctatcttcaaatagagatcatttgaattcttcctttccaaactggaggcctattatttctttttcttccctaattgccctgttgagaacttccagtacagtgttaggtagaagtggggtgagtgaacatcctcctcttgtttctgatcttagcagaagagttttagtctttcaccattaagtatgatgttatctgttgggtctctataggtgctttttatcaggttgaagagtaaggtgaactttatttgaaactagaagcccctcaccaaagatggaaacctcaggcccacttttattttctctcttctggtatggcacaattcttctgtttcatattctcaaaacagggcgagaatgccttaagagacagacctataccttattctggatttcaaactgggaacatttcacttcagatggaagtgtttttgaaagatagcctactgagaattgtatagatacttaagaattcatttgtaaaacataagatggcaggctttctttgagccatgactttatttagcttgattaagtctgtgttctaccggtatacgtcatcttttccttaatctccttgatgggagaatgcgaaatgggagacacatacaggactttcttatacatgatccctagagatgcagtggcatgtatgataagactgcctgggttcattcaaatccttgctctgcctcttacacatttgacaagtaatgtgtatgtatctcagtttcctcattttgaaaaattaagatgataaaactataatgataataatacctaactcagaattgttgtgaggaataaatgaattattatatacaaaaagtactaagaacagtataaaaatactaaaaacagtccctgacaccatcgtaaactccatttatgtacttccaattaggctatgttgttcagtaataacaacacaggtttaagagccagataaatccaggttgaaattcctgcccaactgcttttaccagctgaatttggtataaaaacacaaatgaactgaactttgtttgcctcaaaattcatacgttgaggccctaatctccaatgtggtagtatttggaggtcagacctttgagagggcaactggggttaggaggtaatggggtttgccatgtgaggaaaccaggaagaaggcctgcaccacactgagcacattggcaccctaatctcaatcttggacttctcagtctccaaaactgtgagaaataaatgtttgttgtttaagccactcaatctggggtattcttgatatagcagcctcaacaggctaagagaccagctatgtggcctctgacgaattaatctctctgagatttagttttttcatacctaatcgggtacagaacctacttttcaaggttattataaggcatgcattagataattcctgtgaaatatctaactcaagataattgttggacaaatggcaactattattgttgttactttatttttattttcttcttttaaggccaatgagatcttatcactgaatttcttttgctcatttaacagttcaggcctggggatgataacagcaaatggcataaggggcttttagttttttaaaagtaatatatacttgtgaaaaattcaaattttacaaaaagtgaaaagtaaaaacctgttttcatatgcatttccctgcccattttacttcccctttcttagggttagcaacaaggaaaagaatttgacttatatccatccagacctttttctatgcatatacataaatgtgaattatacataagaacacatacacatacatatatatttctacataaattataccatattatatattgttttgtgattttctaattttactcgacagtatatttttgatatctttccatttgaataaaaatctacctcattcttcttaatagcaatacaataacccaagagatggaagtatcactggtttactttttaaaaatctttaataattgctctcaagataatatcataagtctctagttgcagtgtgctttttctctcaaagcctgtgtttaacaatgtagtatgtaaatgtgtagtttaaagcaaattcatagtttgcatggatcgtgagtgttttgttgaattctaggttatagggacagaatggaaagctaagtacttagtcaaaaagagacttctttagataggtcagaaggaaaaacaagtcatctaaattattaccagcttttaaataatttttcctggtgggttctagtgttgaaagaataaatgaaaaagaagactgaagtcgaaatcagtaagttcaacaaaagccttgaaaagcttattaaatacaaagtaactgttgatctggtggaaaaagagcactgaagttactacaataattaatcttttgtactgagaagttgctataataataattcttttggatgagaaatgggccaaaataattgagaaatgccaaaaaaaggtaaccatgtagtcagatgattacgtttacatacataaattcacaaaagagaaattaaaattaatgcttccagaataagcaaaatacattgtgtcaatttccaacaggtccaaactgtctgtgtgctactaatggaagtgtcagaattctgggcaagtattcacaaagatcagaagtgtcataacactgaagccatgtgattataagagaagaaaatctgtatagatggaatcatgtgtatagatggaaatgtcactcactgtaatatctgagcaggaggttgtaatcaaagcacttagcaattagaaagtacagggccctaactcccacagaatttttgttacaagcagctctgacagcacacagaactgttgtaagatactttgtgagaaagctttgtcagtggtaatgcctgctttaataacatctggaaacagctgtttttctccaaaagacagcaatatgtctaagcctgccaaatacagataataaggtgcttacctatcattaacaaaattatgctttccttattgacagaaaagatctgttcacattgtgagaagaatacattacagaattagcgaagaactaacaattgaaaagcatcacacagatggctgccaagatgggctgcttcccagcccaaaatctgcaaccctctaaggtggctacaattatcctgaggttcaccatgagtttttttgaaaatatctcaaaacaaaattatacatgaggcactttaattaaaaatatatatgccatacagcatttcgaagaaaggggaaagatggcatgaaagcaagctaacaatagcagggcattataaacttccacaaggttgggagccaacaatagtaagattcagtggcagtttttatgaattcagagcattgtgccaaggcacattgtcaaaatgtctgaaaatttattttaatgtcagcaacaaaattattcattcattgaagaaatatttactgagggaatactatatgtcaggtaccaatacacacattgcctgctataaagtttgtatcatcaatgtataggaatgctggtattcctgagcccttctaatagcatcttaaaaatgatatttagcggccccgccgacccacggcccacgacccaccgacccacgaatcggcccggcccccgcgttcaccatgtctggcttctccagcgtcgccgctacgaagaaagtggttcaacagctccagctggaggccgggctcaacagcgtaaaagtttcccaggcagctgcagacttgaaacaattctgtctgcagaatgctcaacatgaccctctgctgactggagtatcttcaagtacaaatcccttcagaccccagaaagtctgttcctttttgtagtacaatgaatctttcaaaggtttcccaaaccacttcttatgatccagtgaatattcaagagagatacatttgaagcctgtacaaaagcttatccctgtaacacatgtgctgtaatatacaaaattctacttttgtctgtccttaacatctacctctgaatttttatgaatttctacttcacaagggtaattgttttatatacattggcagcagcatacaataaaacttagtgtgcaagttttaaaaaatgatatttagcaatatcatattagtgaaaactagtaacttattgtggtttattatttctttgaatactagtgatatttgacactttttcatatgtttattgattatatgaccatttgtagttcctttttgaataatctactcatagcctatgtccacttttttttgactcatccatgtttctgtttatatacaggataacaaattcaggaacaatgggaaagtaacatataaaaatttaataggaaatacaatagagattataaaacactaccatttgattttttatgcaaatacttcaatattccaattttttctcacttgctaaataaagcacacaacttgaaatgctaaataattgtgttactgtaaatcttttaaagaataaaatgttggtgaaaaaccaaaattgcttagtaaggtatgtatgaccttgtttattatctatcatagacatcaagatgatcatagttaataccaacttaagctttacagaatactgttttaggcccaatattgatataataaatgaaggtatcagagaaccttgtatttatggcatcaggttataaagatctattcaaaaccatttttgtcaaaatttaaactctggaacaaaagtcaaattgtttctaaatgagacacaaaataattattgctaatagtacaaattttgtcctatgggtaatactattgtatttttctttttaaaaaaattatttcaatttttatttttgattcagggaacacatgggcaggcttgttagctgggtatactgtgtgatgctgaggtttggggtatggatgatcccgtcacccaggtagtgagcagagtacccagtaggtagttttacagctcttggtccacaccctccctctgcagtgtctgttgttcccatgtgtcctcaggtattactattttcaagtttttttctttttatatatatatatatattttttttattacactttaagttctagggtacatgtgcacaacgtgcaggtttgttacatatgtatacatgtgccatgttggtgtgctgcacccatgaactcatcatttacattaggtatatctcctaatgctatccctctcccctcccccaaccccacaacaggccccggtgtgtgatgttccccttcctgtgtccaagtgttctcattgttcaattcccacctatgagtgagaacatgcggtgtttggttttttgtccttgtgatagtttgctgagaatgatggtttccagcttcatccatgtgcctacaaaggacataaactcatcattttttatggctgcatagtattccatggtgtatatgtgccacattttcttaatccagtctatcattgttggacatttgtgttggttccaagtctttgctattgtgaatagtgccacaataaacatacatgtgcatgtgtctttatagcagcatgatttataatcctttggatatatacccagtaatgggatggctgggtcaaatggtatctctagttctagatccctgaggaattgccacagtgtcttccacaatggctgaactagtttacagtcccaccaacagtgtaaaagcattcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgtttttttcttgtgaatttgtttgagttcattgtagattctggatattagccctttgtcagatgggtggattgcaaaaattttctcccattccataggttgcctgttcactctgatggtagtttcttttgctgtgcagaagctctttagtttaattagatcccatttgtcaattttggcttttgttgccattgcttttggtgttttagtcatgaagtccttgcccacgcctatgtcctgaatggtgttgcctaggttttcttctagggtttttatggttttaggtctaacatgtaagtctttaatccatcttgaattaatttttgtataaggtgtaaggaaaggatccaatttcagctttctacatatggctagccagttttcccagcaccatttgttaaatacggaatcctttccccatttcttgtttttgtcaggtttgtcaaagaccagatggttgtggatgtgtggtattatttctgagggctctgttgtgttccattggtctgtatctctgttttggtaccagtaccatgctgttttggttactgtagccttgtagtatagtttgaagtcaggtagcgtgatgcctccagctttgttcttttggcttaggattgatttggcaatgcgggctcttttttggttccatatgaactttaaagtagttttttccaattctgtgaagaaagtcattggtagcttgatggggatggcatcgaatctatagattaccttgggcagtatggccattttcatgatattgattcttcctacccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctttctgcttgtctgttattggtgtgtaagaatgcttgtgatctttgcacattgattttgtatcctgagactttcctgaatttgcttatcagcttaaggagatttggggctgagacaatggggttttctagatatacagtcatgtcatctgcaaacagggacaatttgacttcctcttttcctaattgaataccctttatttctttctcctgcctgattgccctggccagaacttccaacactgtgttgaataggagtggtgagagagggcatccctgtcttgtgccagttttcaaagggaatgcttccagtttttgcccattcagtattatattggctgtgggtttgtcataaatagctcttattattttgagatacgtcccatccatacctaatttattgagagtttttagcatgacgggctgttgaattttgtcgaaggccttttctgcatctattgagataatcatgtggtttttgtctttggttctgtttatatgctggattacatttattgatttgcgtatgttgaaccatccttgcatcccagggatgaagcccacttgatcatggtggataagctttttgatgtggtgctggattcagtttgccagtgttttattgaggatttttgcatcagtgttcatcagggatattggtctaaaattctctttttttgttgtgtctctgccaggctttggtatcaggatgattctggcctcataaaacgagttagagaggattccctcattttctattgattggaatagtttcagaaggaatggtaccagctcctccttgtacccctggtagaattcagctgtgaatccttctggtcctggactttttttggttggttcaagtttttttctttacatgaaactactgaaagcaaaagtatgtcatgcttacaggttactctatgcatttatcattctattaataaatgtcttaagtaattaagtagtatattaaggccataaaccaagtcattatctcatagcaaaggactattgttattcaatcatctagaaaatgcattttaggccaagtgcagtggctcatgcctgtaatcccagcactttgggaggccaaggcaagcagatcatgaagtcaggagtttgagaccatcctgaccaacatggtgaaaccccgtctctactaaaaatacaaaaattagccaggcgtggtggcgtgtgcctgtaatcccagctactcaggaggctgaggcaggagaatcacttgaacccaggaggcggagggtgcagtgagctgagattgcggccactgcactccagcctgggtgacagagtgagactctgtctcaaaaaaaaaagaatattcattttaatgtatgcccacttttttaatggtcttttagttattgattctaaaaggctctttatacattactttgtcatctgtctgacattattacccccagtggatgcctgaaatggcaaatagtactgtaccttgtatacactatgttttttcccatacatacatatctatgataaagtttaatttataaattaggcaatatagagattaataacaatagaacaattatagcaatatactttaataaaagttttttttatttactaaattgagaatatttagcttttatttttttttctgttttttaaaaatgagacagggtctcactctgtcacccaggctggaacgcagtggcacgatctcagctcactgcagcctcgacctcccaggctcaagcaatcctcccacctcagccccccaagcctcttggactacaggcctgtgccactatgcctaatttttgtattttttgtagagacaaggtttcaccatgtggcctaggctggtctcaaactcatgaactcaagctatccacctgcctcgtcctcccagtgttgggattacaggcgtgagccaccgagcctggcctacattttcattgaaaggaagcactttacagcttttctttggcatatccgaatttccagcctcactactcttgcagtctggggaacttataaagtaaaataagagttacttgaacacaagcactgtgataccacaacagtcgatctgataactgagatggctactaagtgactaatgggtgagtagtttagactgcgtggttaccctgacaaagggaagattcatgtctcaggggacagagcaggatggtgcaagatttcatcaccctacttaaaatcgtccataatttaaaacttatgaattgtttatttctgaaattttccatttaatatttttggaccacagttggctgtgggtaattgaaaccactgaaagtgaaaccatgtataaagggggattactatatatttgagtaagagcttctagagactgctaaatttgctccgtaactatcagagtggaagtcagctaatgctgtcaaatatttttataaggcctatgagtattctggaattattttgatgctgttcacttctcctatttctgtattaaatctaattttatgtacacaaaaccagattatgttacagtcaaacagattccaggaatgttccacaaacaatattgttcagtagtcaatagaggacaaattggactataatcttgccagtgacttaaaacaaagtgaaacaaaacataaaaaactaaaacatgttactatagttgctgccatcaacttcctcatcatttttgaagttggtattaatagtagcatctttggaatatttcagcactttttcagtactacatttatgtagaaaggtctgtgctggcatttaagccaaactctatcaccctgttttaaaaagtcttagcaggcatacacaattacatcttggagccttatggatatgacagtaatattgaccttttcacaagaaatggcagaagctagtttgaggcaaaatcagtgctgctcagaaacttgtgccatcatccttgatgacagataagtattaaaatctccattgaattattttctttctgtgattcagagtcaataaacaattgctgaatgcctaatatgtgccagatgcttttccatacaaccttttccagtcctcaccacccatctataacataggtatcttcatttccatatgaggaaattgtaactcagagaggttatatgatttgttcatggtcacactagtaactattaagtggcagagatgggacctgaagccagattttccagttctaaaaatctagcattcttttgattgtaccacagttgccctcctcagcaagactggatgagacaatgtggatgccccaggcaggcttatgttctggtgcctcttcacctgcatatatttaaaatatttggtcaacatttacttaatgagagtagggagagactgagtttctattttaaatagtgtatgtcttttttccttatgtttgaaataaaaaattcactacctacacttataacaataatagctatcatttattgagtgtttaccgtatgtcaggaactatgctaaccactttacatgcgttatctcatttaatcctaggaggtgagcactgttatcgtcatcatcgtcatcatcaccaccaccatcatcatccccatttaatagatgaggcccaaagtttaagtcacttagccaagatcacacagctagtaagtagtggagccaggatttaatctctggtaggctcacatctgagcctatgagcttaaccaatatgttgtgtgtgtgtgtgtgtgtgtgtgtgtgtgtgtgtgtgtgtgtgtgtatgttttgccttcaactacagcaaaaaatcctaaattggcattttaaattactgatttattactttcatttcttttgtttgttttgtcactcaaaactaaatataatggcagtaacttacagggatataattataaaatcagataacttacaggtatatagttataaaatcacgttcaggccaggcgtggtggctcacgcctataatcccagcactttgggaagctgaggtgtgcagatcacctgaggtggggagttcgagaccagcctgaccaatatggagaaaccccgtctctattaaaaatacaaaattagccgggcgtggtggcgcatgcctgcaatcccagctactcgggaggctgaggcaggagaatcgcttgaacccaggaggcggatgttgtagtgagccaagatcgtgctgttgcactccagcctaggcaacaagagcgaaactccttctccaaaaaaataataataataaaaataaaaataaataaataagttaaataaaatcacattcaaaagaccttagaatttctcctttttttgttttttttttttttttttttttttacaacaaaccattttccacttttctgtagtttttattttgtcctcagtgtccttttgcaattctccaaaccaggtaactttggggaaggtatagtagaggatttaaaatttagataaggaaatgaacccttcattcttgataaagagcattgcaacatgcagtattttgtttctcaatatcaggtgattgtggagagttgcctactttcagcaactcccatcttgctaatctcaccgttggtggcacaccctttaacttgcacgcgcttgtcacgaaaatagagtggttggcaccagtgaggactggcttgcttttgcttttaattttttactcaaaggtcccagcctccttaggtgaaagaagtggccaattttcatttcaccaattactttaggaagtactggcagaaacccaaggtatgcagcaccatatttatgttttattccagggatttttaaacatcccttttaaattggcaccccaggcagttccctggctgacccattgcttaattctcctctctctcaggaaggctatggaggaattgatgaatctaattaggtatccagaactagagagttgatgaagaagaaggatatggtttggatacatgtatattgattcaaatattaaaggacaattttctatgagtttcagctgaccctggagggcatacagattccagaacaaaatccattgagtggatttacctcccctgccatttgtaaacaggcgaaacctgattataatgaatatcagagggcagctggagcctgcaggttgaatactgatgttacgggctgtgtaattactatgcaattttattaccaggcatttcatatgtataattataatgaggtttagataatttagaaaaacggctgatcataagcaatgtcaggccatctacaatctgagcttcacctttgtgttaattaaagcaaaatcttcaagtagaactggaaatgaagggtcacacccaatgaaaggtctctcccaccctggcttcttgtctgtccactcattgtttgtacttctgaggaaaactcaaaatttcactgcctggtacttctgtgtttaaagatcactcttcttcccttctccattctttgtgggtacaagtctgttttaggtcttcttttttctcaaatgtcttattgtgttagaatacatgaaacataaaatgtaccatcttaactttttaaatgtatagttcagtggtattaaacacatcatcatgttaaacaaccatcaccaccatccatctccataacccttttcatcttgtacaactgaaactctgtagccattaaacaatgactccccattcttgccttccctcagtccctggcaatcactgttctgttttctgtctctatgattttgactattctaagtacctcatataggtagaatcatacagtatttgtctttttgtgactggcttatttcacttagcataatgtcctcaaggttcacccatgctgtagcatattgcagagtttccttctttgttaaggctgaataatgtttcattgtatgtatataccacattttgcttatccattcatctgttgatagacacttgagttgcttcctgttttagctattatgaataatgctgctatgaaaataagtgtacaaatatctcttcaagacactgttttcaagtcatttgggtatatacccatgagcaaaattgaaggatcatataattctattttttatttttttgggaactgccatactgtttcccacagtggttgaaccgttttacattcccaccaactgtatacaagagttcaattttctctacatcctcaccaatactctttattttctgtttatttatagtagccatcctatgctttgggtcttaataagatgtctctgactaggattgagattttcaaatcaagtgtagaaagtggaggcagttttgtgtctttatacctgaaaaaacaaaccctcctccttcaaatgctgaagaaaaatacagtgatgacattttagaatttcaaatgagaacaaatagtctaaaaacacaacagaatatttgaaatggaaactgccccagaaaacttgaataattaaagctataatgtattttgagcacctactatgtgacagacactaggaaaagtacttcccacatatattatctcatttaatcctttcaataactcttttaagaaatgggtcctagagtacccatctctgcagatgaggaaactaaggtgtagacaggtttaaactacttgcccaaggtcacatagcaattaaatggcagagctggaattcaaatccaggaatgactaactctagaggcttttcacttaaccaccaagaggacctgccatttccttagatgtttacaggctctaaaataatttctttgtggaaggaattcaaaggcaagagagtcaaatcaatatttccatctgtgtataaaacctacatgatttttgacatatccaagaataacataaattacaggaagggcatttgggcattctatctctcattcctgggggtggcagccttccctacctcaggttcatcccataagcctatccagagtccattcttggccaaccaaattgatctctggaaagtgacttggcatggctcttcctacattaatttcatcaaagcaataataatcatgaaatcatgggctccatattagattttttttttttgagacggagtcttgctctgttgcccaggtgatctgagttcactgcaacctctgcctcctgggatcaagcaattctcctgcctcagcctcctgagtagctggaactacagaaacatgcgaccacacctggctaattttttttgtttttttgttttgttttgttttgttttgtttttttagtagagacagggtttcaccatgttggcgaggctggccttgaactcctgatctcagatgatccactcacctcggcctcccaaactgctgggattacaggcgtgagccaccacacccagtcgagatgtttttttaaaaaaatacacatcaaaataaataatgttcatctacgagtacctaaaatcatctcatgtaccaccaggggtatatatacagcatacggaatagcacggatctggatgatctctaagtgactttctaaccttgacatgcaatgaaacacctaacctctaaaaatagctcaaaaaggttgagactggtttaggcaggatggtaatttgccaatccttgctcactttctcctcctgcagtctccagtctttgcttaactgtcctccatttttgagagatttttcacagcttttcagaagaaactgggcacttccaagagagcaacctccttttatttctgcagctactgatcttcatcatccaacttaggtgttacatccttagaaatgaggctctctctgacctttttctgaccacctactctaaggtaatcccccataaagttaccctgttttacttttcttatagcactcagttatcactatttgaaatcatcttatctgttcgttgacttgcatgctgctagtctccccactaaacaagctccaggaggttcatggcatctagcataatgcctggcatgtactaagcacgcaaagagtatttgccaaatgaatgtacatgatgaattagggattctaaaattgggatagggctttggagctgatgaaatagaggcaaaacaaggaaagctgaatttgggtgatgtaatttatccaactaaggtaaagtggaaactgatatggtaaagtacaacactgtctgaggttcttacatcactcattctttcttgagcacatactatattcagggcattgtgctaagctgtccgtggtgggctgctatagagctctgggacctatgccatcggcaacccctagtttgattcatttatcccatgtttattgagtgactactacgtgtgaagcaccattctatgctggatatcacagtaatcaggacaaagttcctgccctgtagtgaggaatgtatgtgtcaaatcataatcagacacataactacatggcatttttttcccagatggcatttcctagtgatcgtctgacttgccagcaaatccagatctttgctcccaaggtggtcttggaatcatttctccaccacccaccctctgcccactgatacttttatattgatactagctaccatgattgggtatgcacagtgttaggcactgtgccaagggctttacattcattatatgattgaatcttcccaataaccccatgaagaagatactattattacccccattttacaaggctgaaattaaatgatttgtctaatatcatgtagttgttatgtggtagaatggattcaaagctgggccaagtgttccctagagttgtgcaatgcagtcaccatccagagtcagtgcccttaaccatcagtgtgcaatggtgcctcttatatattacatatgccctcccttcacttaggcaatctgattctgcagagtctggcaacccagacactctcaggttataaggtttgcccaaggagctggcaatgaagcaggcagaaatgtgccaaggtctgactctgtgtggtccagaacatgaggcatcagcaactatatgttatgaagcagttgttacagttcattacaccctaggaataacactgtcctcagtaaagatcaaattattgaagatgtagttcataatggaaactatatatctggacttctttcatttgaaagcgattaaacacaagaaaattaaagaaaagctaaggaaaacaactagtgcatttgtagagaaaatattaaaaacatatctcaatacaggcaacctagattaagataataaatatatttgtgctatcagttttataataatatatcctttaggttcagtatggaactaaagctatcaaatatggtttctttttcacactgatttctgcaatttactaaaatatactcatttgtgccttttcaaagcaatttttcttaccttatttaatttttgtgtcatagaaatactgtaaggtagagggaaggtgttatctttgtttttaaaaagtataaatttaaggtacaaagtgagcaagtaagtaaccaacaacaccaaattagaattgcagccatgaaatttggtccacacaccagggtgcaaaaatgtcacatttctttctttttttcttttggcaatgatttattgaatatggcaccaaaagcacaaacaacaaaaggaaaaagaggtaagctggacattatgaaaattcaaaactcttgtatatcaaagaataccaacagagtgataaggcaatccatgaaataaaaagaaacatttttaaatattatatctgataaggaattgatattcataatatataaggaactcctaccagacaacaacaaaagcaaaccatctgattttattttattttattttattttaagttctggggtacatgtgcagaacgtgcaggtttgttacacaggtagacacgtgccatggtggtttgctgcacccataaacccatcacctacattaggtatttctcctaatgctatccctcccccagacccccaccccctgacaggccctggtgtgtgatgagccctgcacccccatgtccatgtgttctcattgttcaactcccacttatgagtgagaacatgtagtgcttccttttctgttcttgtgatagtttgctgagaatgatgatttccagcttcatccatgtccctgcaaaggacatgaactcatccttttttatggctgcatagtattccatggtgtatatgtgccacattttctttatccagtctatcattgatgggcatttgggttggttctaagtctttgctattgtgaacagtgctgcaacaaacatacgtgtgcatgtgtctttatagatttataatccttgggtatatacccagtaatgggattgctgggtcaaatggtatttctagttctagatccttcaggaatcgccacactgtcttccacaatggttgaactaatttacactcccaccaacagcataaaagcgtccctatttctccacatcctctccagcatctgttgtttcctgactttttaatgatcgccattctaacaactggcaaaaaatgtcacatttctttatatccctacaacaaaattcaatctgctctgagcctttcacctttccagctggctaaaaattcaatctccctcatggtttttacctccttctgtcaaggttgtatgaagaccctagcaaatgatacccagaacacaactttcagtgtaggtcctatgcccttttgtgcatacccaacattgttgatatgtttgtcaggcaaatccccttaaagttagacggggtagctgcttctgtgccactcttgcacattggtggtgatagcagggtgttttggctgaagctggcatcctcacggactagtattcagactttcttaagtgtaccatgtctccattctctcttgagatcttgtatcttctttagcacactaaaaggcagcaaaagtagtccttgatgctcatggaatctaccattactcccgtctcctctcttgtcccggagaagctcaacttctatgtcagacagcttctcccacctctactcaaaagcattcacttgttaaccctctgggacaagtcagcatacttttcctcaatgaacctaggcttctgaaatcaaaagctctggattcaggtgatcttcctgaacttctgattttgaccttgcaagcaaaagcacctaagaaaggggaacagaaaggcttgtctgtgttttgatttgtaggagggaaaaaaatctacaacaacaaggacaaattatttaaaaataatatttgaatacataatccttccccaagccctgctacatttcttaacgggagtttttaatttgaggcatggcaccagtaagcagcagtaatcatggatctacatttttgcagttaatttcaatattgcatgtatttattgaacacacacaatgctactactactgtactatgtattgtatggcatatttaagaagaaaaagatatattcttttatctttgagatgtaaagaaatgtatccacaatatgctctttgacagtctgttgctggtaactttcagatcccactacctaaggggctaaaattctcttttctttagaatatgaaaaaaattacttcatagatataattattttatttagagaatgccctttatggagagtattttccttttttattttctacttcttgtagtcactcaagaaacattatatggtagtcatggggccagggacataaagattcacaacattgtccttgtcctcaaggaagggagactaggtggcagaagggaatagatctataatatcagagtagcctgataaaggaggcaatatttaatttaggacttaaaggatgaattgaagtttattaataaagaagtggagaggaacattccaaaaagaggaaacagcatgggcaaagaaggggataaaataaatttcctaaaataaaaatagagaagtgaaaatacatagcatactcaaggaactgccaataatctgaccagagtacaaagtcttggggggaggataatggtgaaagacaacgctagagaactagtctgcagtgtgattgtaaatgttcctatatgcaatgctagagagtttggggttctccttatagacgatgagaaattaaccaaaggttttaagcaggaaaatgataagatcagaacaatgttttctgaatattccttctgacggaggtgccaaaaatagactgaatatagagagagtagtcacatggctctcagtaggagctgatgaaataaggcaatagaagtggaatggatttaaggtaatattgatggacttagtatgagaatgagagataagtaagagttaaagatgactcccagggctgggtaatcaggtagatagagaggccattaaccaaaatagggaatacctaagaaggccaaggttgtgtataataagtttttgtctcagataagttgaatttcaggtgtctttgggatatccatgtgaaactatctagtaagccaattgaaaactcagcctgcagcttggttacagaagtcagggttggagttaagatatttgggattcatcagcaaacagatgttgagtaaattgatggcaataaatgcagagcaaaaggaaaagtctgaggatagaggcctgaaggacaggtagctggagtaagagaagaccctaaaagagagtttggggttctccttatagaccatgagaaagaaagcaacaatcagatgagggctattagagaaacaaaggagaagagaggtcctcgaatgaaggggtggtctttagtaaacacagagtagaggtctgataggacaaggacaagatagggccattcttgtgggcaatttagacatcactggtgacttttgttggagcagtagtaggggcataagtcaaattgctgtggtttgagggctaaagagatgaggagggtggaaacagtatatgagagttattctttcaagtaggctagcagtaaacataaagtgagaaataagttggcaacacagtaggcaaaggtaatatggaagaatgtctatggagagtgagagtgaagaaatgagagagaaaagggttaatgaatggagtcaaatctcagacaagttagtggaagatgggttttagtccaatatttctcaaactacctgtggtgaaggatcaggttttcaaattttcaagctgttgcagattggtacttctgtgaaatataataaaaatgagttactagaaaaagtgcagtacagaaacaaagacattcaaaatataaaccctaatttttcattattagagccaacgaacataaaattaatttatcaaattgctatggaagtttctaaattcttactctcaatttcagtgcttatgctgttgtggatcagtatcaaacagtttgaggattggaaggggtccatgaccacaccttgagtaacactattctagaccataggtagagagagcaggaaaggaggtaagaaagaacaccccttcttccaagagaggagggaagcaggaaaaggatgaaaaacagagaaaactttggaatgaaatgaagaagggttgaatggattctcacctgaaagtcgttttttttgtcgtgaagtaggaagcttcattttctgaaatgattaaaagatgaagaggttggagtgggaggattgaagtgtagtaacgggttgaaacagctgctgtgggaaatcagaaagggaactgaataaagatgaattaaagatttgtagaacaatagagaaggcccagctgaggctgaaaatcataatttttttatggagccaatcagctcaattttgtgatttattttttctaacagttttacatcctcagagcaggagtagagaaaacatatggtacaatactggtactatggtggactagatatacaaactgtcccacggaaaacacttaaaaagcttaaaagcacctaaaaacatgaaattcatttatgtttcatatacaccttaaacacatagcctgaaggtaattttatacaatattttaagtaattttgtgcatgaaacaaagtttgtatacattgaacaaagcaaaggtgtcattatttcagcaacccaggtagacaatctgtggttgtttggcatcaccatcattcctgactctgaatttatatgctactgacaagcaatcattttcttacacttattctcacataagtattaacggtttaaaaaaatgacataccattaatatagggaaaaattatgtgttcagtgtaatgaagcagcacagtggcatcaccagaataccaggatcagctgttaaacaacaaacaatggcaagctttccgtctccacctacaatgctgtgctttgattaaaaggttactgtacattgtatttcatttttttaaggtgagaagacacagaaacagttgaaggaccaggaagtgggtcctataaagatgagaaggtgttctgctggatggctttaaaaaaatatttcctccaaagtcatctgcctgattaacaatggattttttctaaaacaaacaatcccatcaaaaagtgggcgaaggatatgaacagacacttctcaaaagaagacatttatgcggccaagaaacatatgaaaaaaagctcatcatcactgaccattagagaaatgccaatcaaaaccgcagtgagataccatttcatgccacttagaatggcgatcagtaaaaagtcaggaaacaacagatgctggagaggatgtggagaaatgggaacgcttttacattggtgggagtgcaaattagttcaaccattgtggaagacagtgtggcgattcctcaaggatctagaacaaggaataccatttgactgagcaatcccattactgggtatgtacccaagggattataaatcattctattataaagacacatgcacctgtatgtttattgcagcactattcacaatagcaaatacttggaaccaacccaaatgcctatcgttggatagactggataaagaaaatgtgacacatacacaccatggaatactatgcagccataaaaaaggatgagttcatgtcctttgcagggacatggatgaagctggaaaccatctttctcagcaaactaacacaggaacagaaaaccaaacaccacatgttctcactcataagtgggagttgaacaatgagaactcatggacacagggaggggaacatcacacactggggcctgtcagggggtgggggcctgggggagggatagcattaggagaaatacctaatgtagatgatgggtttatgggtgcagcaaaccaccatggcacgtctatacctatgttacaaacctgcatgttctgcacatgtatcccagaacttaaagtgttaaaaaaaaaaaaaaaagagtcaaacatctaaaaaaaaaaaaaagagaaaaagaaaaaaggaaatagacgtttgttttactaagccattatatctttgggtctacttgttagaatactttatttagctgatacaggcattttaattagacgcattcttttatttaatctttacaaccattttacgaagtatgtactgatatgcaatttaagagataaggaaaatgaagttaaattacttgcttgaagttgtgcagtaaatgaatgggtgatatgctaaaggcctaagaagatgtttgctacagccccagccaagctatgctcaaagtaatcactaggccttgttgttgatctggggagcaaaagtttgctgaagcagtaaaaatatcatgacatcaaaattttcactggaaacccacagctagtttataaaattaacacccttcctctttaccttttaactatttctctcactccataactctataaacagcattttgttgcctgtcttctctctgtgttcatcatttccatccggatcagttatcattcttttctggcaggccttattatattgatctccttatttatgagactagaagagaataataatcgatgctttgtggtctcagtatttgctcttttcaggatagaagtgtttctgttcaagaattgcttgtaagtatatttcactgaacactgtagtgatgactatcaaagaaataatactaataatgataataataacaactacttaaaataatatttctaggaactatcgctaattaaataaaaaccctcctttgacctagtgctcctctacagctaccatctcatttctttgttcctcttcagagtcaagtatttcaacagagttgtctatatacactatctacatctccccaccaccccattcactttttagtgcactccagtctgacttctggccctgccactccaatgaaactactcatgttattgcaacatgcaacatgcatgttgctaaatataatagacacttctctattctcattttatttgaagtcccttcagtatttaacatcattaaccattcttccttcttaaaagattttcttctttggatattgtgacacaacactctgctggctttcccactatgtcagttgctactcttgtttagtctcattagccagttcatcccaatattgtgcaacctcaggactcaatcctggttttctcttttttctttatattccttctctatgttatgttgtccagaccatggcttctaatactgtctgtatgctaactcccacatttatttatcaagtcaagacctttcatttgagctcatgacatgcatatctgcctacctatttcatatctctatttgcatatttagcggacaccttaaacttacattgtcaagaagtcttgatatcctgtggacctgctcctgtccttatcttttccatgccaatatgtcatcaccacttatttgtttacccaaaccagaaatctagtcataatcataaattctttccttttcctgacctcaacaaaatatgtgtcagtaagtcttgttgactctacctccaaaatttacatggaaattctcctttctttttatcttaaccgccaccacctaggtccaggcctatcctgaattaacgaagtctcctgactgatctccttatctctgctctgttctcctgcattacattctccaaataccagcaaaattgatctcactaaaccgtccagtgtctttccattgctctttgaataaaagccaaattatttatcatggctacgaatgatccactcctgcacctcaataaggaaacagaagacttgaacaacactatacaccaactagaattaacatatacctatacagcattcctcccaataacagcagaatacataatcttctcaagtgcacatgaaacattcttcaggatagatcataagctaggtcataaaagaagcctcaaaaaacataaaaggattgaaatcacaccaaatatattatctaccaccgtggaatgaaattagaaataaaaaacagaaggaaatttgggaaattcacaaatatgtggaaattgaataacacactcctaaataactaataggccaaaaagtcacaagggaaattagaaaatactttgggacaaatgtaaacaaaaccacaaaatatcaaaacttataggccaggcaaggtggcttacacctgtaatcccagcactttaggagaccgaggtgggtggatcactggagatcaggagtttggggtcagcctagccaacatggtgaaaccccgtttctactaaaaatacaaaaaaattagccaggcgtggtgatgcacacctggaatcccagctactcaggaggctgaggcaggagaatctcttgaacccaggaggtagaggttgcagtgagctgagatcgcaccactgcactccagcctgggagacagagcaagactccatctcaaacaaacaaacagaaaacaaaaccaaaagaaaaaggaagaaaagaaaagaaaaagaaacttacggaatgcagctaaagaagtgcttagagggaaaatgatagccataatacctatatttaaaaagaagaaataattcaattcaataacctaacctgccatttcagaagccagatgagcaaacagaagcaaacagaaggaaataaataaagattaaaacagagataaatgaaatacagaatagaaaaacaatagagaaaagtaaccaaaccaaaagttggttctttaaaaagaacagtaaaattgacaagtctttagttagacaaaaaaagagaaaagactgaaattactaaaatcagaaatgggatgatattactacagaccttacagaaatacagggaattataagagaatactatgagcatttgtatgacaaattagataaaccagaagaaatgaaccaattcctagaaacatacaaactatcaaaagtgactcaaaaagaaacagaaaaatttaacacacctgtaacaaataactagattgagtcagtaataataaaaactccctgtgagggagaggggagtggagatggttaatggctataaaaatatagatggaatgaataagatctggtatttgatagcacaatagtcaacaataatttattgtacatttaaaaataactaagagtataattggaatgtttgtaatgcaaaaaaatgacaaatgcttcaggtgatgcatatcccattttcctgatgagattattgtacatcgtaagctagtatcaaaatatctcatgtactccataaacacactatgaatgcataaaaaattcaaactaaaaaaataaatgaattttaaaactcccaacaaagaaaagcccaggaccagatagcctcactgttaaattctaccacacatttaaagaagaataaacaccaaatccttctcaagctcttccaaaaaatagaaggaaactgcccaaatcatttatgagaccagtattttcctgatgccaaaactagacaaaaacatcacaagaaaagaaaactcagaccactgaatgtagatgtacaatgaatacagatgtaaaaatcctcaaaaatactagtaaatggatccagcaacatataaaaaataattatataccatgatgaagtgggattcatctcaggactggaaggttgatttactatcccaaaattaatgtaaagtattaattttatggtatattaaagtaatatgccacatcaacaacataaagaacaaaaaccacatgatcctgtcaatagacacagtaaaagcatttgacaaaaaatccaacctgtcatgataaattaaaaaaaaaaaaaaacactcaacaaactaccagtagaagggaccttcctcaacctaagggaagctattaaaaactcacagctaacatcatacttaatgctagaagacagaaagctttccccattatatctggaataagatagggatgtctgctctcatcaattctattcaacattgtactagaggttttaggcaaagcaattagacaagagaaaaaaaaatacatccagattggaaagaaagaagtaaaactatcagatgacacaatcttgtgtacacaaaatcttaagaaatccaacaaaaaactattagtagtaagaaatgaattcagctcggttgcaagatacaagatctaaattatgcaatgaggccaggtgtggtggctcacgcctgtaatcccagcactttgggaggctaaagtgggcagatcacttgaggtcaggagttcgagaccagcctggccaatatggtgaaacctcgactctactaaaaatacataaattagctgggcattgtggcgtgcacctgtagtcccagctacttgggaggttgaggcaggagaattgcttgaacctgggaggcagagcttgcagtgagccaagatcatgccactgcactccagcctggagtgagactccatctcaaaaaaaaaaaaaatacaatgaacaatccaaaactgaaattaacaaaattattccatcttcaatagcatcaaaaagaataaaataggaataaatttaacaaaaaagtttaaaattgtaatcccaactttgactctgaagatgggattctaaaatggtacagtcaatttggaaaacagtctgtagtttctgaaaaggttaagtacagagttataatataacacaataactccaccactaggtaaatgagagaaatgaaatgaaatgagagaaatgaaaacacacatctacacacaaacttgtaaaccaattttctttgcaacattattcataacaaccaaaaagtgcaaacacccaaatgtcaatcaattgatgaatggataaacaaaatgtgatatatccatataacagtatgttatttggccataaaaaggaatgaagtactggtagatgctacaacatagaggaagcttgaaaacatcatgtgaactgaaataaagcagacacaaaaaggcaaatattatatgattccatgtatatgaaatgctcagaataggtaaatccatagagacagaaaggagattagaggttgtctagggctgaagaggaataggaaggaatgaagagtaactgctaatgggtatggggtatcttttttggggtgatgaaagtgtccaaaattgattatgttgaaggttgcataactgcatgaatattctaaaaatcatcgaattgtaaaatttaaatgggtggatggtatcctttgtgaattatatctcaataaaaagaagaaagaaagaacaaaccagagaattctggaggaaacacagagcagagtgtagcatgggaaatttcaagccccttagaaaagctatatgctaccatgaagtatctgcaatagaaatagcagcttgaggttttagaagaccgtcaagtggcatgaaagaaatctagaatcccttgtggaatcttgtggaagatgcagaagtcagctgaggattaagcagcagcctacttaccaggcagtggctgtggcataaggtgaacagccccaaagaaaaggctgtagggtggatagccaacgtcaggggccagatggaggatctggctgaagtttggagggttagctgcactattaggagctagggtaggaatcccgaatagtaagtaatgagagacgactgagcttcctgacacaatcattgtgtattactcatgctgagagaataagccataaattgtgaacatttaagcagtgaatagagtgaggcaaaatgagctacacttcaagtgggatctagcagaggttatagggatcagatttctgctcctcggtgccatgagtgagtttgtactttacattgattatttgtacaaaagagacttaattcagaacagacttttatattttaattgacaatgttaatcctcaccctgccaaaactgtgcctccaaccaactggaataggtgccccagaacacaatgagattagttaaacagctatatttttataattaacttttcaggtgaggccaattgggtttcattatgtacattttcaaaccccaatatatgtacagaagctagtagatgaattcttcttttaaaaagagagaaaagagaaaaacagtcaagtaaagactttcccaaactatagtagacaccttcatgttttgattgttcacaactcctctaactgccccaaataacactctgtttgatcatcttcttcctagaaagcctttttctccaatctacaactagctagctttattaattcttccacattcagagtagatattagcatatctaaatctcattaaggagtttatagaactttctctaaaggaaataggtagcaaaacaacattcaattagtttgtactcaagttgacaatagaagatgtaaatgaaacaactagaaaacaatccaaggtagatcatggtgcttttgctcataaatgtgttcattagataaagaaagaattttggaaggaaggatctgttttgtaatcagaaaaacaaaaactgatttacgaatttgaattgaaaagtaggtaaagaatttcagtatttactcacgtattcattcaaatataaaagggaactgattaccacctccaccacaacaaccatgtgttatacgtgtacaaggttagatcaaagtggtagctaagaatattacattctgcagttgttcaaggatgacagttgagaaagtttgatgacagaggataaaaataacacttgtttgggcataaatggcaggtttttttttcaatgaaatatgtgaatgttcctccttttacccacaaccccagaaacctaagaaaataattttgcaacattaagttcaccacctcatcgaattataattattcttattttctgaaatgaaaaaataactatgttgtaaacacgagaacaaattgaggcaatgataatatattaactaactattgggtttaattcaattactagctttgctgcacaataaataatatgcataacctctgtccaagtatttttttccacagttgtaaaacaaagcctttgacaggagttagttaacagcaatttagagctgcctctaaattgcagaaataaaaatgctcacaatttgaatgtgctttgttgacaaagagactatggcctattttttttttttaagtggaatcttcagctcccagattgacagtcagttacaaagagaggaaggcaacttaaagtttcctctggagggtattatcactgcagtccagtatcagcagtgggtagaaaccatgtgctctatcatattttgacctttatacttcaagtcaagagaatcctgagcaaggtcagtttttctatccacccagtgtgcactttgcatagatgtaaaaaaatttttttcacagaatttgttctgtggatttagtttatgtttgaatgaaatatgtttctttttatgctggtgactttacaagaaaacaaggccaggagaggcatttcctcaaatgcctaaaggagacattaccaccatcaccactacttgccaagcgatttataaagcatcttgaggctcaaggttagtatgggagatgagccaggctcaggagaagttaacacaaagataaaggttagtgtttttcccccttttagtcagccaatacaacaaagtacttagataataacccctagcggtcaggtaatgatgtattttctgcaattatcacatttgtgtttgtctattttctttatgctagtgaggtttggaattggaattgaaaatcctctagggaaaagctatttttgtaattcagctggggtgtccttgtctttgggttttcccattgcatcagtcccttagcctggcaggatagccatgatagtgctttgtcttttagatgaaatgcagaactaaggacatgactactggtgcttattaaagattccttgctatttttcacaagagtaggggcgttagactcttgtctactggccaaattctaaattgggagattacattctgctttcctaaattcccctagcagaagcagccatccatggtatcctactttgcttcctgtgctaaactgttttgtgatgtcattaaatggctctggttttttactctagaaatgatcactttagtggggtggggagtaaatcgatacctattgtctgatattatgttcagtctagtttcaaaaaaattaaaaggtagcctgtggtagttaaggacaaagtacaaaacaaaacaccctaacgtacaaaacaccctaacataccagttgttgtggtgctttttaaaaaaaccaatctgctttctcttctgtaacatagacaaaatattaatgcatttttttactccactagtaattgacaaagaattgttatttgtttcatacttaaggttaattctaacagtgatgaagtttgagaggatgaaattacatatcaccgaccaattaaactatcccttttgtctttaggctgcatctaaccattccagattttcatctatctatctcataaaatctttttggaaggagatttttcatctttccttggtaacatatttcagtgtctctcaatctttccataaaaactaagttcttatttctgtttaacctcggttccacctgctggagtgtaatgtcactatcttttgtccatccttagccttgttatcatatattgttagtgagaggcaatgtagtataatggcatggtttttggaatcagacatgccagcattccaatcctagctctgttactttctaggtgtgtgatgttgggcaaattacttctgaggtttaatagcctcatctgttaatgagtaacctcagagcattgttgtgaagataaaacgagatagtatcttattctgaaggattatggggtaggacgaggtatggtattggagacctaaaaagtgttcaatacatactataatagctatttatctgattatgtgcatgtatctgacttaattcataaactcttttagagcgggaggcatacttcctgagtacgccctggatttcaacagaagtatagtgttgtgcacatagtatggtgcagaggctcaatattactgaatgaataaattgttttgtttttattccctgagtggaatgaacagcccccagctatctgcaagatcccacgcatgtagaaaaaaggtgacaaaaatcaatctgcagtttttaaatatgcagatacctgactttatctagatgttttagcatggtgtagatacaatgcaaataacttacgctttctatttctatcacgttcatttctacgaattttaacatttgattattgtcattatttttattattaagctgcacttaggcacccagaaagggactgactcatatgtctcctcatccatccaagcatttaattgagaaattttaaaaatgaatattaagagctaattatatacttgaacaaaatctttcaatttgtgactaagtacattaccttccctatttatctctaagatctgagcactacagataatattcctaattgctttgtacccaagccaagaaataaaaaccaaaaccagaaaagtccaccactgcaagtcccaaagcacaattagtatctttgaaccagtgaagtattagttaggactttatttttggcttttaaatgtttaaacggggcaaggagggtaagttgggggaacaagtacaagatacatagattcagtcggacttgaatatttctccataaggaaaggaaagagtaccctggtgtgtgcttaggctggaattaaaaagacagcagcgtggccatttcctggattgctttgtacacactttacaggggcggtctcaggtatggagctctgggcacctgctcgctcacactccaacagttcagaaacccgtgtatttgaggccgggtggctcaggttccacgtaactgggcttaagtgtcattaatactgcttgcggcggggggttactgagctgtgctttgggacctggatgcttacttcggactttctcctttcttcccccctacccccactagtttccctttccctccttccttcccgggcgtgcccaccttctccctttgctcccactttccgctgtctgactcttgtttccttcaccttcctttctaatcggcttcctgtcttccaacctctgccggccggagagattgagattggggctggggctggggctgcggctcagaagaggcacgagtcgggcgggacaggcgcgaggcgcccagccgcgaaagcgaggagcgcgcaccgaggcgggggcgcgcgcggggcagccgcgtggctaggcagacggggccgggagcggcgcgcgcgcgccccgccagcctctggcgcgcccccggcggcctgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctagtgagtaccgtgccctccgccgccctctcccttgcgctcgggatggggctcagagttgaggcaaagtgcgagtccgcctcccggccggcggatgcccctgccctctcgctgcccgggtccccggagctactcaactgaactaagggcaccctgcgctttttgccctccgaggcaggcaccccacacttggagcagggtgctgctgcaaggaatggccccgtggctcctagaggtgttagctttctctttgcgatgacttcgaggagttttgactcctttacttgtctccttcaccacccccaccacccctcaccctgccccggttttggagatctgggttactcaaggtgttgacctctcctcactttggtttccattaccccaagtgaaagccccgccagtattcccgccccgcgtatcttgcacatggagaactactatcccattgcaggatgaaaaatagcaactatccaacttctgttagtgatggaacttagctctggagcttgtgaggttacccatcttctcctctgggttttcttgtgccctgggaaggggggaggtttcttaaaacacatttttcccttactacttatttttatccaaatacacccattaaaatgtgtttctcgtgtagcgagcgcactgccggcttcctcacatttgaagagtgcgaccttttttttttttttttccattccaccgtctggataatagctcattcaaagagaactgtccccacagagccacggtcagtttgtacattaagcgtgcattcgcttttgtgtcgatttcactttttaagaaatccatgttatacttgatgatttgagaacagttaaatagtaaatgtgtaggaattgttatggtttcctttggttttgtatcttaaattattttacccttcaagtgtgtggttgaaaaattttaaaatagcactgttacagctaaaagccaggttaattctaatccctgtccatttggatgtgtgggaggtggggcatatggttttttttttttaatgtgtaaactgaatgtaaactgactttttgcgttaaatgctagacagaatgtaaagaccaagagagggcagaatgagaaaaagtgcaattgcttttatttgagtacttagcatcaacaagaaaaataatacagaaaaaatttcagtgaaactcgtactgaaaggcatcagccccttttccagctaagacaagtgccccttgtcccccatatcataaatacctgaattgatgttcttttaaaactgctccttttcattttgtgagattagaggattggactactgttgtataagtataaacatttctgcctagactaaaatattaaattaatatgtaaagtggaaattacaataaagtgtcctggaaattgtgcatttgtactgtttgttttctttggctttcattctttaaatgtctttaattttgtatgactcttctgtggtctgtgcattttcttttagacttggttaatctttgggcattggtttatgagaagtgcatgaaagagcatccaggagaacacttcgtcaaataaatatctttataaatttcatagtgttaattctagaagcttaaatcctaagtccacacttttatttagccaattcatttttttggttaagaagtaaaattcattttgaaaagactgccatgtaaaataaatctatgaaatatttattagcttgagtcacttatttgtgacttttatgccttctcttggatgtctgtgatgtattaaagctagtcctgggatgatacttaggttggctctgcaaagtcatgggactgcaaaaattcactcctgtttagttcttgagctgttaacatgagtttggcaaaggctgctttagtattcacgctccattgctccaaagcatatgagaacacactttcaggaggtgctattttcacacattttacagtgagtttgggttaactcaatgactataacaagaattttaaaaggaaagtgagcttgaccagttcatacagaaaatgcttttgaaaatatcattttaacagtagccactttgcacacgtatttagatattattctattcaaacaccccagcccctggatttctttttcatggaattaagcagatgataggacacactttgaccactgtggatatgttgaaacggtggtggaagaataataactattatcatctagcagaccttgaatgtgtcatgtattctataaaacaactaatgtagagtagacactaaacatgaccaagtggagaatgaaagttcacttaagtggaaaatggactgtcttatttccatttatcttcaactcatttttgaggtgtactgtggaaaattcaggaaaacttcctgattatgggagggacataactaagcatttcaacagtgccttagtaactaccacacatttgtctttctgttttacatatttaacagcattgtgtacttattagtgttgctttatcctaagtgccataagacataaacagacatattgggatttttttttctcatagttattatcatgtcatgagcagtgtgtttcaggtcatgtctctgcccaccagatgttgtgcttttgacagttttaacttctcatacgtaaacgcacactcttttcatcctttcccaggacttttctctcagaatgtctgtaactggtgaaatcctcgttttatgggtttagaagctgtagatccatcagttagttatccttccactcagtattgaggggatgtcaatatatgaacaagctgtatggatacaaattcttcactgttgcccccatgttttgattacctacccaattgcagaaagcattgtacaggcaagtttgtgcacagaaatctggttaaagacatgaggaaaacttaactttactgcattttgatattcaaaatcagcactcttggatttatgtagggagcccagatagctattttataggaacctgtttgctactataaagggatccactgtgccaggtgttgagctagttagactccagagcagtcattcttaactttggctgcacattggaatcactgggaagttattaaaaatatggatgcctgagccccaactccagagattctaatttaattggacttgaatggggtcttggatggggcctgggaatcaggattagtaaaagctcaccaggtgagtttaatgtgcagccaaggtggcgaaccactggttatagtctactgaatctttctcttgagatttggataatttgggctagggtagtgccttggaatctgaattttatgagcaccctaaatttcagtaaacaaccgatttgagaaactcttgcattgtggtctgcagaagacatcacctgggaaatcattacaaatataggctctcaggccccgcctcagacctgctgaattagagtctgcagtttaacaagctcctcaggtgattcttacgcacattaaagtttgagaaggactggttctcatactttggagtacatcataatctatagtgcttgttaaaacacaaattgttgggccccattcccggagtttctgattcagttggtgtggggtgggactgtgaatttgcatttctaacaagttccctggtgatgctgatgctacagttcccagggccacacgttgagaacctctggagagagaattgaggacctgaataagtacttgagcgactgtaatggaatggcaattttcaaggccagttttcagtataaaacttcctgcttctgtgtcactatgctttagcatgttcattctaacctagcacccaggagattgagtgctgccgagagtataagagtctgaggttcttgggatggttttagttgaggggtgagggtgactcttggaaacctgtggtatgattttaggtcctttttcagaaattgttaaatgtaagggatacattttaggagttaaaagcattacaaatatgataccttaaggtgaattatattgattttaataagtaaagccccctttgttcccataaaatgctcttatgattctttcactaaagtattgtgaaaagattttaaaagcttttacttatgcctatggttgctggatttcattttaagactttccctctgtaacaaaaatatgaaaggattctgctaaggcactgggattgttcagtcttatatctttaatgctgctgcgtgtcacgttacttgaactttttattttaatcatcctaccacctttgaagttaacgtaatactacattttgtatagaccatagcacatagaagattctttattattaaagtacatcagtaagtgtggttttaaattgcaattaataaaatgtattttaaaaaaatccactcccgcatatgcagattttgagactctgaagaggtgttttaacagttaactctttctcgtcttgccaccgtagtcaagttgctgtttttcagtgtgcttgggaggaattgggttgtgttggggagtaggcattttgtttcaacagaactgtggcaatcctattgcattatcaaaaagatgatttgatagtgctgctcaggttaaaatgatattaaatttgtattttaaatataagccattatatttctgttatatgttttctgatgaagattgaccagaatagccagaagatgtatctgtctatcgcagatgatgccatgaggccatgacagatttccttatccacactaacataacggtactaacttgcattctctggtcataatgtatagtttttcttataaaagcaaaacactgtctgaacaattgagtcattttgaaggtataatatggttgtttttttttaacaatgttgattcccattggaagacaatctgatgtcgtatcttatggatagaaaagaaggcaggcatgtccccagttgtcagttgttctgtaaaagccatcagtgactgagctagaaggatggagaaatataaatcacaaaattgtttttatatccatgcataaaggtgtatgtgggacaaggtatatttagttaaaaagaaaatgcttattttgctttctcccccatatggccaaagggagtgataatttagcccataatttttcttgcttatgaattatgtttgtgctatactcaggtttcagttagcgggtggcagccaagtaggaatctctgctgaaatctctcagtccaatgggaagaaagaccactactgaaaaagtaaaaaatggtctgttaacccatgcatgagttgtttttctaagtatgtatttctcaggcacatgctaacatgtgtgttgttgtctttttaaaaactgtatgctttttgaaaccaaatttgtgttataaatactaaaaccttagctgtagtggattatatttttgaagtgaattgcatttcctatttatagacagttttactttttgagaatttatgtgtgaaacactaaaacttgtgtaatgagattagtcagttcccaagttttcctgatttcaataggcattattatgtactctcgatgtcacacatgcttggctcttataaagcagcacaatgaccagggcttttacatttaaattttgttaaatagtctctttttcaaacttgtgtaataatgtctctttttgatactgttctgaatcaattaagctaagtaagtgaggaccagcagtaaaacccagcatctgccaagaatggaccctcaatgtgtaagctgtctttccacaatcagtaattgggcagttgctcacaggacactggagacagtgtgggaaaccagtggttgtgtaggtggaaagagtagattcccaacagtaagcttatttagagtttagcttctgtagttagtgttgctaagagcaaaaatgacccacagtttatgtagtataaagaaaataacccaaaggaagaagtacagtgtaatagtatagttggttgggtggagcatgttttatgttcagtccaactataagtggcatcttttgtatcaagtgtgggtgtattttctacagctcttaatgtttcagacattgaaacttgctcaaagttaaaaatgttagtgttgaatagctgagtggaaattatatgtcattggaaaaaaaaaccctgtttttgtaaaaaatatacattatcctgagtttcatggttggaaaccagaaaaatagaaggaatagtcctatcctcacagagcttacagtcctgttcaagatatgatactattatcaaagttgcttgaaatacttacaaagcaatatatacatgattgtagattaataaaatacacataaaatgcatacacatggaaatgacatggaataaaggagtggtcagggagaaggctatagggagggaataactggaaccaagttttgaaatggaggaggtacagaaattattggtagagtctgtttgaccagtagatcttgaagtcttacttggttgttcttaaacccgttgctgtcaccaccacaccccttgccacagtacttggggattcccagcagctgtcttcagtcagcaacttgcactctcagcattcttcatatcactccccttgctctggtctctaagatcataaaacttcaaggaaattaaaagtggcctttgtgttgagaatcctctggggaggctggataagagatcttgtatctgcttatagtttcttgtattaggaagagaacaggatttgcagaagagtcctctagagtatcagatgaattgggagaagagtctcaagataggggagactaactaggcttaaggttatgagggcagtaggaaaactggcattggaaagtgggaaagccaccccaggggcagagtttgtgaatataggaatgttgcaaaattgagaattggaagaagttatcagcatatgcaagggttcatactctagggccaggttttgtgtaggagtggaaagattgtagctcacctgtttttggcttccatcattgcctcttcttttcttggctctgtgcctagctattcttgtgctcagaaaaagtttgttaaacagctctgttgaaatggctatgaaatttgatcacaggcataagaactctcctcccctttccctcttcacctattcccagctgtatctaatttgggagaaaggatgagaggacacatcggtttatagaatttgtatcaaatataaagatagctggaatagcttttggatgaggacctgtgattaggtgactacatgtgcatggagaggcactgcaggaaaaaaaaaaacaaattctggttgcttggcagaagtaaaagaagagaggctttgaacatgattcagagttcataagcctggggaaccatgaggatggtggtgccattaaaaaacatggggggaatatgggaagaaacaaatggttgggcaggtgaaatcagatttcttactatgtgtagttccaagtgttggcagttatcaaatgttatttctttttgaattaccagaaccacagagcagcaacagagctattgtgatgttttagttggccccttgggatcactcccccactttgtgactttgaatggctcagataagtagatatcagtgatagttttcagctttgtactgctagtaaaaatacctggcagaattttgggtttctttaatgtaggtttttacattttcttagtcttcaggcttatcaatttgtaaagcaggcagtgatccttttatttccttatgtgtatatcatagtacagccttgagcaagataaagcctcgtggcaggccatctcaggaattcataatttcagaactaaagggaaatttttgaaggactagaagtgcctttggtacaagattctaggttgtgtgtcctaaagcttagaaagtaaaatagattgaatcaagctggatctgttttgtggctttgctcaatgatgaaggatggatgttatgaactgatgggatcagccatattgctttaggatctttgcgatcttcagtggatgggcaaaagtgaaaagttctgcttgagtaaagacctactaatactagtttttttcaataaagtctgtgatagtcttgatgattcttgccttttccctatctgtttcattttacagataatccacattgttacccaaagccacatgcagtgccgggagagcacagttgactgttttatgcagtatcctgccagaagatgctgaccagttctctagtaatagaaagtagtgagattgaattaagagcctatatagttcaccttgccattcgatatactttcactgtgatctgtaagcatattacatacaactttagtaacatattttctagtgagatcttggattgctgcaaggtggtaacagattctctgctttgcttcaggtgttagtggatctttgagtaattcctatggaatggagtctctgaaaaattggttttgatgctgttagcctaggggtcccacagcactgtatctgcctcaaataaatgcttatgtactagttacattagtgtgtttcttttctgtgatatcattatcgcttatagtagcctagcaaccacacggttaggtttaggtggtttggggtgcaaataaattatatagctggtaaaacttgggcctcagtacataattcattgtagcaaggcaaacactttgtgctgattttgaacaaaagtgaagtgtttagattgacgggtgcttttttacctccttttttatatggtaagtagaagatggcattggtgatttattcaataaagaagaatctcatgaagtctttgccttttttccatgttagagtaggtattctcaacacaattcatgtgttctcaacacaattcatgagtttccctatgataatgacaaaaacaaattaaaaaaaaaacttgccacagcttcttttgcattaaaacaaaacaagccaataaaaaacttgccactagcttggctgggtacttgattttgtggaatagctctttgatgttaggagtaggtacagagaaagtcagtagttaaaattttttttgagttcacagatccatctacccccacactcttctacttgtccattcaaaaaaccctcacaagaacaaaaaggaataatattctatttttccgacactaatgaggtgggtgatatgtggtttgtggtatactttactccacaaactcctccaactattgtcctgtctggcaatttttgtgggaattgactctcccacattgtaggcattggctgtgtggagaaagagagtcacatgtggttcgaggcagggacagagggcatataggaatcagggagggagtaaaatgaattgtattcaagttaagtgaagcatggattcagggcagaaaagggagattgagcacctgatctggagcaggagtgctttttatgttttacatcataaaaacttagatgtccctcctttagaatcaatggccacagcattcttgttaaaaaataattattctggctaggtgccatggctcacgcctgtaatcccaacactttgagaggctgaggcaggaggattgcttgaacccaggagttctagaccagcctagacaacatagtgagacccccatctctacaaattatatatttgaaaaacttagctgagcatgatggcatgcgcctgtagtcccagctacttgggaggctgaggcaggaggattgcttgaacccaggaggtcgagggtgcagtgagccgtgatcacaccactgcactccagcttgggcgacagagtcagaccatgtctcaaaaaaaaaaaaaaaaaaaaaaagaaaaaaaaaagtttctagcagaagcaaatgcatatcatgaagtttcataatatgaggacctgctatgggtccttttaatacttataagagaccatattgaaaaccatttgtacagtgtcttcagaatgaggcctctacataactctggaagctatgggacaagtagctttacccaaaacagcataaatgtagccactctcctgtaattatccttacttatttttcttgacttgtctatgcacatagctataaatcctcaggtattcagacatatcttctttttaggcctgtatatttatattaatagcctctacttagatgtgtgaagtttgtttcatgtagtttgctcacagttattatctataacaaagattatggaacaggcactattaaatgatagacccaggtataatttctgactggctgcagaatacagtcatacaaaggtacatacctatctcttttgtactttatcttagaaggacctactatggtcaatttaatttgtaaattacattctcacagataactggagtgtcagccattttttgtttatcagtttatcttttatcatatacatgtaggctgatggtagtttactttttttttttttttttggagacagaatcttgctccatcacccaggctagagtgcaatggtatgatttcggctcactgcaacctccgcctcccgggttcaagtgatttctcccgcctcagcctcccaagtagctggaattacaggcacctgccatcatgcccagctaatttttgtatttttgtatttttgtagagacggggtttcaccatgtttgccaggctggtcttgaacacctgacctcaggtgatctgcccgcctctgcctactgaagtgctgggcttacaagtgtgagccaccgtgcccagccacttattttttatggtggtaaaaaagatgagatttttaccctgttagtaaatgtttaagtgtatagtaatgttaactataagcactctgcttagcttaatttttaaaggcacataatagtggctttacctaaagcaactcatttcttctaggaattttgggaatccttcacaaattaaccttataaacttactagaggggccaggcgcggtggctcacgcctgtgatcccagcactttgggaagccaaggcgggcggatcacctgaggtagggagtttgagactggcctgaccaatatggagaaaccccgtctctactaaaaatacaaaattagctgggtgtggtggtgcatgcctgtaatcccagctactccggaggctgaggtaggagaatcgcttgaacccaggagtcaaaggttgctgtgagctgagatcacgccattgcactccagcctaggcaacaagactgaaactccgtctcaaaaataaaaaataaaaaaaataaaagtaccagaggtgcatagctcctttttacaagagagcctaatttaggcttcgaggtatttatttttccaaacctattgaaaattatgaataaactaaaggcattaaaatcaaaagtaactttttaatttttttattttttattttattttatttttcgagacggagtcttgctctgttggccaggctggagtgcagtggcgtgatcttggctcactgcaagctctgcctccgggttcacaccattctcctgcctcagcctcccgagtagctagctgggaccacaggtgcccgccaccaagcccggctaatttcttttttgtttgtttgtttttagtagagacggggtttcaccgtgttagccaggatggtctcgatctcctgacctcgtgatccgcctgcctcggcctcccaaagtgctgggattacaggcgtgagccaccgcgcctcgcccaattttttacttttttgagatggagtcttgctctgtcacccaggctggagtgcagtggtgtgatcttggctcactgaaagctccacctcacgggttcaagtgattctcctgtctcaacctcccgagttgctgtgattacaggtgtgtgccaccatgcccagctgattttttttttttaattttcagtagagatggggtttctgaggaaatgtgttttctagagagatggaaaattggaagataaattgcataatgggatattataagtaaggccgttaagtctatatgtgtatatatagactatataaccatttcagttaagcacttcttgaaattgcttcttacagtatacacacttgtttctaatgaaaaacttacatctaagtgtggcagtggcatctgtgaaataatagatatgatcaagttgcaggtcttgaaagttgtttgtttgccctgttttctgtacaaccagtatgaggctctctatcattagctggggtgtagacgttttaaaaataatatcactgaattgtaatgcatcaatttgggttttggagcagtatctaacttgttccatttagaggtggctttgcagttctaaacaagaaagtagaatttttactatgattatccctttgcttacaggcttttaaaatgaatatttgttgaagtctcaagtcttttttgccagtattatcttaagactgtgtttgacatcaatacctatctcttattctatgcaagtactgctcttaatattatgactggttctaatatttcatttcaacaagtaatacagctgttctgggtagaacactatgctagacccctttatgagtatgggtgagaaatctataaaataggcataaaccatgcttcatgtccttaaaaagcttgcagtcatactgaaaagacaagattcatgaaacaaataatgaagtcacatatgattcaacagctaaatgagtgatggagacagtgatgtctgtaggactcattgtttgggtagactaatgtgggctaagattgtacaggagagctttacagacaaaataggatttaggctaggtagaactttcatagatggaaaaagcagtctaggcagagaaacatcttagacataggtcaggatgagcattatacagtggtcagtgggtaccaatcaaaagtaggttgaagtgggggagaacctagcaagaaaggggacctgtaaggagactagctataacaagcattgggaaatgaaggtctaacagttgacaattttaaaattttaatggcctgtgagtggcctctttcttggtaaaatttctctttgtctgtttaattatgtctcaccagcacctttaatgttgtgaatgtcatgaaaccttgacaagagactaggaaataacacaagcagtagtctgctctgtagacaaagtgctttcattcttcagtacgcattcagcttaagtcagttagattaacattggttatgtcacactgcctgagtgccttctatgttcagtgatcttttttcttctgaacttcagtgtctcaaagatgaagttagaaaaattgtctagctacaaagttatgtagtttaaaaatactataattatgatacaattaaatggtttggtcactttctttcctcctaaagttaatgaagaaattttacttggatattgcaaatttaactgagataatttaggtactagggattataataattttaggaagattgtgaatgatgacagtcttctttatgaaattaatttaaacatagattaggctaatgggaatgttccttatggttcttcacatgagctttaagaatgctacaactcttaagaaacaatctatataagcaaacttgtaaaggttttatactgttatttagaaacaaaattctaaaatagtttcctgaattacaatgagcagcatatttttagtttatgttgaggaatgattatgctttgaagaaaaaaacaagcaaaattctcagtattttagctgaagatgtgtctttaagacataagtttagaacttaaacttctttttcagtgatcactgtaaaattctattttagtaactcccttctgttattcccagaatatgttttagaatataagaaaattattttccaaatatgggactaatctctggcagattgtaaagcatgagcattgtatcagtatactcaggaaacagaaaacaacactagcgtaatgctcactaacagtgttctctatgtagtcagtttatgtctataagtaaatgaactctccctcctatcatagtcgaatctgcaatttgaattatatactattagagtgaggagaaaaaataccagatgttaaaatagtggtagtacaatatttttgaataaaagttgttgaagaggtagatgttgaccctatgtaataatcatagactcctgccacataatgggataggaggccaaatggaatccagtggtttttagtacagaccacacagaggttcctgatcacttttaatatccgtaaatctttcttaacaaaggtggatgccctcatcaggggagtgggaggcaattttgtttatacagggttgaactatttagatttcaacttcatttttcacagacttcaaacaacgtgcatctcaaataggcaggcacctccatagtgtagagcacaactgggggaaaaagtcagggcttttctgttttgattgtggcaagagaacaagcaaacccattttaaagtgaaaaaaatggatgtaggtctaacgggccctgattcctgtctccattgggctacacatagaacctttgcttctgtttatttccgctcagtctagagaaattcagataagttcttacagaagaggagtgctttagtctttaaggtttctttcactttcattaagttatattcaccatctcataataacccttcattaactcttaactaatttaaatagtttgtaccagtccagcacggcctcaggtccattcattttctcagaattgttatatttaaacactttttacttcaatctctcccaccccaaatttgaagtataaatttaggaaaatcagtcaatctctctctctcttttttttttgttttttgatttgtttatttatttttttggagaccaagtcttgctctgtcgcctagactggagtgcaatggcgtgatctcggctcactgcaacctctgccttctgggttcaagcaattctcctgcctcagcctcccaagtagctggggattacaggtgactgctaccacgcctggctaatttttgtatttttagtagagatggggtttcaccatgttggacaggctggtcttgaactcttgacctcaggtgatccacccacttcggcctcccaaagtgctgggattacagtcgtgagtcaccgcgcctggcctaggaaaattctcctcttaccccttcttcaatatagtttctctctggagctttgccattttcaagagcagtaatcttgaatatttgaaagcttggtagcaccttcattatagaatttttactgtgtaaattctagcaatgtttatcactagcaaagttctttactggtcctgctggttttccatttttgggagatggtagaatgatgggaatggggaggtgtaaatttatgacttccaagtttttttttcaatcattggatttgagtgtctacagcagtgtataaacactgtctaactgggtgaattttggaatcagggcagtacaaatctaaaaagtttctagaattttttccagggtgattttaaagcagagaataaatgagatgtcccattgtaccccttcctcctgtgctttacctgaaagaaggtatctttttctcttatgcatataactgaaaccataagatcattgtggatttatttgatattattgttagttagagactgacctggttatatgtagctgtattcaagatggtaggactatgtgcttatggttttcagtgaagtatggcacaggcttatcttttactctatgattccattcccatggaagattggaatgcttgaaaaattatttggcactatttctttcttctttttctactgttttgttttaaattgtaggtttcaaaatgtttaaataaaattttttttctaatatgtttaaagtcatggatttttgatttagtgtctaagaatggattttagggggttggcagacataatgaaatttcatgcaaagatttgtataagtgcatttttctgattagaagtttcatatctttcatcaggtttccatagaagcttcctatagtgccagcttcttaagaatattcaaggagtttcaactaacattggctgggaaagtacaagtcggcttcacaacacccctgaaatctatccttggactctagactaggacctcctaatggactctagattaagaccccctgcaagctcctcaaatatcttatccccagatatttgtcactatttgacctgtctggcagctccttgggaaggccccattcaccaggcttgtctttatttgatctgactcagtggaaaagccctatcctcaggacatttgttgaaaacaagcagcagcaattgtttagcactgtatctgcctgaggtggctgacttttagaccctgtgcaagcaggaagtgaaggctatggcagaattgtaaactctcagagcattgaaggcatacccaacacagggccctttggcaaaggatgaaagatctcttggttcaaaacattttagaaaatatgtcgatcattagctgaccactaggtagctgaacagatacttcaatggacacacatgacagggaatataggctttacagaactagtccaggaaagtcactaaacaaacagtaacaacaaaccttaggggagaagtgatctgatttccaaactttccactttatattgtttaaaatgtctagttttcaaccaaaaaaattaaaatacaaccaacagtaaactatggcacttaattcagggacgtaagcaatcaataagaactgtcactgaggaagcctagatgtgcttactagatgaaactttaaatcagttgttgtaaacctcttcaaagaactgaaggaaatcatggctaaataaaagaaagtatgagaatattagacatattaggaaagaaagaagcatttatctaaacatattggaaactatagctatgtggtggtgtgctagaggataaatgaagccacagggtaaacatgatgtctcttcttcgaatgtcagttttccagaattaaaactgagagcataaatttgatattgaaacaaatataggtatgttatagtgtagaatgtaaaattcacaaaaataaagcattatgaaatttgccatttgtgatgggccacttacggcaactctcaattcctactcatttcacacctttaatttattttgcctatgatgtacgtcagttgaaaagtttgagaagtctaatctaatgatctgttgcttcagtgattgtggaccaatgacaatcctatgttagaaacaaatgggcatgtcacagataagagataactgtaatagaaaaccgatttccacagtatactcactaattgaccattgtgttattttcacacttggaatatcctacctttgatgaacaaaaggaatacctttacacctgaattgacatttctccaaaaaagacatgcagatagctaataggtacaggaaaaggtgctcaacatcactaatcatcagggaaatgcaagtcaaaaccacaataagctatcacctcacacctgttaaggatggctgttatcaaaaagacaagagaacacaggtgttggcaaggatatggacaaaagggaacctttgtacactgttggttggaatgtaaattggcatagccattatggaaaacagtatagaggttcctcagaaaattggaaatagaactactatatgatcaatccagcaatctcacttctgggtatatatccaaaggaagaaaatagtatattgaagagatatctgtgcccccatgttcattgcagcattattcacagtagccaagataacaacctaagtgtccattgacagaaagtggataaagaaatatacacaatggaatattaatcagccataaaagaagggaatcctgccatttgcaaaacatgagtgaacctggaaaacattatgctaagtgaaataagccaaacatagaaagacaaatactgtatgatctcactttttatgtgaagtctaaaaaagttaaactcatagaaacagttgtatggtggttgccaaggtctgaggggtgagggaaattgggagatactgagcaaggatacaaactttcaattataagatgaacaagttcttaggatcttatatagagcatgggtggtgatgggtgtgataatttgattgtgataatacacagtgtgtatacatataacaaattatgttgtacaccttgatctataaaatctttacttttcaattaaatatttttaaaagggaatacctttcttgttttgaaaatgcttgatgtgtcttttctcacattaatgtaatttagaggaagagaaacagatttgaagaagcctgagccaagggattataagttatccttgaaagcacaaatactatttatcatgcagtttccctcatgaaatgttttacggcagacctgtttatctcatagatctgagtcaaagctgaatttaacacgttaaactttaacttatccagaattagtatcttttgtctaagaaccaacactaaaatatttccttatgttaatcaccaacactagaaatttgcttaattttttttcaaaaacaaaattttgtatcactttttgagttactgcatagtttataatgcaaagaaaacatccaagcttagtgaaatgataggataattactaacttagcaattcattcacacatattaactttaaagtacacaagattcaaattcttcaaattaatttctcaattaaatgaaatacaatgaaatgtaaataaaataattaaatgaaaattaattaaggaccttaatggttgcttataaattcctgaaattgcggattgtatgtccatggagtctgaagatccatagtaattaaaacgtattgtgttatatatgtttatagtatgctcatgctgttttttaaaatatgtatagaacattgaactccacataattgatagcatcataaatatcattgagactactgttgttgattttcatgagtgatttcctctatattatctgctctgtttaagttgattttccaagaagaggtcttaatgactttgtaatcactcttacagtgttttattcattgtgattgactatcagtatttttcctcttgcagcctgactcctaaacccagagtctcatatacaattgtaggtgctacgttaagagagacagggcagttatatggaaagtattatgtgttctttcttttcgcttactcttctctctctctcccccaccaaccacacacaaaggtataaggttgttttcatatcatacctgcaactaaactcattcaggatccccagacctctctaaatgggaaaccacttgtaataggtttaacatctcctaatctagtattagggtaatgctactattgttgtaaaagtttctcataacttgtaatttgctttggcatcattataatgaataatcaattgtatgatataaaatagtaagtgttctaatgaaatgcattttaaaaatgtttgattccttataagacttagatcttataatgaccattttcttatttgatcaaagaaatacactgagaccttagtaagcttccttctgtttagttatgacttcaggtattgaactagatgctgtgcagtcagtcctaccatgactaggatcatttatagtctctcatgttcttttatttaaaattaaagtatgtgaatctttaaaaaaataaagcagtattttaaaaatacttgaaatacagccaaacgtttataacaataaatgcttttttattccatctgttattaaaaatacatttgtttccctgtagtcaccaaaggtaaagtagaatataaatcaaagctgatcatattttctctcttctaattctatagatgtttatgaactttacctagcagcttatgtgtacatatcaccagggattccacatattttgttgggcaattttaagagctgatgccttttaggaagacaccaataccagaatgattttcaaactcaagtaaagagggtatttctggaatattggagtaaggacttcagaaaatctactcccctataaaagcaatgtctggcaacaattgttaaaaacaagtttttcagaattctaaaaattaaccaaaagcttccaacaacctgaggagtgtttattcaataaaatagctgattttcggttaaaaaaaaaagttagatttgttgtattttaacttgccctaatccaatcaacctttccccagatccaaaatatctctggaaactagtaaccttgcatccatggtagctgtgaaaacctgtagctactggagagttgcaagctcctcacatcttatccccagataattgtcactattgacctgtgtggtagctccttgggaaggccccattcacgaggcttgtctttatttgatctgactcagtggaaaagccctatcctcgggacatttgttgaaaacaagcagcagcaattgtttaatactgtatctgcctgaggtggctgacttttagaccctgtgcaagcaggaagtgaaggctaaggcagaattgtaaactctcagagcattgaaggcatacccaacacagggctttttggcaaaggatgaaagatctcttggttcaaaacattttagaaaatatgtcggtcattagctgaccactaggtagctgaacagatacttcagtggacacacatgacagggaatataggctttacagaactagtccgggaaagtcactaaacaaacaataacaataaactttaggggagaagagatctgatttccaaactttctactttatattgtttaaaatgtctagttttcaactaaaaaaaattaaaaccaacagtaaactatggcacttaattcagggaggtaagcagtcaataaaaactgtcactgaggaagcctagatgtgcttactagatgaaactttaaatctgttattgtaaacctgttcaaaaaatggaacgaaactgtggctaaagaattaaaggaaagtaagagaatgatgtctcaccaaatagcaaatatcaacagagaaagagagacgttataaagaaccaaatagaaaatctggagttggaaattacaatagatgaaattaaaaaaattattaaaagggttcatcaacggatttgagctgacagaagaatcaagaaacttgaagataggttaactgagattatcatatgtggaaaaaaagaaaaaaggtagcaaagcctaagagacctgtgggacaccatgtagtataccaatgcacacataatggagtccctgaaggggataaaagaacatttgaaggaataactgctgaaaacttcccgaatttgatgaaaatacttagtataacatccaagaagctccatgtactcaaagtaggataaactcaaaaggattcacacccagatacaatgatagtcaaattgttgagagacaaaaagaatcttaaaagcagcaagagtgaagagactcacaagggatcctcaataagcttaacagctaatttctcagcagaaactgggtcggaagggcagtgggatgacatattcaaaatgttagaaaataagactgtcaaccaatatttctatatctagcaaaactatattttataaaggcaagataattaggacattcccagataaacagaaacagataatttgttgctgaagacctgttttggaagaaatatgaaaggtaatccttcagggtgaaatgaaaggaaactattaagttgaatgtacagaaataaagagtactggtaaaggtaactacataggtaaacataaaagacagtataaaggtatgtttgtttataactcttctatctgatttgaaagacagcagctgcataaaaaactaattataaaactgttgatgggcgtatttcatataaagatgtaatttgaatgacagtaatagcacatagggggagggagggaatagagctataggggaacagagtttttgtatattattgacactggttggtattaatctgaactagattgttttaggttaagatgttaattgtaattcttaaggcagccattaagaaagtgactcaaactagaataaagaattggtagttagctttagaaatttcagtgctttggcatgcaggttagattctgaaagtgaggttatagattatttccaaagttaagctttagttgacaatttcatatgttgtaaacatgtacaagtatattgcctaagtagaatatttggtacctttttagataaacttcaataaaatacagagaaaatttataatcattaattctcagaacattttcatgagttaagaattgattattgctccagtttttaatatgagaaaactataccaaagagaatttaaactttgcctgcctcttccaagtatgatttctaatatggtgggagttgcagtactcaagcatggtttagtaacatatccctctactctcctcaaagtgcttaatgatatttttgatattaaaattaatatctttaataatttcatcacacttctcaagaaactgaagacagtttaaaagtctctttgagcttccctgcctttctttcagaacaatttcaagagaccttcagtctaatgtgaagtatctatcactaaatgtgtacatctattgcccagaaagttgtttttagctcaggtggagtctctaaatagaccgtggaaaattgttttctgaaataattatggcacatcaataaaactgctgagtcttttttttttaaaatagaggtttatggattttagaatttagttatctgttaatgagcaaattaaatgcatccttgaaaaaattaattcaagtattttttttttaagtttatacctaaggcagtgtgggagattcaaaggtagaagagatgtggttcctgccctcatcaagacttcctattaggttggtgcaaaagtaattgcgtgttttgccattaaggacaagtgtaaagagttgtaatatgaaaatggattacctttcataattaagtataacgtatctcacctaatgacttacaaaataacaaagttcagtatcataaataccattataacttacattatagtactgatttgttcctctgggaagaaaatcagcttttcttttgacttggtttgagttctgtttatttgagaaagaactaatgtggcaaaccaaatgaataaaagctctcaacaggttttaacgcatcttgaaccatctgctattagcaccaagccagtactgcaatgtttctggagctggctgtcaggatcagggatgtcctgcagacaaaacaagattcctagtgtaggaagctattgaactggtactctcagaagtgactaccatcttcttccctctccccactagggatcttagtctccttatttagcatttgtttaccacatttcaaaagagtagcttagcagttttttagaaatgtttcagcttagatgtaagctgtacatgattgaggaagggagaaaggacacagtgctagtatatagatagtaaaagtgctgatctcatctccgtgaagtcagagcaacatcctcggggatgaggcttggtctagttatgatagcatactttctttccataatatgcttggaaaaatatttaccctcaaaacaaatccactgtactattttaagcaaattagtttggttttaaatcatattttaaaagttatttaatttttaaattacgaaattttaattaaatgaactgtcttcagagatgattgacctagacacaagtaactatgggaatactgtgatagataaggcttccctgcccttaagaagtttatactctagtaagagagctaagttatacaactcagataactgtaatacaaataagtaagtgccttatataggtataaacaaagcctgtagtagttagaggatgatgactgtagatgggagattttagctaaggtgtctgatgagtcattgggttcacagacatacagatattaagattaaaaggaaatttataaatcatatttccatgaaaaatcctgccttcactagaataagcctacatatttttcagcattggtatttagggatagacagctgttgacctgaggatgacttaggctaatgagttaatttttaaaacatcattacaggggcagaatcaatggtaaagtatccttctgtgtctgggtttataagagtaggtcaaaaggaatggccaggataacaggtcagataaattcaagaaaatcaggccccctaatgtgtcagacattgtgacaggtacaggtaatactatggtcctttgctcttcagtagctcatagcctagcaggagaactcagaatgctagatcattggaagaacttatctctaaatcttatcccatgatccctggaccttctaaactagatgaaggaaaatataccagatggtggggatactttaaaatcttctgacaggaaaactgtgctcctggaatgaactttttaaaaaggtagtatactcacatggtgtgaaatccaaacacacgaggacaatgagatatagatttccctcctactcctttcgcccagctacctaggtgctcttcacaaaggcaaaaactgctgccaccaatttcttgtgtatctttacagagacagtctatgcatatactactagaatttatgtacatatgcatgtctttttgttttgcacaaagagtagcatactatacatacttttctacatctttttttgcagttaacaatcaattttgtagatactttttaaaagactgttttaagagcagttttggctcacagtgaaagtgagagaaaggtacagagatataccgtatactccttgctcgcacatatatatagcctcccccattaacaacaccccacacctgagtggtacatttgttataactgatgtccctacattaacacatcattatcacccaaacttcatagtttaaggttcacttttggtattgtacattctaagggtttggacaaatgtataattatatgtacccaccagtatagtatcatagaattttcactgtcctaaaaatcctctgtgctctacctattcatttctccctccctaacacttacctttttactgtctccacaattttgcctttttcagagtgtcacatcgttggaatcatacagtgtgtagactttttagattgacttcttttacttggcaatatgcatttaagtttcttctccatcttttcatggcttgatatttcatttctttttagtgctgagtaatattccattgtctagatgtactatagtttgtttattcattcacctactgaaggatatgttggttgtttccaggttttagcaatcacaagtaaagttgttataaacaccatttttctgtgggttttgtgtggacataaggtttcagctcctttgggtaaatacgaaggagcatgattgctggagtgtatggtaaaagtatgtttagttttgtaagaaactctcaaactgtcttccaaagtggttgtaccattttgcattcccaccagcaataaacaagagctgctattgctgcacatccttggagatacttctgtatcagcacacctgcaacttcctggttcttttctttttaaaaactatttattttgaaataattacaggctcacaagaagttacaaaaatagtgcagcaaaatcctgtgtacccatcactcagcttcccactggtgatatataattatagtgtattatcaatactaaaaaattgattgtcacaatgtaatcaactagacagcagtacctgtttctttttaatgcctacaagacattccattctatgggtgttttatttaaccagtcctttattgctgggcattaaaattgtagtattgctggtatagggaaagataggagaaaataaagtctgtgtattcggggccactgctggcatttacattgcttttatgtgaattagaaaagagttccctctctgggtggatgtagtcccataggcacatggcttgggaaactagaatataacctagataaatgtttttagcacctctgcatatatatctctttgaacttaagtgggaatacatatgcaggataatggactgtcatttaaattctgcaatataacatcagtgttccaatgtgaaacttcgaagctgtccctttcagatttagcatgtgctcccatcctcctacctgtaaccgtcatcacctctcccaagtaccttaggtcttgtatattttgtgttattattattattaagacagagtctcactctgtcgcccaggctggagtgcaatggcacgatctctgctcactgcgacctctgccttccagtttcaagtgattctcctgcctcagcctcctgagtagctaggactacaggtgcgcaccaccacgccggctaattttttaaaatacttttactagagatggggtttcaccatgttggccaggctggtcttgaactcctgaccccaagtgatctgcccacctcagcctccccatgtgttgggattaccagcatgagccaccacgcccggcttgtattttctattatttatgtacatgtctaccttacattggatagtaagcttctgtcttcttctttatattttctgtcttcatctttatattttctttcccttctcttccccactccactattatcaatctacatagaacatcattttttataaacgtgctgagtgaatttttgtttaaaatttttcttaaggtgaggaagttaagagcagtgaatttttaaatctgcctctcaatacttcaagaggtgtcatgaaatttttaaaccaaaattattttcaattaaagtacccacacactccacactcataggagagaaaaagagtgtgttattaagtcaaccaactcataatggggtgctacagtttcaaaaacattaataagcattgtagtattgaagaaaacggggtagtagaacttgtgacattgcaagcagggaagtattttatatgtattgtacactcatgttcaataagtagaattctgagaagttgcataagtcttgtgccctaaaaattcctgatttcatcagatcttaacttctgtatgccattgatttaggagggaaattgtccatttttaacactggccttttcattactgttaagcaccagaaatattttataaaattttaataatattaaatatttcattaaaacttacatcattggactcatatgtggtacatatcaggactgctacaaacacacaagaatggaaatgtactttttaaaaaaaatgtgttttctattacatagacgttatactagcaatgtaactaaaattagcagagtaatcatacagcctaatcagcacataaatcttatacaagtgacaagttaaaatagataatagtagttgcaaaagtagcttgagatcaatatcgggtggttatgtttgcttgtatatactatttaaggaggtaagcattggggaagttgggctgaataaaacgggggaggcaagggtgagaaatgctctttagatctaatgttcacagtggatcatcaagtgagaattgctttgctagcaacacataaatattttttcattataggggatgactgttactgggaaagcattggagtaaatatttgttttccttgattatttgctgtaaataattttttgtaaccaaatcaacaaagtactgtgagttcactataggatattacattgtaatatagaagttcctgttttcctgatgttaactataatgggtttctacctgtattccaggaaatagagcaagttgggttgattccagtatgttttatttttcagcttcagtgctaaaatcagattgtgtgcaactctgaatcatggttctataaattcttggctatactaagtaaattacagtatatcttccagtacaattataagaatgctgtaacatgcaggatgttttcttgagcgttttcatgattaaagattaatttcttcctgaatttggcttgatagatttgtattgaagagcactgtcaactaccatttgagtgccatctgtgtatttgacagtatactgtggactaataggaatttaacgaataaaatagtgcatttttggtttggcaggatttcttacagagataaataggctgggcacatttgccttgtaggtatgtgtgtttatgtacatatatgtttcatatcaacgttggcctgtaaacttccagtataaatagaataatttaccaacttgttcttccactgggacataatgtaagtaaactatcttttctagctaactaagcaggtggctatttctatgactagtatgtttcaaattttaatatacattgatgtaattaaattttgtgtgtgtctatgagtataatcatctctcattatctctgcttctgtgggggatcctaatgtaaatagtgtaaaatagtaatatccttgcctccttttcttgactttttccctcattctgtgaactggctttatgtgccttctgtaccttgctccagtgccttaagtggtcagaagtgggtgactaaaagaggtagaaattgccacatgtggataatggggagttgggtatttatgataatacatgggaatgagggagacatattaataattttgaagttaatggacttatttgttgagggaaggattcatggacagttttgaattatgtttcaaatatggatttagaattttatttagggggagaggactagacattctagtcagtgaggatcataaacagagctgagtaagtagttttgtttagagagctgttgggaaataagtatatttgagaattcttgaatcaagagagagaagagtggagtggcttaaaattaaagcatctgtttattcattttgacttgattttctaacctatgtgggaatgctgtagaagttatatggttgaataagtgagggattagacacatttaaatcagagtcattattgaagaaaatatcagaatagtttagtccagggtggactctagtctacataagaattagctgtgagattagatttgtgaggaaagaataagtacaaacaatagtacaggaaagaaatggtatagtttggcatttaactgaataatgtgggtggtgatctagaggctcatgttaggctagcattgtttatccaaaaagaagggctgtaccatttctaatgaatttggagagctctgtcagccatacattgatgaagccctgcagtaatgtctatgattttgcttgcagttatactttgaagatctccagtattctgtcagtttctgagagcgcacaatctgactcttgaaattctggtagagcttgtgaggagaaatcaagagaaattgctgagaacctattatgtggtgtgcatccttctggatgttttacatacctgctttgcttccctgtttctctaccaaatcaaatcttctgtaaagatatatgagggtgggtaggtgaatgggcatcgtgctgagggagaactctccactcttcaaagtttttgccacctaaaaaatgccaaaagccatggtgctacttcagctctttgtgagatttctagcctgccttcttcctttactctttttgatttatgctatctgatggctccaagtcacagatactgagctaaagtcctttctgcagtcatggtcctctttcttgcttccctgaactaccaaactggctaagtgtctctcctttgtgtcccataattcctcattcatagctattttcttatcatttactgctgtatattaaattctattcatgtatttctctccttcacttattagagtataagctcctgaagagtgaggatggtctttttcctttcttatcccaagtgcatggcaaaaatagtagagaaggtgcttaataatggtttcttgtactaagttgaccccatcaactgcagtttggcttctcatcttgtttatccttgtgggatggccttgtacactgtctaaaccattctctctattgcgaaagaatggggcaaggaaacttcttagctttctttttagtctcttttattccagccactctatgctttgaatacctagttttgacttgcttcccggtaacagactaagtctttcaggggtatggtattcacaactctaccctgtactagacagtgtcatgtagactagtaacttggaagattaaggtataagaaattgttgaggtcgggtattctgagcatcagtatacacactgatttcttccccagaatggtgatactcaggaaaccagggagcccctggttacataaggaagtgtgaactgctgcagatagaaattggaacaagacatcctcattactgtaactctgaggtctaatagatgtcctccctacaactacaacaaggtggtctgtgttttccaggattggagaagaaaccaaaacaatttgacagtttttgtcaactaggtctggaggcacttccctgaagtaaaaagatcatctgattcaacgactcctcctcagtctcagtcacattaggtgactacaccagttagtgtgtctctgcattttggttctatttgagaaaaatgtttctgtatggaaaggtaacacaatagtaagagatagtttatccttcatcccctcttttgacaccctactcttgaattctgatagctggagttctttttcttaaacccactaccttcacaagaaggcaaactgtttaaactcacctatctctcacatgatagtagctggtctcataattgacagaatcattggcagtaagaccattatctcttttaaccagtggttgaaaattctacttagttgtctattggagctcaagaaactattaacttatgaacgtaatttagtattgaagcaccttgtgggcctcctggctatcaaagataatcagataccccaaaaggacccttgaactggtatcaaaattcagtagtaactaatgtaggatactagggattagcctcatgattttttttaactaaggtctccagatggccaatgaatttatgaaaccggaaggagctggtggaatgggaggacagagaagatgacgttaagtaactttgcatacatgctctaatttttttttttttttttgagacagggtctcactctgccacccaggctggagggcagtggcacaatcacagctcactgcagcctcaacctcccaggctcaggtgatcctcccacctgagcctcccaagtacctaggactacaggcgcacaacaccatgcctggctaatttttgtaaattttttgtagagacgggtttttgctatgttgctcagggtggtctcaaactcatgggctcaagtgatccggctgcctgggcctcccaaagtgttaggattacaggagtgagccattacgcccggcccatgctctaattttttaatggtcatgtgcccattgagcattcatcattcaggtgagtcataactagagactgtataagggtattgtgaaactctatgcagttctttagtcatgctggggttgggttcttttaaaaacagaccatttccagatagtaaccatatattctggatttccaggacagccctgatttcattttgtcccattgtgtccataagtatacttatgttcgttagacgttatgccagtttttggcttggaaaatatggacatcaggcatataaggacttccttcttgccaactgaaaacagttcatcacagcatagccttgctctttcaaccctgccatcctaactgccagcagtctctgattttgctcccatcttgtatctcccacacttactttaaccctttgtgagttaatttatctcttttctttggtgtctccttgcctctggagtccagcaaattgtgtatccttatactctcacaaagctacttgtatcctagcattttggtaataggatgtactcttttgaaaaatgggacactttcttttttcccagggtgctcttgggggttgaaaactgttctgtgagatactcatcttcagaggcctccgaaaacacattcagtaagaagcagtactactactactaccatgtattgagtgtttactatgtatgagaagttgggtaaaatatttttaaaatctcatttaatcctaaccacctgtgagattggtagtgttcccttttcacagataaggaaatatacttagagagtttgagtttttcaagattctgcatttggaaatccttgctacattccaataagatattagttgtgtacataccaggcttagaattgtggatgaactaccaatgactccaaccccattatagaagaaatttcacctttttacttggtaccaccaggaaataagtatttctatactcttggtagatgaatttttatacattcttcttgtataccactggtcctcaaacttgagaatgcatgaaaaccacctgaagggcttgttactcccagtttctgattcagtaagtgtgagaattaagtgtgtaaaattaaacttgagacttaatttctagtaagttcccagtgatgccaacgttgctggtccagggaccacactttgagtcattgttacatactaattattttttattcagcaaatcattattcagtacttatggtgttctaggcaccgttctaagcactgtggatataataatgaaaaggttaggcagggtctttgttttcataaagcttatagtctagtgggacagatgactaattttattgggataagtgaacagggattgccatagagaacaacagagttgctatcctctactttagatgggttgagaaccctgtctaaaggatggtagttgggtctctttgaggaggtgatagtctaagacctaaaggatatgaagagctcatatggctttcacgcttgaattttcttagctccaacttctgttgccatcactggtgatgactaccttgggagaactccatgaatttcagactgacccctgtgtaattcattctttggtactttgtgtggccttggccaagcttgactgaatagttcctttaagattgtttaccccctctccaccccaaccttcccccaccatccagtatagatacagaagtcagaggaattttaagagtgggctaattttgtcttctggcttcacctagatcacattctttggtatatgatggcttgagaagaatatatgctaaggaattgtgcctgtgaacctgccattcatggccactgcccttaccttataactatcaatgataccttaagattctgtcttaattgccagtttgcaaatttgcctcaaaaggggagacagtgtgggaatctccacaactccttagctaccctgatgttaggtttctctagggaagatttctagattcatgcagtctaagaaggtgttgtcagagcaacacaaaaccaaacttcccttccagttgtggtgactaaagctggaaaaattctagatattcgaaggagactttctacggaactatcatgatttcttgccttcagagttttagttctgaagtttgatgccttactctttttttcccccctctggttctgtcctaccatgacttaaccagcttttcctttgaatccctcctgcctctggagccatttccttgctgtctagtttcattttattttttatttttatttttatttttgagacagagtctcactctgtcacccaggctggagtgcagtggcaagatctcagctcaccgcaaccgccgcctcctgggttcatgcgattgattctcctgcctcagcctcctgagtagctgggattacaggcctgtgccaccacgcccagctaatttttgtatttttagtagagatggggtttcaccatgttggtcaggctggtctcaaactcctgacttcaagtgatccaccctcctcggcctcccaaagtattgggattacaggtgtgagccactgcacccagcctcattttattttaattaaatattttctctggtattctgttcctttggaggaaaagagacccttaccaggtgctacggtatgaatatttgtgacctcccaccagatttatatgttgaattctaatctccaagatgatgctattaggaggtggggttatttgggaggtgattagatcacaaaggtggggccctcatgaatgggattggtgcccttttataaaagaggcccaagggagctcattcatccttcccactgtgtgagacacagcaagatgttgttgtttatgaggaatgggcccgcatcagacactgagtctgctggctccttaatcttggacttcctggcctccagaactatgagaaataaatttgttatttgtgagctacccattttatggtattgtaaatagtccaaacagactaagacaacagatatttctctaggtattttcaggcagagcatttcacttggcctaggtgtatgtatttttggatagcagacttccttagtcttctctcaataaattcctgaaccagagaaggggaatatgagtaattgacttttctggttgccaaagatgtctttagtttacatgaaaaatgttttgaacagttatccagtgcatgcttaaatgggctgtctcttataacacatctgcacatacaggccagatttaactaccttacccagattgaaaatttccttttccttgtggactcagaagtttcttcctgctagtctggttcctgatggtatacagtggataaacattttttttttgttaacccatatatcaaccataagaatgactgaaataaaaaaggaaatggtgtgccagctcactcatagctggagatgataaaccttttctgttgctttagagccagatatccttggttggtagtgtcatgtctgctccatattaacagtgtcttgggcaagtaaaccaatcttgccgagaagaagaaaatgcatatgaaagcacctaatagtacttaattcataatatcataatatgctctcactgaatgttaatgcttgctttcctccttgatgttcttaaagccctgaaacacttgattgagcaaggcataatctctcatggtgtaccccatcagcaccataatcttacattttccagatatggaatccgtttaagaactacctgcttaattatatttattataaaaatgataatctcagagtatccctacttcttcaaggtatccaagaaaggaaattaacaattttgggcgtctacctagtagaggtctcattgacccaaaatgatgatagcattaataattatacctttattgacagaattataatacttagcagtttccaggaactttttaatggatagcgtccttggattcctgtagcagttcatcaagtaggcagtccccatcttgcatatctgtgtccaaggatgaagggaataggatgattccttcatggtcttttgactgatggatagtggagctgagctttgggcctaagtcttctgacacccctcctttccctgccctattccagcacttttatccaactatgccacatttttttttttaatctgaggttctggtacatgatttctcaaattactagaattctaagacaaaatgtttcttaggtttcacctcattttatctctgagatgtttatgttcctaagagatagttcttacgtgtgggagttttaaactctacctagaggtcagagaaagctgtttatgcctttgatgtaaattttgtgcaccatacttagactatactacacattccaaaacagtatttcttgggcctagacttgtaacaaaactctctagtgtgatgtattctcattcactcttttatattaacctattttattctttcagcaaacatatttagcccttactatgtgtcaggggataggaataggaccgtgcaaaaagacaacctctgttttcttggagcttacgctgtagtggataggaaataagcaaatgggtagtgatgtgtactgtgaagaaaaataaagcacttttaaattttcgcccaagccatgagattactaaattgtggtatctatcagtgaccccttgtagaccttatagaccttctaaaaagttagttattgagaagatggcccaggaaaggaacattgtctctgacatccctgtgcagtttctaccttcttttccattatttgaactaagatcttgctttcttgtatggttgtgagcaaccctgatcgagtggagtgtaagggcatggccaaacaaagacagattggagaggaagcctgttaggaataaagcaccttcggagaaacagtctcacaacaaatactgttagagttgtatttgtcatttatcctttaaatgtaatgtgttgccttatagagtgtcacatcaagaacactgaaaagagatgtatttcaaaatatgtatttagctatacaatggttaacaaaacacagcataaaaagcagcctccttaaatgcttctagttttatggtgtactactgtagaatgagttctttttgactgaagtgttttaaaagttttgaagaaccagggagtctgcaagttggaaagaagccattcttaccatgaggcaaatatacttgagtttaatttttaaactataactgctgtttgaccttaaattaagacagtctgttttcattgtggtgttttactggtttaacaatgagaacatttaaagcagctgccaccaattaaaatgattcataagtgctggttgtaaataaatattcttgaaattttaactcagtgaagtcagtctttttagtggcactttctttctggaaagcaatttggtaaaatgcatcaagagctataaaaatgttcatacactttgatctggtaattcagtttcttaaatatccttagaaaataaaactgagatcttgataaactttaataaataaagatgtccctcacagtttatcaaggaaatagttgcctaaattatggtctacctatatgatgtaccatggggccattaaaatatttttgaagagtattaaccatataggaaaatgtttatgcaattcagttgaaaaacaaaactatacaaaaccatacagtatgatcctaaaaatgtgaaaatatttccatagaaagagtgtcaggaaacattatacattttcattttctttgggtagtgagattgtgtatgatatttattttctcctttctacttttctgtattttctagaattttttatagtgaacatgtattgaatttatagtgaataaaaatgttatataagtattttaatcctttcaataagggtgccttttatgaatatccagtccatttatattattatgacctaattttttccacattttcagctttagagcatttttttctagtgaatttttgtttttaacgttttaatgtttatttttatggcacataatgtcaacaattttacctctgcttggtctaatttctaggtattcttctttaaagccaataattcagttccttgttggaatattatttttcaggtggtttacatcaaacagcacacacattcgtagtatgtggtaaagagagttgactctggagccacaatgcctgggtccaaatcttggccctaccacttagcagctatgtgaccactgacaagttaatggctctctctaattctcagtttccctttctttaaaataggggataataatagtatctacctcatagggttgttataaggatttcaaagagttattacatataagtacttaattttaaaaggcctggtatatagtaaatattcaataaaaattggctatttttagtagtgtgtgtgcatatatgcacacatatacacatacatattttcatgataatttgaaaaatgcccttttatatctgccttttcttttatacaattttaattttaaaatgaagggttttatcttattttcagataaaattagtttttcttatatgctttgaaattatttcaaaaagttttcagcaatagaaacctggtttgctttcaatcatattttttccatatttgtaactgatcattcacgtgggctggatggactgaagatcagcttcattctaggtataaaataacttttatttacatacacaaagttgatatattcataaccagttaccctcatctattatttacctcatttattaaagtactgctttaatagagaaggagggggatgggtaggtgtcagtatacttcaaaaataataaaactacatttgtttctttttaaactttataatccagccttctctaatcaaactgatactcccagaaagatttggagggaaagagagctaccttttattgaatcacgtgttgggctagactcttacatgtattatataattctgtagtccaatatgaaaactattttaagtaaagcaatcatttggcaattttactgtcctggattacagaatcacaaatgtgttcctatagaaaacaatttggatttaactgattaactgtttattaaataactaattgcaatagtttttccattattctgtttcatttttttgaaacaggtgtttctgtggtatgtttgcattggcagaataaagaaagaatctgggcaagtttgaaagcatgaaactggtcactgaaagtttcttttcaagaatgaagcatttttttaatcaatctaataatattcaacagagacacatatagataatccagatatcttcatctttagctggatatttggttagtatttaatgccaagaaggagtgtgagaagtagtccctgtgggaaattgtgttttctttggtctttggttctacagctatgtagaaattctggattgagtatgaagtttatttatacatgtacatgtacatttatctgtgggatttatctaagaagcagtggtttggggtattgttcttgctggtgaaagaagtggactgggtggaactctagagaaaaatttgcttttagggataaacatgttcaatagctcaggtggcaaattttgctttcttgtattgatgtgataagctgagtgggtcactgccatttccagaccatatacaccacctttggctgatttgtcttctgtcatgtacctagcagttcagctggaggctttttaaaccaaagtatttaaatatacataggaagttgttgtactggtgcttattggtggctactgtgttctttcttatcttcctagggagtgtggtccttttgtttagcttctgtttcatttgtttacaaagttataggctttgaagtaggcagttatatataggattgcctaaagagacgtggaaagtgagaagtctgctttataagtaagcaattatccttatttcactgccttattacctcagtttctcagccagtgtctttcatgaatttggcttttctcataggcttgacattggcttacttactgctatcctaatttttttgtggaaacttacttagttttgtgtctcccagattagatactagctcagtttactttctgaacatttaactatcaaagctttgcctgatgtgttagtgaggaatttttaaaaaataatttttgataatttaatgatacacatcacattattttttctatttgttccatcataaaagaaattttcatatctggtttccttaatgtagggttcctggccttaggtgactgtccttctatagatatggcattgttattacaagatttgtactggtaagactatgataaatttagtgttttctaggacagtagtgaggtaaatagctgtgctgtaagattgtttaaatcatcatagctgaaaaaataggcctttaaaaatagcgataacagaatacacatacattagacataatgcatgactattaatgacttcctcaagatcttttaggagttatgaataaggtcattcagattgcactttttttaaactcatggagagagtataagaggagtgagctatttttggcatgggcttaaagaaggaaatatcagtgtgactggtaactgacatgtttgtcaagttcagtttctacctgagtgctttaatttcttttaaatttcattactttggactttagagttctcagtatgaaattttttaagagtgacttgtctaacctttgggttctgagtagtgtgttgcccctgaaattggttgagtcattttatattcttctaagagttcaccacctgtcaaagctgaagagatctgtcccttttgccctttatttcctgaaccatttttctttttttattattattatactttaagttctagggtacatgtgcacaacgtgcaggtttgttacatatgtatacatgtgccatgttggtgtgctgcacccattaacttgtcatttacattaggtatatctcctaatgctatccctcccccagccccccaccccatgacaggccccatgacatgtgtgatgttccccaccctgtgtccaagtattctcattgttcagtgcccacctgtgagtgagaacatgcggtgtttggttttctgtccttgcgatagttgctcagaatgatgttcctgaaccatttttctgctggcactaatcttatttgtgataggttttcccacatttaatatgtaaaacctaccacagagtttgaaccttaatgtgacttagggttaaagggctttgagacttctacttttgtccatgaaggagtaactggtgcaagacttgctcctttccaccttacatctcccataaacaactagaaaccagacaaaatacatgaaacaactgtttttagacatcgggcaacagacagcacaggactgtggtcactgagagaaagggaacaaacgaagtgagctctaccatcaccctgactttttgtcagcaggcagtttctagaccacagcattgtgagggggaacccaagcagaactgcaatcttgctgaattggtgagacagagataggaactcagggaggcctaggtggcagaaatttatggagcagagtactggaggaggaaagctactcagagacatagctccagaaatctgcatagatgttccccttatctctggctgaatatgaatctgtgcatgtatcaagggcaacactgtgaggctgggcagaaaacaactgctcaggagctataagctgaaaacttaccagagctcatacagacctgagagatatatgagttcctacagcaagagttgtgagcccttgttgaacacccagggcattccagagagactccagaagggtcatactttagtagtaaaggctacattaaagtaaaggactttaaataattatccacaaataatttaactgcatgacaaaatgaacttcaacagtctttgaagagaggacagcaaattccaaacactcaacaatataatgattataatatctggcatacaaaaaattactagacatttcaagagggaatacaatgtgacccataaccagaaggaagccaatccgtagaaacagaaccagaaatgatggttatagaattagcagacaaggactttaaaacagctattaaaatgtgttgaaggattgaaaggaaaacatgaatatagtgagtaaagaagtgaaagacatataaagaaccaaatggaacttctggagctgaaaagtatactataaaaaatgaaaaattcattgaagaaataaatagcaaattagatgctgcagaggaaaatatcaatgaatttgtatccataacaatagaaattatccaatctgaaacagaatagaaaaaatggaaggaaaaaagcctcagtgaactgtgagacaatatcaagcagattaacctacttgcaactggagtcccataaggaaaggagagagagaaataggcagaaaaaaaattgaagaaataatggctagaaattttccaaatatgatgaaaatgtaaatccataaatctaagaagctcaatgtatccaaaacagaaaaaccacactaaagcaattataattttttaattatttatttatttatttatttttgagacggagtttcactcttgttgcccaggctggaatgcaatggcaccatgtcagctcaccacaacctccgcaccctgggttcaagcgattctcctgcctcagcctcctgagtagctgagattacaggcatgcgtcaccacacccagctaattttatatttttagtagagatggggtttctccatgttggtcaggctggtctcgaactcccggcctcaggtgattcatccacctcagcctcccaaagtgctaggattacaggcgtgagccaccatgcctggcctaaagcaattataattaaattgttgaaaactagtggtagagcattttgaaagccactaggaaaaaaaggacacattacagaggaacaaagagaagaaccatatacttctcatcagaaacaatggaagcttccagaagacaatggaatgacgtctttaaagtgctgaaaaaaaaatactgccaatctcaaatttgataccaatgaaaacaccctttaaaaatgaagaccaaaagaaatgaaggtgaaatatatatttttttcagacaaaaatgaaaagaattatcactggcaaaccttaactacaagaaatttaaaggcagctgtccaggctgaaggaagatgataacagatggaaacttggatctctacaaagtaatgaagagtgccagataaatgtggcaagtgtagggtaaatataaaagacattttccccctcattaaaaaatttctttaaaagttaagttattatttaaaggaaaattaataatctattataggattatatggtatatagaagttaaaggtataacagtagcctcaaaggatgggaggagttaaatggacgtatacgttaaggtctttacattgcttttgtagtgatataatattagctgaaagtaggttgcaataagataaagatgcatcgatacaacctagaaaaattactaaaaagggcataactaataagctaataatggtgataaaattaaatactaaagtatactcatttaatcttacagtaaaagagaagtggagaacaaatgggaaatatagaaaacaaatattggatgtaaagatggtagacttaaacccaactctgtcagcagttatattaaatgtaaatagtctaaccactccagttaaaaggctgcataaaaaatgcaagacctaaccatatactgtgtataagaaacccactttaaggataaagacacaggtatgttaaaagcaaaaagacagaaaaagatatacaaacattcataagaatgctagagttattatgccaataagagatgaattggacttcaggacaggcagtgttacgaggaatgagggccatgtcataatgataaagtggttaactcaagaagacaaaatactaaatgtgtatgtacctaacagatcctcaaaatacatgaaagaaaaaaaatacacataaaaggataagtagacaaaactacaattagagttggatatttcaacattattaattcagtaattgatagaacaagtagacaaaaatcagtgaggagatagaaaacatgatcaatactaccaaccaactggacctaactgacacttataaaacattggacctaacattaccagaatacattttcttttcaaattcacaaaagatctctataaggagacctacaaaacactgatgaaaaatcatagatgacattaacaaatggaaaaacatcccatgctaatggactagaagaatcaatattgttaaaatgaccatgctgcccaaagcaatctacagattccacacaatcactatcaaactaccaatgtcatttttcatggaattagaaaaaacaatcctaaatttcacatggaacaaaaaaagaccatgaatagccaaagcaatcctaaagcaaaaagaccaagttgagagtcatcacaccgcctgacttcaaattacactataaggctatagtaactgaaactaaaacagcatgatactggtacaaaaatagacaaacagatcagtggaacacaatagtgaactggatataaaaccacatacctacaaccaactgatcttcaacaaagtagagaagagtaaacactggggaaaggagtccctattcaataaatggtgctaggaaaattggctagctatgtgcagaagaatgaaactggacccctatctcccaccatatacaaaacttaagatggattaaagacttacatgtaagacctgaaactataataatcctagaggaaaacttaggaaaaactcttctggacatttttctaggtaaagaatttatgatgaaaactctaaaagcaaatgcaacaaaaacagacaaatgaaacttaaaagcttctgcacagcaaaagaaataatcaacagagtaaacagagaacctacagaacaggagaaaacatttgcaaattatgcttctgacaaaggactaacatccagtatctacaaggaagtcaaacaacaagaggggaaaaaccccattaaaagctgggcaaaggacatgaacagaaatttctcaaaagaagacatacaagcagccagcaagcacgtgaaaaaacattcaacatcgcgaatcttcatgcaaattaaaaccacactggggtaccatctcacaccagtcagaatggctactattaaaaagtcaaaaaacaacagatgttggtgtggatgtggagaaaagggaacgcttatacattgttggagggtatgtaaattagttcaacttttatggaaaacaggatggccatttctctaagaactaaaaatagaactactgtttgacccaccaatcccactactgggtatctaccaaaaggaaaagaaatcattacattaaaaagacacctgtactcatgtgttcatcgcagcactattcacaatagcaaagtcatggaaccaatgtaagtgtccatcaacaattgactaaataaagaatatgtggtgtgtcatgcaccatgaaatacaatgcagccattaaaaaaagaatggaattgtgtcctttgcaacaacatggatagagctggaggtcattgtcctaagtaaattaagaaacagccaaataccatatattctcacttgtaaatgggagctaaacagtgagtacacatggacataaagatggaaagaataatagacactggagactccaaaagtgggaagggtgagaggggagtgagagttgaaaaattacctatccagttcaatgttcactatttggttaatgggtacactagaaaccaagtccccaccagtacacagtatacccatgtaacaacaagcacatgtaaaccctaaacctaaaagaaaataaagacaaataaaaaacgcttaactgttttcattgttttgtttgaagtgttacgaattccctgaccatcctgcatacacagtcaaatggaaataccaaaacaaagttccatacaagtttttaatggcataaaaaataggagttgactgtatcaattaatattcattctaaaatttctggacctagttcttctgttattcttagttttgcttaacatttagcttaggaatcggaagacttcaatagaagctcttttttgcctgatttgttttatattaaaataattaattattattatttttttgagatggagtcttgctctgctgcccaggctggagtgcagtggcccgatcttggctcactgcaagctctgccttctgggttcacgccattctcctgcctcagcctcccgagtagctgggactacaggcgcccaccactacgccctgctaatttttttgtatttttagtagagacggggtttcaccatgttagccaggatggtctcgatctcctgacctcgtgatcagcccgctttggcctcccaaagtacaagcgtgagccactgcgcccagcctaaaataactaattttttttaatagtaaagactaagtctcaaaccttaaagccctttgaacaaatgggttcagaataggacttccaaatagaaattacttcatttttgaaatctatagcaaaatgtcatttaaaattaagttgtattttcaggtaatagagatttctggtgtgttcctattatcaggaaaaaaaacccacagctatttttccctttaaatgttctcagtgtaaactaagaaaatatgtgcaaaaatactatttttttccaattaaggtagtctttctcatctaatttagggctctaaaaaactataagattgtctcagcatatcaaatctgggactaattttttttttcgtttgctgaaaattgttgatttgctcttgttaaaggaagaaatggttctttcagttcaaaaattggcagaatcaagctaatcccttaaagtatgcttgtgctttggctgattgtatgtctgtggtgattacccttgattaacaacagcaaaaaattctaccttcccaatcatctgttagactttagtctgccttccttcctctggcatttgccagttaaattggaattatataaatgggagaaagggaatataatgctgctatgatagaatttcttggaacaccaggcaaagaaaagtattgaaagattggtcctgatccccgctttcagatatttgtggtctcctatactaatttatgctgtctatctaagcagtatgatcttattttcctgagccctgtggggtacaggctatttattatacaaagcttggagggaggagtgtggtataaggatacagtggtgacttagtgcattttctttatctacagcaaatggttggatgagaaatgcatctgaatcttaacttctcgaccctgcctcagattagccccctcccatttctctccattcctctcaatttgaatttcatattatctggaggagtctcattcattctataatatgaactacttaatcaaataatcagatcaatacctagctgaggagttgttaaccaatggtataataaatggaaattttgatttggaggaaatttgtatttaacagaggacctgggtttgatgaagtccagctagacaacaggaaaaaatgaagtgagaaggctgagggagatcagaaagagtgctgggaagccatcaagcataaaatggtaggccttgctgtgggcttctaatggtgataatgtagaaacttataaattggggctagtgtttctaggctgatgcagcatttctagtttgtcctggtgtcttctcagctaatctttctctctcccctactgggagaaacaggaggaagaggagattgtgcttatgctcacctgtgtggtgctatgtagtattcataggattttcctattctttggtcttttagaagacacctaggtttgccactcacatttttttttcctgtagtgggggaaaaaaaaaccatattataccagtagtaagaaaatttggaggacttgccaggttctaacactaaccagtttggtgattctgcactgtctgcctggatctctttttgtttttcacctgtaaaatgaaaagcaaatggattatctcttaaagactctttcagtgaatgagcttagatacattgttatatacactttaaactatgtactaaagtttgggttagggatttgtaatggactgaattgtaaccccccaacctctacattcctatgtccaagccctaacccctaatgtgactgtgtttgataaggcctacaagaaattaattaaggtttaatgaagtcatgaagatgggggcctgatccaataggattattgtccttataaaagactgttggagagctcgtgctctccctctccctgcacacactcagaggaaaagctatgtgagtacaaagtggccgtatagcagccttaaagcctagtaaaggaagagagcctttaccaggaactgaactctgccagtaccttaatcttgggctttctagcctccataacagtgaggaaataaatttctgttgtttatgccacctagtgtatagtattttattatggcatccctattacatgatttaaccatgttaggtatgtttttatgaattgaatctgtagtttatatgatttagaaatgaaatgtaaagcttctttttgttgaaataggaagtgaaaggtttttacctggtggtggaaagaagacatcatcatttctgtacttctgcaagctgctagatcctggggaattatggtatttttagctggatgttatgaggaatatagttgtatttttgagctaaattgctgagaaacctgaatacagttgagaaacaatcattatttgatggcagaagaacagaacaagttacagggcttctctcttttcctgtatccccccccccaatataaataaccttgttgagtaccctattctattaattattataattattattgcattggtagagattgatgtaattttgttaatgttgcctcctataaatctcattctaaagaatcttattctaaagaagagcaaattgccagagtctaagacttttttgtaacctctgttttgccttgatatggcaggagagatagggtttaaggtaaaatattattaagtaaatacaccttttttgttgtatcacttaattgtattctgctcctgcaaacatatttctgatttgttctggctcacatcagtagatggggagtgccctgttcagatttacattgcttttcgtacttttgctgattgtatgcaactacatttccctagagctactgttgacctgacagtattggctgctagttggcagggaggattcatcatctagattagatggttacttcctgttcctgtctacagacatgaaaaaatggagtgtttacttttctccaaaggtttctcagaagtaggaaaattactttaaaagctttgtctggttgccttcagataaacattttcattaatatttcatctcattttgagccctcttctagtttgtagtattttttcaatgtatgtaggtggcctcaaaccatatggcaaaagcatttcccaaaacatccaatctttgtcttactatgaactggttttctgtattttttttctcattgagcagctcctctcaacaggctcaaaaccctttttctactttgatctgcctctgattatgctgatgtattaggtcctttttggaactcatacatgttttaatagcacatttaaaaatgaaattgcctattccttccctctgtgttgcgtgaagaaaaaaatttgttcctatttttagataatatgtgttgaatgttctcgtagtcattgccctgtacaacgtggttatcacacacaagatacaatgtcttgtgctcagggatgtttattacgtttctgtctactttaaaatgcttaacttcccggattcttatccccattaaatgttgcttttaggtattttagttgtttttaattccatacacgtgtactttataaaatatgttggatgagcatttgtaatgagaaattagagtcccagatttttaatgaatagttttgttctgtctactaaaagtctgacttcttccatcttcaggcatctgtcctaaacacagtgaggttgtggagtagcactccctcccatctttgacacagatacttccccgcaatcccaactcccaaagtggatgttgcctggggtaggtaaggatcagggagagtatagatcattctgtatctgctctacgtcttatgaaggctcttgagaacacatagtccacagtgcttcaaattcaaagaaatgttaaatctgaaagagcccatagcaagttatcaagactatcagactacttcctgtttcctgaatgtgctgtgcacttttacatgtccatgcccttgcttgttttggagcatctttgctcctcaggctgccttgtaaaatgcagcttgtcctccagcaacttaagctctgaattaatcattctgtcatcagtgatagcatggcattataagaaactattaatatataatttctcccatcttatgtttgagtgccctacaacgtatttcatagtatagtgtttagtttgtgttatttttctactttaagttttaaatgtttacttgagcagatagggttatattatagtaagaatggtgtatgtatatatttcctgggataaataagaaagtagaaggtaaaacacttaaatgactttcatttctagcgtttttgataggaaatgaattcactcacacttttaggtttctcatggaagtcattgaggaagagaatatacaacgtagttctgccttattcagaaaccatcatggtattttaaaaacatgctattatctatattacattgtgattcacttcattctgaagctgccaaaagacctgtcttacatagagatactttggatagccattgttacgggagaggattgatacatttctgtatttctgatttcttaatttatgatcatatgctacttctgtgatcaaaaaataaagtttttttttttttaaaaaaaaagaagagacaggatggcgatcattaaaaagtcaggaaacaacagctcctggagaggatgtggagaaataggaacgcttttacattgttgggagtgtaaattagttcaaccattgtggaagacagtgtggcgattccttaaggatctagaactagaaataccatttgacccagcaatcccattactgggtatatgccgaaaagattataaatcattctactataaagagacatgcacacatatgtttattgcagcactattcacaatagcaaagacttcagaccaacccaaatgtccatcaatgatagactggataaagaaaatatggcacatatacaccatggaatactatgcagccataaaaaggatgagttcatgtcctttgcagggacatggatgaagctggaaaccatcattcttagcaaactaacacaagaacagaaaatcaaacaccacatgttctcactcataaatgggagttgaacaatgagaacatgtggacacagggaggggaacatcacacaccagggcctgtcggggagttgggggctaggggagagatagcattaggataaatacctaatgtaggtgatggattgatgggtgcagcaaaccaccatggcccctgtatacctaatgtaacaaaactgtgcgttctgcacatgtaccccagaacttaaagtataatttaaaaaaaaaaaaagagacaggctgggcacggtgtctcacgtctgtgatcccagcactttgggaggctcaggcgggcagatcacgaggtcaggagtttgagaccagcctgaccaacatggtgaaaccccgtctctactaaaaatacaaaaattagccaggcatggtggtgcatacctgtaatcccagctacttaggaggctgaggcaggagaattgcttgaacccaggtgacggaggtcgcagtgagctgagatcgcaccactgcactcagcctggcaacagagcaagactccatctcaaaacaaaataaaacaaaaaaatggttgctgatattgactatgccagattagaaactgaaaaatgaagaggtgaatttcatccttaaagataaggtttaaattttaagatactggtatttatatgagtaatgaaagaattggtgagaaagtaatcccatctaattcttgtcttcctgatcagtggttagtcaagaacaattggagaaaaattcccaaatggagcattagaatcttggctcaagttataacaggtttattgcatatgatatagaaagcaaaaaaaaaaaaaaactggcttttaccttttgtttgttattttaatacctttagtgtaggtcatccttcacttgaatgctaatgttgacagtaacttgaccttacacttaagtcatctttttgaatgccactggacatttggctcttggaagatggtaactcttagtacttctccctggtttgtatatattacttatttgggaacctatctgccattgtggctgtcagagctcagcataatttaaatgtttaaggagggtgattgaagtacttgaatgagatatcttttcatctatctgctgatgactcactaaagagtattttgaagaaaggatgttctccaactcaccagtgtattagaggaaaaaaacatatggtatatccccttaaaatttaagtttttagaaagcagaaatgcattattccagtattactgtgaatacttatattaccatagaccatccccattgtaaggtacttatctttttataaaatgtcctaaaatgggtaaattatttcataaaaactggcatacaaagttgctctaattagaacgtaattgtttttagacttaaccattaattgaggctgtcagtagtttgcagcagaatccaagcatctactgtattaaacttcatctaaaaccacgttattcttgatgatattttgttataattgatactttgttctttgatgcttgagagattgtatttgcaggtaatacttttatctaaaaattaagatgaattttctggtttcagagtattattttgttaatgtctgctgttgcccttcacctctctgaaccctactgatttttctagatcaagctaaagaatgtcaagcttgatgaagttttcttctatctcaatagcttaaattatggcatttggacatggtttatagtatctatttcctttttccttgtattagttagctgtgtaatagttatgcctgcctcttatactggctcctagagagcaatgactgtgttttaggcatccttgtagcacctttcacagtacatatcccctatattttcaggaagtatttatgaaaaccattggtttttatcccggattttccaaattagacttacaaataagtcagtaatttgaggtttaaatgagtaattacacagttagccataatggttaaggctctatagttaagattgcccaggtttgagtgcctgcttcattatgtatcaactgtgagactccctcatctgtaaataggaatgttagtatcagcctcctagaattgttgatgaagactaacataattagtttgtttaaaacatttattgagatagcaaacatataggatacactcaatataatgtagtagtagtataatataacttttgctaaatgtagtcctattgggctggcctgtgagccccttgaaggcctgtcttttggtctttatatctcaggcacctaacctagcagacagtcaatactcaataaatacttgcttgaattgaattgatttatttaccctatttttatcttccattacagcccactgtttgtaacatggaagattggtcgagacaaaagattacgtggatgcataggtactttttctgccatgaatttgcattcaggactcagggagtacacacttaccaggtgaagaccaatttttgttacctctgcttttacattaaaaaaaaaaacttatgaaacttgaatctgatactttaactccttttactgaattgtcaacgttcttgtcttccttcatgtcaggtttttcctttgtctttaaccatttaccttttctctggtaaaatgttattgatatatattaccataatataaaatactgtgattaatgtattctgccatcgatgttttgaagtgttttttttttcttccagtggccagcttattttgtataacttgaaaaccaatgaccaaatgtccacgggttaccaaaatatgtgatttctatagtaacagtcattatttcttccctcttgtgttttttaaaaatagttgttgtctctttcatcttacacattttgttacacttttaaggacttttgaaattgaaaggagagcctaggaagaaagtgatgccacagcctagcagtataatcattcacattcacacttcacccagaattaattgtagcttgcttattttcttttatctaataaaaggacaaagtaattcctcattacagttgtttaaaactttgttcttaatttctgaattcacaaaaagctatctagcacacaatgtgaattttttggttcaagtttagatttcaagcaaattgtgacccaaaattatttcaaaagaagaaaattccttaaataataagctattagtaaaggaatttcctgtttttgttcacattttagggtgattatctgatacagtttctatagttgtaatatgcacagtgtctgtccaacaagaaattgctccctgctgactattggtacttggggcatgtttctcaacctccataggtaaaatagtaattacagtattttgttctatatacttaatagaggtgttaggagaatgaagtaataatcactattttacttcaggattaatgtggaacattattttactgtagaactgcataaatgcaggctcatagcaccagttaataaaatactgtaactgagtttggtattctcatatttgaaggtatgcagtagctcacagctgcagggttttctcagcttacagtgaagcccagaaaaaaaaccaatggcttgggggatcatattcattttttagcttttcacaggtataagaaactgggtgtttggatttgattaaataacatacaggctgtaagggttgaaacacatattctggaaataaattcaacttgttaaagataatataagtactagtctaggcatgttagattttttttttctgacataaaatacaatgggctcatttttgggacttcagcaaattctgccaatggctacctttttgggacaggtacatattaaattacacatttaatactaatcaatggcaatttattgtacatttcccaaaataagttgttatgaggaacactggttcctttgcgctacctgaagaaaagaattctgtgaccaaataagtttgggaaacactggttaaaaaatgtaaacaactctgctcactgtaggacttctcagaaccttttatgttaatagtgttatgtatatctaagagagagaaatagaatgtagcattttccaggcttatttgactacaggacccttttatcctcccaccccaaagtctgagtgttccaaggaaaacatttttggaaacacaagtctgttttcaaaacagaatattactttatatttgggtagtaagagttggtattatagaaaccctttgtgctttctagtgaaattgtagcagaaatcccattatcaaacattatataccttagaaatctttcgtagtggtcattgtggtagcaattgggttttgtttaaagaaaaaaataaattcttttgccaatgttggcaaggggtgaaaacatccaacttttctggacttgtccatttatatcctagggtaatgaccagaagaattacagtataattttctgacaataatgtgattctgaatgaattgttcaaatacttgaagttggaaatttgcctacatttgtataccttgttaccctcattgcaatctatagctcttcctgtttacttttcatcttttttctcatgtttctatacagcttcctcaaattgtatatatcacattaaagaggcgtgtgtgtgtgcgtgtgtatacatatgtttgtgtgtgtatacacacatgcacatacctggttttacttctcatttttgtttggcttaatttcttttgtataacaagatattaacaatcatactatttggaaaagatgaacaaaagaaaacaagtcttacaaaatacaattaatcttttttcctggattcattttagcatcaaaagttgtaaggagtcatttttaaaagttggaatataatatttttctgttcagtagtgtgcttatcatttttacgtattatgttattatgattatttttgttaatggctgccatttattaagaatttactatgtcagacattgttgaggagctttacatgcatagtccttgtaataacccttaggtactaatatctacattttcaaaatgaggaaactgagaattaggtaatttaaataatttacccactcacacatctattaagtgatagaaccaggattcaaacccagagcatgtgtctacaaaatccatcccctaaccgaggcaaaattttctgattatttatgttttgcagctttgtcatgaaaataatgaacttgaaagcaagttactataaattttataaatcatagatcagtaatccttcaaaaattctagttaggagttaagactgaaattttgcaacaggaaaatccatagatattattatggaaagtatacaactcagagttgtatagagcagacagaagaaaattgacttgaactaatattgtattaaggataaagcttattacaaaacaatactactgtaggataggaaattgtattctttggctacatggactagactttaagaatacaattttttttgaacataaaaattggtgattcttggcttctggtcatcccaccttaaaaacccataactcacaaaatgaataaatagaattaaatgaacttaggggataggggcataaaggagggagaaagcaaaacaaaaaacaaaataaaacaaaacaaaaaataagcagtgaaattaaaggcattctaggtataggcatctttttaaaaattcaaatatccggttcatctgtgattagatagactattgtttgattttcagaatgttactcaattatatctcttctttttttttattgtggggaaatatatgtaacataaaatttaccattttaaccatttttaaatgtatagtcctgtggccttaagcgcaatcatgttgttgtacagtcatcaccaccatccatctccagaacgtttttcatcttccccaactgaaactctacccattaaacatgaactccacattcttcctcctccaggccctggcaaccaccattctactttgcgttgctatgaatttgactactctaggtacctcgtatcagtggaatcatatgatatttgtcattttgtgactagcttatttcacttagcataatgtcttcaaggttcatccatgtggtagcgtgtgtcaatttaccttctttttaaggcagaatatattccattgtatgtatataccacattctgtttatcctttcatccattggtggacgtttgggtgggtggcttctaccttttggctgttgtgaataatgctgcgatgaacataggtgcacaaaatatctgtttgagtaccctttttcctcttaaaagtgaaccagtttatagaagacaatgatctagcttgtgtgtagtcccttaactctaaaacctttcttaaaaatatgaccagatattttttaaaatgaaatgcctatcctgaattaagtttttatttataaataaaattataaacttttaattttaataaaattatttaaacttttagaattaaagtacttgtcatagtcaagttgtatgttcaaatatgaccgggtattttttaaatgaaatgcctatcctgaattaagttttttaaatatatatataaacataatcttttaaatgtaaagtacttgtcaaagtcaagtcatatgttctcctaattgaaattttgattttagattgaaataaaatcttataaagaggctgaggatttcttctcaattgtgaaaatacatagtatttgtgtaggtaatgaaaagtttatgagaagtacatggaactattataaatagactattctttgtctgaccttgaaggatctgggtaaaagcaggaaagattatagaaaatacgaagcaggatggagagctcagaattattgataaaagtctatccatagaatttggtgataaagtccacaaattaccctatttatcattgctcaagacttcaaagtagaaatattctttgtccgagctgaaggagataatttccagtattgtgtttatggcttttatatattagaaagcagaggcagattcatttccccaattttagtacttagaaaacatacttttatagagaggaaaattaccactaatatagatgaatataaacatctcagtcaaaaaagattcctggccgggcgcggtggctcacgcctgtaatcccagtaatcccaggccagcggatcacgaggtcaggagatcgagaccatcctggctaacacggtgaaactccgtctctactaaaaatacaaaaaattagccgggcgtggtggcgggtgcctgtagtcccagctactcgggaggctgaggcaggagaatggcatgaacccgggaggcagagcttgcagtgagccaagattgcgccactgcactccagcctgggtgacagagcgagactccatctcttaaaaaaaaaaaaaaaagaaaaagaaagtttccttaaaattttggctaataaatttcccagcaaaatgcagatctatttctttatgtaaattcaagttggcagtaatttttctagaacacattaagtaattaatagatgtattcttattcagcaaaacaggattgtggtctgtcaccacacttaaaagactatctttttttctcctttgttgtacttagacctctcggcagtgaaataattatgcaggtgctggcagttctagaacttgattgtgaactatgccacttttgttgaactacttaattctaagaaattagcaatgaaagtttagccctttctagggaacagtatgaccacataaaaggtgatgtgctgtgttttgttttggagttttattttgttctgtgtgggttagtggggttgtgtgtcaggggagtttgaggggggattgattgcttgcatggtacaaatattcactttccattagattttttgagatactgaaaatagctaacaaacctactttattactttcaaaggtcctagctagattgggtacttatgggattcattgtaaactgaatttgcttttatattttggtgttgtaatctggcatttttctaaagcagtatgagtttaaagccattataagcagcataatattttccctgtcatagtagaccatcgtgtgatcatttttattcttgattatttgggtaaccactctaggctcattgtgaacacttagattaaacaagttcctcctccctctcatttaatattagtctttatggtagcatcacccagattgatttttcttatgaaaagaaaagctgtatgaatcacctctgactgtacattattgttatggaagctcattctggagatgttaaggccaaacaatttttggcaagtggttgtggcaagacttctggctaaagtatgcattttggggaaataaattagatgtatcacaaacaatgcaaaattaattagtttaatttacaacctacattttttgcctttttataaaagagatgatggcctgagtcctaaaacttatacctaatttgatagtttcagtttattaattacaaaatgagaaacatttgtcagattttataggcacttaatttaaggtacagtttggaacctaggttgttgtacgctctttactcaaaattatccacatgaagcatggtgaactatctgctcaaactggaatcctcattttagccatgaggttaatgcactccttcgttatcccaaggttgtgctaatgtgcagagatgtagccacaaaattcccagcagaatgtggaaactaagcagcaggaaccatttgcagaatgggtaatggctcctgaattgtagagaattgtctgaattcatatagcacctactgccacagaaattaagtgtagtgagtatatcagattctaattccttatcacatcatttagatctttagagtttccagttggaatctccctgctgctttgattaagagccacaggcaaaatgcctggggcagaaaaggccatctgtgaaaaggtagtgttgagagaagctgaaaatgggctttttcagcaccagggctcttggttcttaagtttgatagggagagagtgaactataagaaatttaccctatttttacatctatctgtaaagtttaatacctctctggtccttcgaggctgtttccccttttaatcatgtttaaacagttcatcctgcaaatcttgtcttaattttgccttaggagtttatgatatattaggagagataagaagttatcgaaataattgtagtcctaggtagaaagcagtttttctcaagaagcagaggacgtgatactggatgattactactctatatctgttataaaagctaaaatgtatttaaaggtatctataaattattttatttggttcatccctagttcactttttataaaagcaaaacagtatgtaccactttctggcttgtttttatcctacatggtccaaaaaggtcaaaattatagggatgcgtgtaaatcattattatcaaagcaaccatatacaaggtgttgggtatttatattttaagaaatttgtaatacatattttaaaggggaaaatgatcttgtcatagaagaaaaagcctttgaaatagaggactcttaagagtgtgcatgcacatgcacacatacacagggagtttaccaaacattagctagaaccaagttggattatagctctgatgcttggcaaatgaagaaaattaaaagttatagtttagatttcactttcctcttgtcttgttaaagtgaattcatattttgttttagtacagtaaactgatatctgtctcctttcctgagagtcattgtctgcgatagtcttcattttttcagatgaatgactgaaatggtaaagctaagttagaacacaaatattgtatgaaattattacattggatgtggcctaaaattatactatagacattaaaaatatatttcttttgtctgaatatttacataataaatgttgggcttacttataagtgtctaaagtatttgagtcattaggacctgaatgaacaggaggacagatttgtatcttagtgttctggaagaataagatggttatgctttgatgtaactaaaggtgattatcatgcaaatcctatgcttttaccacttttaaggggacaatgttaggaatttgagtactttaaaataattgaaagttgaggttttggtgtagcaattgaatattaaaattttagttatgatcttatgagcatgagaaatactttttaaaagtagaaggcaaaagaaatgaagcccttctctgtgatctttcccattctctcaaacttcaaactgccttaaatgtggttatccaaagtagtagtccttggaaaaaacttacttttcatcattgataacaatttgttgatctttaaatgctaaacacttattgcatcgtaagtcctttatcttgcatcataaatatatttttcttagaaacaactctagtttttcttacattctctctcaatttttaaataaagagcaaactttcaacataaaagtcctgtcctaaagaactacattatctgatctacttcttgttaacaaaagaaataaatatatctatatttatataacaaaatagacatggacaaattgtaacatttaaaaaattttctattggaatagaatatcatagatgctaggaaattctaaagatggaaaacaatatagtcatgtaccgcataatgacgttttggtcaacagtggactgcatatacaacagtggtcccataagattataatactttaattttactctatcatttctatgtttagatgcacaaatacttaacgattgtgttacagttgcctacattatgcagtatagtaacatgctgtacagctttgtagcctaggagcaataggctatatcatatagcctaggtacgttgtagactataccatctatgtttgtgtaaatacactctatgacgttcacacaacaatgaaattgtttaatgatgcatttctcagaatgaatccccaccattaagcaatacctgactgtatttaatacattcttttgagaatgaagctctaattattgttaatatcaaatatgcagtgtacttttcagtatatttaaaatctgaaagtgaagaaaatacatttggattcataaggtacagatttacacttggtgtgatgttcagaaaactcatttttgttaattttacttcagctcaaaaaattatcctgtaaatctacatatggaaactatagacttattcagattagattagcatgttattgtctccatttttaacactctgttttttttatttctacatggaaatgctaacttttgtatccttcctagtagtgaaagagaaagttagaaaaggccataaaataaattcttcagaagctttaattaaagggattgcccagaactcaacttcttgttgctatacccaactaccttcaggactactttgtatgttctacaaagctgatttaaaaggttccaactgcagtcacttcactgaggatggcaggaaagagaatctcttaagttctgcaggctgcttttaacctaaaccattcttctaagatgaccattacttgcctcctagctaagcctggagaagtattttaagcctttgaaatgagtggagctgtgttgcatatgaagaacagtaaacaactgtacactgctggttagacttgtactgctaatgagatcatgggttcaatccctatttggaccatatttttagacaatagctaccactagatcccaggcgttgattacagtggggctcagacagagcacgtgggcgaatcagtaccaaacccaagttttagcatcatttcagcatatgaaacgtgctacattaaaagtacccaaaacaatgtggtcttaaaatgtgatatacacaaaccctttgaaagtagcaagacagacatgccctttttctaaaattgacaaatcccgaagaggaagaaaagagttgggacaataaaacactggttctggaatctggaatgttgctttaagtccaggccagcagtgacaaaagttattgtaatgacctctgaacagacagacactgccattgagcaggcctctggtatagaaaacatggtacatttgggagttgtgaatatagctccaggtgtgctcctaaatcagttcacagtagattatgcttaacaacattgagatgttattggaggtgtggatgaggaagtttgttgttgcagtccttttttgcaccttattttaaagaataaatgaaacatttttctaattcccttttaaaaaattttaaatggaagggaagtttacttctgatgcttcagtgttgtaagttcaacatatagactgtcaacctaaattcatggtataacacagttcttttcttttttctttctttttttttgtatctgttcaatgaaaataaggtacaacccaggtttttacatagtctgactagaagtattccacttcaagatctgagagtagcattttctcaaactttcaccttaaaaaacaacatcactaaacaaaaactatcacacagaatggataagaagttttgtagatctttttggtgatgaactatgacatgagccttatagattgtaaaatatagttgaaactaatgtacataatgaaaatttttaaattttatttgctgttaaattctgtgaaatttcagttatttaaaataaacatgcaaaaatatgaaatgtaatgtttcagattgcaaggtaatatgtaatatgtttgtaagatactctggtctaatactaactagtagtatttggatttgtacagtcataattcattaaaatgacttcattttaacatgtaccgatgtagactaatattgtaagttctgatttaaagaatggtgacaaaatggcgcatgtaatacttttgcaagtgttggggaggtcggtatgttttgaaaagagtaatttaacttttgggtgctaggaaatgggttatctcaaagaccattgctggcaatgggcaggcctggtaatactggcacagagcattaatcatacaccttattaacggtgaggtgaataactttgaaataaagttttagggaagaaaagagactacccaaaacttagctatctcatgaacagttgatactaattataataataattgctttgaatctaaaagaaaaaagaatatttttagatgttaatttttcttcacaaactctttgaagagtgtcaatgtgacattagagaaaaggtctttggagtggcagtagaactgacaacacaggttggacttcagcaggcctgaaaatggtatggccaaaaggggagatttctttctgcctctaataaagagtagtggctaggaataggagtcatctcagatgatactggatttcagctgaagcaactcttaaatatttcagtggtaaaaggatgactatgttaaattcatgggtttgtaaatacatgttataaaatgtaattgttctttttaaaagcacatatttttttaaaagcctacattttaaagttgtcatctattgtgtattgagatgttcctgtgcctcacagatcagctcactaaggtgtggtagctattgtctaaaaatatgtaccctctcatactgttgcagcttcctcttcataggctttattattgcccagagcagcacatttaccccattagccaaaatggcacaaacaacgcccattggcatgactgaactctccttagttggtgtcaatccttatatctgagataagaagctttcctgtgtctacctttctcacctagagtaaaagccaaagtatttaaaaaacatatatttcactcagagtaaagttaatgttctgcaatgaatgccaccatgctcagcttgcccctctcacctcatctcctactcccctcttcccacctccattcattctcttggccttagctaggctggtttccttgtttccctttgaacacaccaagcatggtccccgccaggggctttgcacttgaattttctttacttgcaacagtcttctactagatagacatgtagcttggcttcctcacgcccttcaggtctctattcaaatgatgccattatcattgacacgtatgtaaaatagcaaggcctacatttgatatctggctctccctgcccgtttaccctgcttcatttttctccgtagcacttatcaccacctggcatactgtaaatttacttgtatatttgtgagtctttcttaatgcgaatgtaaattccatgagggcaaggactgctgtaatattcctcaaagcctacaacagtacgtggtacatagtaggcattcagaaaatattagttgaataaataaaagtcttgtttttatcagcatttagaaattgtggattataaagtataattctttgtcttactactttacctagatgtgaaattatttggtcttattgtggctagtttcttatagttttcattgagtgcatattgaatgtattttttgtgtgtgtgagtggtttgacattaaaattctcttttaaaactcattttatcatgaacacttttaaatactcgcaaaaatagactattataatgatgcagtcatttttataatagtgattttttttctcttttctttttgtggggaacagcgtctcactatgttacccaggctagtcatgaactcctgggctcaaacaatcctccagcctctgcttccctaagtgttgggattacaggtgtgagccaccatacctggctgctttttcattttacttatttttattttaatacttgctttttaagtacagaggcagtatgaggttgtagaaagaggtagccatatctgggttctagttgtgaatccctcaattcttagctttgtgacccaagggaagctactgaatttctgccatgtcttggttttctcatctgtaaaatgggtataattctaaactggtaagtttgttgtgaggattaggatatatatgtatatgaagtatcttatacatactaggtacgtagtaaatatttatattgtagtacatgcatagtaaatatttatatttctgcttcaggaagaaattaagtagtgagaatggccaagaaatgaaattttaaatatatttatagcaatttcagtttttctttttctcttggacacatgtaggtaggcaggaattttcataatatgagaagaaacaagcattatcagtaaataaaccagtgaccccataatcagtcaccatcacatttctgtttatgtaattctttaaaaaatacacacatacatgtaactgatcattgagcaaaacgctatcagtctatatttcctgttggttctgccccacagatatctcttgaatccaccccatcctcttcagcctcactgccactgcctttgtctgggttcttattctggctcactggtttccctgcttccctttgaagccattgtacaccaatcaccagaattatctttgttgacaaaaatctatctcactctccttaaaacagtgcctgttattccttatcaccagagaggaaaacccatttttattaagaagcatagtacttgaggacctaacctcacactccagccatgcacacaattattcaccacttcccaaatatattctttcatgtctctctggcttcacatttttttctttgcctctccccatttccacccagtcaactcctacttatccttcaagactcagcttgctcattgcttcctctgtgagatttccttgacagtccccaggaaaattggtcagtctcttttaggcctctattataacacttaacacactggattataattattaattttatgtttgtctctcccttttgaaattgcgctccacagtagtttaccaagcaacatcaaagcaaactaacaaaaaccagtctcattgctttgtagcaactttgcttgatcctgataaccattctactctctttcttttctgtttgcatatgttagcttatatctgtcacctcttcttgctgccagcatacttgagccagtaagagttaccagtgttgattgatagtgcaaagggtggcttaaggccacttggaattagactgagccagaggacagggatctttatacagaacactttagaaaacaaattgacatgaggttgatctcattataagtgactgaagatgcactatgtgaattgattcctgccatggaaccatagacctagaagagattcttttaagtcatctagtccaacccctatcagatactttaatctctcttaaaaatctcctgagtaatgggcatctagcttctatctgaacatctctgtagacttggaagtcacttccagttaagtagcccatttcatttcaaacacctctgaactctactcccataacttcagttaccacatagttttagtcgaagtgctagaagtcaaagattgcctgcaattagcactttattctttatagaaagctgcattaaccagcagtggttaaacttaaccctccgagtaatatctgaattatctgagtctttaggagtttaggagtagtaagataacacagctttacaattgagtctcatccacccacccatacaaattttaactcttcccttattgttgaaacctttgaagctactgctgccacaatatctctcacagtctaccttagacttctggagttggctgaaccctagagcccagagattccaagatagacctggtgctagatcttttagtgatcccaacaatgtcacagagttggaactagagttagaacacaggtctcctgacattgccttggactatcattacaaattccagaatagaaagtacccatattatatgtgacttgatgcttaaaaaatgaaaaagtacccataaaagtatatgaatttgttaattttagttaagaagcatacaatttcaaggaaccctgtaatgaaatgatcattttgtaatgtaaagatttattcttgagttatctgccttgtgtcaagtttaggcatacttccataaaatgaacaatacccttagaactattcaactgcaggagtaacaatatcagagttagagaatctcaaagcaaaaccttagatttcccctttcctttcctttccctttccgtttccctctcccctttcccctttcctttcctttctttccgagtctcgctctgtcaccaggctggagtgcagtggcatgatctcagctcactgcaacctctgcctcccaggttcaagcgattcttccgcctcagcctcccaagtagctgggactgcaggcatgcgccaccatgcccagctaatttttgtattttcagtggagacggggtttcacaatgttggccaggatagtctcgatctcttgacctcgtgatctgcccaccttggcctcccaaagtgctgggattacaggtgtgagccaccgcacccagccagatttcccttttctttaaacatatctctgcttgttatgtgtcccaatcatacttgtaacttctgttttgtgtgtgtgtgctggaactctcgtaggtattttatataagttacctcatctaatatttccaacaaccttatgaaggtgaaagtatttcacttatattgcagttagggaaaacaaggtcttagatggttaagtaatttgctgaatgacagctaataataacctgattctatctaattccaaagcctgtgctcccaaccactgtgcgatactgcttccttccagtaatatcactcccccttccctggtgaaagcttcttatggacatttgtttcactgactcaacaggtattccctggtgtccacttacagaaaaaaaaaaaatcactgaataacctttctcttcatttgggaactcagtttcttaactcagttttccaaaatctcccttatacccctagtccattaattccagtctcaacttctcttgggttctctttccttttagaatcttgaggcactgtctcccttaatatgacttttttcttcacagctatcctcccagttcagtttggtattctgaacttccatagtcccatcagaatttaccaccttctcagggatacatactccccaaactgatttctttctacatttgatcttagccaaaaggccaagaagtgattgatctctttctgtacaacatttgcacttaatatcagtacatttacatggaatactagtttagcccttagattctagccagacacaactctctgaaatccactgctgactagagagcctcgggggaaggattcaccataaaggaactgtgaataaaagtcctgactcagctattctcttcaactggccaaaaggtagacatttaggagttaagaagtgagacagttccttagaaattataattaaggaaacaaattccaagtttctaagtaattaagaccaaatatattgtcttagttttaatttttgcaatttgaagttccttaggagcagtttttgatagaacaaatgatcataaaacagttagataagtggcagacaaatatatccgtgactggtatcaggaaggaattgaaagtatgtagtcgtggactgtgtccatcttattgaacttagatttcttacaatagtaaggtttaaaaaaacaataaaattctccagattgtatttttttcttttcttttcttttcttttctttttttttgagacaggatctcgctctgtcacccaagatggagtacagtagtgcaatcacagctcattgcagcctcaacctcccaggctcaaggaattctctcacctcagccacccatgtggctggtactacaggtgcataccactatacccagcaaaatttttataatttttgtagagacagggtttcgccatgttgcccaggctggtctcaaactctaggctcaagtgatctgcccacctcagcctcaaaaagtgctgggatttcaggtgtgagccaccacggccagcctcagattgtgtctttttcttaccacagctgggatttgaggatctcagtatttaaaaggcaaagaagatttttagaatgtgctttctgtagtatacaagtattttatgatgcattcttttaaaattctgtggcaaacaatagtgaaaactttagaatcataggcatcattcattatcttctattttgctcctgaaccatttaaaaacttttctttgtctgaaacaagtattattggaaacctgttatcaggataggtatttttaaatttgacagtgaaaatatctttcaaacttgttttcatatactgcctgttaataataatgaaattaatgaattaatagccaggttggttgggacattgtccatgtcacacgtgtttctttctttcgtttttgtttgtttttttttttttgagacagggtttcactcctgttgcctaggctggagtgcagtggtgccctctgggcgcactgcaacctgtgcctccagggctcgagtgattctcctacctcagccacccaagtagctgggattacaggtgcaagccaccatgcctggctaatttttgtattttttgtagagacggggtttcaccatgttgtccaggctggtcttcaactcctgggttcaagtgatctgcccacctcggcctcccaacgtgttgggattacaggtgtaagccaccacacatggccaatttttgtattttttgtagagacggggtttcaccatgttgcccaaggtggtctcaatcacctaggctcaagctatccacctggcttggcctcctaaagtgctgggattacaggagtgagctatcatgcgcagtgctgggattacaggagtgagctatcatgcgcagcccatgtcacgtgtttcctaataggttttcaaagaattttgccacagtaagaagtttttatttcacatattcaagtcccacatacctgatcatggcaaaatggcaaattaatgatgtagttgaagagaaaccagcaaagagctgtagatgctagctcagaaatgagtaacatttttagtctttgggatgtcagtgatggtgcacagtgtatttaagtgtcatttttgtcataagccagagaagcaggaggaaagagtaatgggacatggtaaagcagaaattctgctaagtagctgaatgttagagttgattgctgctattctgtttcttgcctatagtgtagcccattttaagttcaagactaagaaaaccctccaaaaagtttaaaaaattcaaagcaaataaactagtaaatgctcatggctctacacttttacactgcagatttcttctatttcccaaaggactcacccagtgatgtttcctaactccccagagttactgtttcttcccttgtatgttcataacacattactggtatctctgttacagcacttgctttatcttgccttccaatgtagtttcttacatgattgtctttcctacttagattggtagtcccttgaggacctgaactatatttttcacatctttgcatcccctaagtagctatgagggattaggcatagagcaaaataaatgtttgaataggagagtcatttcccctagtatactgaggtatttgtttactagctgggtaagataattaaagaaagtgttaggagccacagcctatgcaaaggaagtgagaaatgaagattaaagcatctctgaaagtataagtcataggaaaataaaattaatttgcaaaggtgatttacttttatttttaggaatggtgagatgtatctgcattttgttttctatttatagttttaaatcaaggaaatttttactcacttgttttataactggatcagttttcatttaataaaggataggaacactcaattcttatgggatatttagatattctaatcacacctattaagttgtgctattataaaaatgaaacagttgaaatacaagtttaagatgtgctcccatggaagaatctatatgtactaattgtacaaatgagatgagaaacagaaatagcctggggaaaagaaatggggatgctatttaacatcctatatattacttctagcagacaattgcaatttacaatcactttataagaagaggtgccatgagggctgcttattaaaattgttttatgaaggacattttattcacagtagcactactgtccatatattatttttaaatccctacgagagagatggtcatttttgtgaagtttcggttgtagttcctggtcctacaaaggtttagtgagtgagtgatggcttgtcagaaatgatctttctgtgatggctgaaaactttgggaggaccaaagtttcaggtgagcaatcctaggtcatagcttcacatcctgccatttattatctagttaattatgcttgattctgcttgatacaaaaataaaatttgcattcaacaaacaaaacagtacctcacctctttttcacaaagaagaagatttgggctagagattgggagattttgtatttagcaaatttttaaaagtccttttgagatgtgtcttctaagggcttttgtttgctatcattaactgtgggaatatttgctcctgaatggatcccaccttatgctgagcccagcttcccttgtcattccccctgcaataaatactatacaataagtgtctatgtaacaaataaacagtttggaggttaaatggaatgctcaatataataaagctccattgcagtagggagaaaagtccttttgatatgcatttgataggaatgtgttaatttcaacaaaacatctggtataaaagagttgtgaatgcaggacatttgagggggttacagaaggagaagggatttactgtgcttaacaattgccagtagtcaggccacttccaagttgtgattttgtcagacttagaaattaagtgggatcacatctactcagcccttcagtgggagaagatccaaatccagctgcagcaaggagcagtgactgattcagaagtagtgagctctatccagtgtctcctagctggttttcattaatatgcttactattgccctctttatattctggctttttaaaaaaatatggcctttgtggtttattggttgaacttgtacagctgaatctactgtaaaaggtcttttttcactggcattatgtcctacagatttgagtgttcttgctgttctatataagataattcaaacttagaatagtcactatagtttcaaagcttgattgaaagatacattcagtgttttctctaaatatgtagcaattataacaacacagctgtagttaaatacataacttattataaatcctgacagtcttccttctcatttatatcaggctgacataaggtttagtcagttcaattccacatttatcgagcacttaactctgaccatggtactgtactaggtactatgcagctacaaagatcaacagtacatgatgtctgtgctcaagagctgagtgatgtcttttgagggaaattggcatgtacacaaaataactgcattagatgtagaaacaatgctactggaagtgggagaaattagctctagttggatagattggggaaggttttactgactagctgacatgtaagccgaacctctatggacatatacgactcaatttcaacattcaaaagtggggatatggagaagatattcattatgcatccagaaaacttcctgagccaaatgtaaggagacagagaaatatatatgagaagagaaatatatacaagcagcccaagttacatccctgactattactattaccctgactcgggctgcttgtattaatatataggatggaatggaaaggatagagattagagaagcagttatgaagctaatcttaaatattccaaatgaaagatggtagaggcctgaattaggttagtaacaggagggatgtaaagaaacatataacagagacaaggtagtaattgaacaagatgagacttgtggaaagtaagctaaagggaagagttgaagatggcttcaaaggttccttcttagatgatggggcagggggaggatgataagatgaaaggtgataggcaacacaagacaagaagcacatttgacacattgtttgttaaagagtcatttttaatgtgaaagtaatttttaattaatcctagattatctttttctgaatttgaatgttgaagattttttaaaattaagaatttattgaaaattgtttgctttcaggatatggtagtgagagtgaaatagagtaatacattattatacattgtatcttattaaatattttatttaaaattaaaataaataaaatagttggaaaagacccttgatatcattattttctcttaggccatgccacaaagcaaagcttagaaaatacagctgaatcctcaaacttctttctaaccaaaaatacattttgtggataagaaatctataaagaaataaatgtttgtaaacattgggcggttgttatggaatttaaatatctgttcttattacctaagaatgtctgggtttcaaggctgaattaaaatagattccaggcatctttaaaggtaaacaacacatctgttgatttgtctagtacaatggaaactgactgaattttgattatgataaaaatcagcatcttccatctatttagcaatacttttgggtaatcttttctcctttggggaattttccagatgtttgggaatatgattccaatttacaagagttgtttttatattgtagctgagtgatgtcctaactatgaaactcttaggttggtgtaactgtatccaaagggtcctctgcaatgtgtgtaggaatgccctgtgacaccttggcttctttgacttgcccagactctcaaagctaggtggctggaaggtttcctggaggcagagtccagttctcattgtagtaatttacattaacaaaggaattaacatttccagctatcttctgggatcactcagttttgagcaacattcatataatgcagtgaaaatgaatagctagtaccacaaaacaatttagatggttcctttggtacagacgttgacttgtattttctgaaaggaagagaagctctgaaattcagtgaaaatgacagggcggttgctattgtacacattattagaaagaaccatttcaaataacaattgtaaacatgtattttaatgctaatatactgtaatagcctagcattgagtagtgaaacaatttcagacaagtgtccaaattgttttatgactacatttatttcttagtatttatttagaaaattagtagtcaatgcttagttttatcccagtatggattataacttgtataatattctatagaaaaatgttacctaactggaataactcagagctgcctccctctgccccagcagttggtttgtgccctatgtttgctgattaccttaaatatttgcccaagtcaagccataatttaaaaagcaaaattctcatttaaagagtcacaagcttagggtgtcaagttgtagatgagtttggacttgtgggccctcttgttcctcctgattaacactgatgatacagagatgacaaatatgattaacccagcatataaagagacataacatcttaaaagagaggagagatttttggtgactttcttggccaatactattttggagatttttttcccatacgaaacttactggctagcatttcacttttgttggaacattgacctatgattattttattcagtattcttgcataggcctttgaaaggatacctatcaattttattgtaccaaatgttcttaagaaaacacatttggtagttctgatattttgaaggtttctatagaaacaagaaatcttacagccattttttttatattgttgctctgatttacaattctgtatatgtaaaggaggagtcttatcacctcaaaccaagcaaaatttgtagagcaccgatgatgtgcaagttttgtgtcttacagtaagggaaacctgtacaaatccaggagcttacaatataattagagtagctaggctctctttgtgacaaggtaactaagactcctaggcagtgagccatgcttgcagagggagtggttgtggagagctggaagactgccctgtgctagtgaagtgagagccagtatagatgtgtgaggagtaacaacctccaggaatgcttcctttggacaatgatgctactttgttgggtttgcattagatatttatttcataatgattatatgtttagtacttaacttacaggtttccaaagaattttagctgttgttttggctttttattatgtttgttttttttgtgtgtcggtctataacctcaggggcataagccttttttcccttccccctattttacagctagatgtacccccaaggtatctacattaggtatttctcctaatgctatccctcccctaggcccccaccccccgacaggccctggtgtgtgatgttcccctctctgtgtccatgtgttctcattgttcaactcctacatgtgagtgagaacatgcagtgtttggttttctgttcctgtgttagtttgctgacaatgatggtttccagttttgggcgggtgtatgtgtccaggaatttatccatttcttctagattttctagtttacgtgcgtagaggtgtttatagtattttctgatgttagattgtatttctgtgagataagtggtgatctcccttttataattttttattgtgtctgtttgatccttctctcttttcttctttattagtctggctagcggtctatctactttgttaatcttttcaaaaaaacagctcctgaattcactgatttttttttgaagagtttttcatgtctctatctccttcagttctgctctgatcttagttatttcttatcttctgctagcttttgaatttgtttgctcttgcttctctagttcttttaattgtgatgttggggtgtcaattttagatctttcctgctttctcctgtgggcatttagcgctataaatttccctctaaacactgctttagctgtgtcccaaagattctggtacattgtgtctttgttctcattggtttccaagaacgtatttatttatttccaccttaatttcgttatttacccagtagtcattcaggagcaggttgttcagtttccatgtagttgtatggttttgagtgagtttcttaatcctgagttctaatttgactgcagtgtggttggagagactgtttgttatgatttctgctcttttgcatttgctgaggggtgttttacttccaattatgtggtcaattttagaataagtgctatgtggtgctgagaagaatgtatattctgttgatttggggtggagagttctgtagatgtctattaggttccgttggtccagagctgagctcaagtcctgaatatctctgttaattttctgtcttgttgatccaatattgacagtgaggtgttaaagtctcccactattattgtgtgggagtctaagtctctttgtaggtctctaaggacttgctttatgaatctcggtggtcctgtattgggtgcatatatatttaggatagttagctcttcttgttgcattgatccctttaccattatgtaatgcccttatttgtcttttttttttaatctttgttggtttaaagtctgttttatcagagactaggattgcaaaccctcccccccccgtttttgtttttttttttttgctttccatttgcttggtaaatattcctccatacctttatttgagcccatgtgtgtcttagcatgttagatgtgtctcgtgaatacagcacaccaatgattcttgactctttatccaatttgccagtctgtgtcttttaattggggcatttagcccatttacatttaaggttaatattgttatgtgtgagtttgatcctgtcattatgatgcaagctggttattttgcccgttagttgttgcagtttcttcatagtgtcaatgatctttacaatttggtatgtttttgtggtggctggtaccggtttttcctttccatatttagtgcttccttcaggagctcttgtaaggcaggcctggtggtgacaaaatctctcagcatttgcttgtctataaaggattttatttctcctttgcttatgaagcttagtttggctggatatgaaattctgcattgaaaaatcttttcttttagagtgttgaatgaatattggcccccactctcttctggcttgtggggtttctgccgagagatccactgttagtctgatgggcttccctttgtgggtaacccgacctttctctctggctgcccttaacattttttccttcatttcaaccttggtggatctgatgattatgtgtcttgggattcctcttctcgaggagtatctttgtggtggtctctgtatttcctgaatttgaatgttggcctgtcttgctaggttagggaagttctcctggataatatcctgaagagtgttctgcaacttggttccattctttctgtcactttcaggtacaccaatcaaatcaaaaaatatttggtcttttcatatagtcccatatttcttggaggctttgctcattccttttcattcttttttctctaatcttgtcttcatgctttacttcattaagttgttctttaatctctgatatcctttcttctacttgatgattcggctattgatacttgtgtatgcttcacgaagttctcatgctgtgtttttcagctccatcaggtcatttatgttcttctctaaactggttattctagttagcaattcctctaactttttttcaaggttcttagcttccttgcattgggttagaacatgctcctttatcttggaggagtttgttattacccaccttctgaagcctacttctgtcaatttatcaaattcattctctgttgttttgttcccttgttggcgaggagttgtgatcctttggaggagaagaggcgttctggtttttggaattttcagcctttttgcgctgttttttcctcttctttgtggatttatctagctttggtctttgatattggtgaccttcagatggggttttggtgtggacatcttttttgttgatgttgatgcttttcctttctgtttgttagttttccttttaacagtcaggcccctctgctgcaggtctggtggagtttgctggaggtccactccagaccctgtctgcctgggtatcaccagcagaggctgcagaacagcaaagattgctgcctgttccttcccctggaagcttcatcccagaggggcacccgccagatgccagctggagctctcctgtatgaggtgtctgtcgacccctgctgggaggtgtctcccagtcaggaggcacgggggtcagggacccacttgaggaggcagtctgtcccttagcagagctcgagcactgtgctgggagatccactgctctcttcagagctggcagcaggaacattcaagtctgctgaagctgtgcccacagccacccctttccccaggtgctctgtcccagggagataggatttttatctgaaagtccctgactggggctgctgcctttctttcagagatgccctgcccagagaggaggaatctagagaggcagtctggctacagaggctttgctgagctgcggtggcctccacccagttcgaacttcctggcggctttgtttacactgtgaggggaaaaccgcctactcggcttgagctatatttctgattcagttattagtgactgtaagatttatacttagagatctttgagcatgacaaagactgtaggtgaggatctagcaacaccaacatggaagtaaaagctctcaaattcacaataattgcaggaagcccagtatactcaataaagaatgaatgaaatatttatttaaaaagtagttttgcttgttttagtgacaccgatttgcttgtgttagtgacaacaataactcagaatgggctaatggagtgttaccaagtagaagtcccccagagacctgctttttaacatactacacaaaagatttgtaattatgatgttacagtgcctgtagatggttaattccagaatcctggaaataatttattctctttaagcaagtcctgtatttcccttacaaccttaattataaagttgatttgcttagcagacccttcttttccaaacttgctaaggaaaactttcagtctaggtctgtttgaattagcacaaattttgaaatagtagagttcaaattaatgaggttttattctgttatgaagagcttgttttccatcattgataattatttccaggaaagttaagtctgcagaaagcattctctcagtttccttaatgttgtttaccaaagtttaagaagtggtttttagttacatgaggggagagtgaggacatggcagtggcaaaggaaaatgaggtgctataacctggtctctcagatttgtggagcaggctttgagcagcattctaaaccaatattattccttgtaaaaggcaaaccagaccttggaattttaaagtctaatgtgattgagagaatgtgtgctggtgcatagtaatactttaacccccatcagtcgggtaagttgtaagaacctcttaggtgacaaataccctgacagccccacgaggcatgcaccatttccacccattttccctagagtcagcccttctcccactagataattctcattgcttcagagggttgattttcaacaagtcctccatccccctagactgcttactaacctgaaatcccacagagaacaggaagagtggccactggatttttttggaggatttaaaaaaatttgtgtactaatatctgattttctttaggcccatgttcatctaaagagtccgttatcttatgtttcttttttctatgcctgcccttgatgtcctgtgattcatccagttcataagatgttcctttataagaaggtgagaaaagcataaaaatagactagtaatatgggtccctatgtgtttcaaactgcaataaaatattattattaattgccccatataagaagcaatggagctccttcaggatgcagagtttatgtgtgttttccaggggggtgatagaggctgggagatcaaagcaattctgtaactttatcatggaattatgtttttatctatttatagcagtctatgagttttagatagaaaaatgttgccaaactttgctgtactttgaatgtacagtaatctaaagactaaaaagaacagttaacaccttctaaatgaacagcattaaataaataaaaacaggggaagacacacttcagtggaacagtttaaaaggatattttgaatgtaggggaacactgaccatttaataaagtataaccagtaatgccatttaatatttgttatactgccaataactttattaaatttgaaactaccttcctatattccttcattcattcactaaatatttatttaccagctactgtgtgctaggcactgggtatataatggtgagtaaaaatgagcacagtcaccatactcatagagctaaagttatacctataacatatacatggggataaagagtccaaaagttagtttttaatttggatttctatagggttttgcttagcctggtagatttctagagataggctagtatccatgaactttaagaagtaataagaccttgtgagtttaggtgtcttcctcttttttttttctttttttgttttttatttctggaatgtgacttagtttataagacttgcacttctcattaggtgctttgagtaactcgtataatatggtattgtagtgtagtaaaacttcaatgaaacaaggtgttccacagcattgaaattgaatgtagcatgctcctggatgtatactcgtgcttggcacatagcaggcactcaatacatatttgttgaaatagttcatgttcatagttatgccctcatatcagtaatcattaggactgctacttattcgtgaaaagttttgtcactatggggagcagagctgttatcacatgactgtaatttaaattgcatagattttatccattgcccttttctcttttcttttttttttctagtcctaactgctagaaatattacccctgaaggtatttgttttcttttttttttattatactttaagttctagggtacgtctgcacaacgtgcaggtttgatacataggtatatatgtgccatgttggtttgctgcaccatcaactcatcatttgcattaggtatttctcgtaatgctatccctctgccagcccccaaccccacaacaggccctggtgtgtgatgtcccgcaccctgtgtccaagtgatctcattgttcaattcccatctatgagtaaaaacatgtggtgtttggtttcctgtccttgtgatagtttgctgagaatgatggtttccaacttcatccatgtccctgcaaaggacatgaactcatccctttttatggctgcatagtactccatggtgtatatgtgccacattttcttaatccagtctatcagtgatggacatttaggttggttccaagtctttgctattgtgaatagtgctgcaataaatatacttgtgcatgatttataatcctttgggtatatacccagtaatgggatggctgggtcaaatggtaattctagttctagatccttgaggaatctccacactgtcttccacaatggttgaaccaatttatactcccaccaacagtgtaaaagcattcctatttctccacatcgtctccagcatctgctgtttcctgactttttaatgattgccattctaactggtgtaagatggtatctcattgtggttttgatttgcatttctctgatgaccagtgatgataagcattttttcatgtgtctgttggctgcataaatgtcttcttttgagaagtgtctgttcatatcctttgcccacccttcgacagggtggtttttttcttgttaatttgtttaagttctttgtagattctggatattaattagccctttgtcagatgagtagattgcaaaaattttctcccattctgtaggttgcctgttcacgctgatgccagtttcttttgccatgcagaagctcgttagtttaattagatcccatttgtctattttggcttttgttgccattgcttttgatgttctagtcatgaagtccttgcccatgcctatgtcctgaatggtattgcataggttttcttctagggtttttatggtttcaggtctaacatttaagtctttaatccatcttgaattaatttttgtataaggtgtaaggaagggatccagtttcagctctctacatatggctagccagttttcccagcaccatttattaaatagggaatcctttccctatttcttgtttttgtcaggtttgtcaaagatcagatggttgtagatgtgtggcattatttctgagggctctgttgtgttccattggtctatatctctgttttggtaccagtaccatgctgttttggttactatagccttgcagtatagtttgaagtcaggaagtgtgatgcctccagctttgttcttttggcttaggattgtcttggcaatgcaggctcttttttggttccatatgaactttaaagtagtttttttccagttctgtgaagaaagtcattggtagcttgatggggatggcattgaatctataaattactttgggcagtatggccattttcacgatatcgattctttctatccatgagcatagaatattcttccatttgtttgtgtcctcttttatttcgttgagcagtggtttgtaattctccttgaagaggtccttcacatcccttctaagttggattcctaggtattttattctctttgtagcaattgtgaatgggagttcactcatgatttggctctctgtttgtctgttattggtatataggaatgcttgtgatttttgcacattgattttgtatcctgagactttgctgaagttgcttatcagcttaaggagattttgggctgagacagtggggttttctaaatatacaaccatgtcatctgcaaacagggacaatttgacttcttcttttcctaattgaatacctttatttctttctcttgcctgattgccctagccagaacttccaacactatgttgaataggagtggtgagagagtgcatccttgtcttctgccagttttcaaaggaatgcttccagtttttgcccattcattatgatattggctgtgggtttgtcataaatagctcttactattttgagatacgttccatcaatacctaatttattgagagtttttagcatgaagggttgttgagttttgtcgaaggccttttctgcatcttttgagataatcgtgttttttgtcattggttctgtttatgtaatggattacgtttattgatttgcatatgttgaaccagccttgcatctcagggatgaagccaacttggtcgtggtggataagctttttgatgtgctactggattcggtttgccagtattttattgaggatttttgcattgatgttcatcaaggatattggtctaaaattctcttttttgttgcgtctctgccaggctttggtatccggatgatgttgaccgcataagatgagttagggaggattccctctttttctattgattggcatagtttcagaaggattggtaccagctcctctttgtacgtctggtagaattcagctgtgaattcatctggtcctggactttttttggttggtaagctattaattattgcctcaatttcagagcctgttattggtctattcagacattcaaattcttcctggtttagtcttgggagagtgtgtgtgtccaggaatttatccatttcttctagattttctagttaatttgcatagaggtttttatagtattctctgatagtagtttgtatttctgtgggatcggtggtgatatccccttgatcatttcttcttgcgtctatttgattcttctctctcttcttattagtcttgctagcggtctatcagttttgttgatcttttcacaaaactagctcctggattcattgatttttttgaaggggtttttttgtgtgtctctctctctttcagttctgctctgatcttagttatttcttgccttttgttagcttttgaattggtttgctcttgcttctctagttcttttttttttttttttttttttttttttgagactgagtctggctctgtcacccaggctggagtgcaatggcgcgatctcagctcattgcaagctccgcctcccgggttcacgccattctcctgcctcagcctcccaagtagctgggactacaggcgcccaccaccatgcccggctaattttttgtatttttagtagagatggggtttcaccgtgttagccgggatggtctcgatctcctgaccttgtgatctgcccaccttggcctcccaaagtgctgggattacaggcatgagccacggtgcccagctagttcttttaattgtgatgttagggtgtcgattttagatctttcctgctttctcttgtgggcatttagtgctataaatttccctctacacactgctttaaatgtgtcccagagattccggtacgttgtgtctttgttctcattggtttcaaagaacatttttatttctgccttcatttagttatttacccagtagtcattcaggagcaagttgttcagtttccatgtacttatgtggtattgagtgagtttcttaatcctgagttctagtttgattgcactgtggtctgagagacagtttgttgtgatttctgttcttttacatttgctgaggagtgctttacttccaagtatgtggtcagttttagaataagtgtgatgtagtgctgagaagaatgtatattctgttgatttggggtggagagtcctgtagatgtctcttaggtctgcttgttgcagagtcaaattcaggtcctgggtatccttgttaaccttctgtctcgttgatctgtcaaatattgacaatggggtgttaaagtctcccattattattgtgtgggagtctaagtttctctgtgggtctctaaggacttcatttatgaatctgggtgctcctgtattgggtgcatatatatttaggatagttagctcttcttgttgcattgatccctttaccattatgtaatggccttttttgtctcttttgatctttgttggtttaaaatctgatttatcagagactaggattgcaacccctgcttttttttgctttctgtttgcttggtagatcttcctccatccctttattttgagcctgtatgcgtctttgcatatgagatgggtctcctgaatacagcacactgatgggtcttgactctttatccaacttgccagtctgtgtcttttaattggggtatttagcccatttacatttaaggttaatattgttatgtgtgaatttgaccctgtcattatgatgtttgctggttattttgcctgttaattgatgcagtttcttcttagcatcgatggtctttacaatttggcatgtttttgcagtggctggtaccagttgtttctttccacgtttagtgcttccttcaggagctcttgtaagacaggcctggtggtgacaaaatctgtcagcatttgcttatctgtaaaggattttatttctccttcacttatgaagtttagtttggctggatatgaaattctgggttgaaaattcttttctttaagaatgttgaatattggcccccactctcttctgtcttgtagcgtttcagctgagagatccgctgttccctttgtgggtaactggacctttctctctggctgcccttaacactttttgcttcatttcaaccttggtgaatctgacaattatgtgtcttggggttgctcttctcgaggagtatctttgtggcgttctctgtatttcctgaatttgaatgttggcctgccttgctaggttggggaagttctcctggataatatcctgaagcatattttccaacttggttccattctccccatcactttcaggtacaccaatcacacgtagatttggtcttttgacatagtcccatatttcttggaggctttgtttgtttcttacttttttatctctaaccttgtcttctcgctttacttcattaatttgatcttcaatcactgataccctttcttccacttgattgaatcggctcttgaagcttgagcatgtgtcacgaagttctcgtgccatggttttcagctccatcatgtcacttaaggtcttctctacactgtttattctagttagccatttgtctaatcttttttcaaggtttttagcttccttgcgatgagtttgaacatcctccttcagctcgtagaagtttgttgttaccgaccttctgaagcctacttctgtcaactcgtcaaagtcattctccgtcccactttgttccgttgctggtgaggagctgtgaccctttggaggagaagaggtgctctcatttttagaattttcagcttttctgctctggtttctccccatctttgtggttttatctatctttggtctttgatgttggtgacctgtagatgtggttttggtgtagatgacctttttgctgatgttgatgctattcctttctgtttgttagttttccttctaacagtcaggtccctcagcttcaggtctgttggagtttgctggagttccactccagaccctgtttgcctgggtatcaccagcggaggctacagaacagcaaatattgcagaacagcaaatattgctgcgtgatacttcctctggaagcttcgtcccagaggggcagctgcatatatgaggtatctgttggaccctactgggaggtgtctcccagttaggctacacgggggtcagggacccacttgaagaggcagtctgtctgttctcagatctcaaacgctgtgttgggagaaccactgctctcttcagagctgtcagacagggatgtttaagtctgcagaagttgtctgctgccttttcttcagctgtgccctgcccacagaggtggagtctagaggcagtaggcgttgttgagctgaggtgggctccgcccagttcgagcttcctggctgctttgtttacctactcaagcctcagcaatggcggatacccctcccccagccaggctgccgcctcgcagatgcatctcagactgctgtgctagcagtaagcaaggctccgtgggcgtgggagctgccgagccaggcacgggagagaatcaccttgtctgccggttgctaagaccttggtaaaagcatagtatttgggcagggagtgtcccgcttttccaggtagtctgtcacggcttcccttggctaggaaagggaaatcccccaacaccttgcgcttcccgggtgagtcaacgccccgccctgcttcagctcgccctccgtgggctgttcccactgtccaaccagtccgaatgagatgaaccaggtacctcagttggaaatgcagaaatcatccaccttctgcattggtcatgctgggagctgcagactggagctgttcctgttcggccatcttggcaactcccattgcccttttttcatcctcaaatgaagctatttcctttctgtatctattgtggtgttcctaatatgtagcatagtacagaatcagcaattgccactatttcagcagcacattttgaagcttttccaacatattttattaccccatgtgcttatctcatggaaacaaaagtaaagtaggaccttttcaatgggagaattaaataacttttaagggtaatagaatggaaacctatacaagtaaaatttttctttgaaaactaggttcttaagatatgaccagacaagagatgaagagttaaaatgtccttttctgttttatcaggctaattttaaaaatgtttgttgaaaggagtaaagtaaaacctgttccaagttgagattggaaagtaggtttgcttaacgtatgagactttagcagtacatcaagaatcacatatttgacctgaactgaatctacccatgtcattgtgctatttacttgaaaacgaatgttgagattatcttgccctgaacaattttgtagttatacacgcacaaccagaacatacagttgcttttacaatagggacagattctctatttagagtttgataaaagagaaccaaatactctattttaaaaatgtatagcctttcccttgaataatcctttatgtagctcagcagctaagtagaaatgatgggacagaatggatgaactgcgaggtgagaccagcccctactaggagcgtataagcaagatgaggagggagtggagtggataagaaacgcagaggaagacaatagttaagactgcattctccacacacacatagtgttggtgctccgctgctcccccacccttatctgcttaatttataagttctgcttggcttcatcatgctgacacgtgccaggtgcctgtcagtgctgagttatgttgggcagctcactgtttcactgttttagctattccctggtgccctaggcatcattttcctctttgcatcttgaacatctgctctggagtgttattggattatgtgaaagaatgatggaaagatcagtgaattggggaagtcaggagatgtcactgatttctaagtagttttgtgactttgggcatgcagctttttgctcttagttatccccaaaatcaaatgaaggatgtagactagatgatctctaagcgcttctagctgacatttgcttgaccccatgactttagggggccttgttcttggaggacacctattatgatttctaatataatgtagtattagctttgtctatttcatggggctgttttgagtttcagctaggataaaagatgtgaagatgctttggaaactattaagaatcatataaaacaaaaatgatacgagtagtttaaaagattctttcctccaaagataccatatagtgataaaaattaaagtaattccatttaaatgaatgtgaggccaattacagaggccataagaacagacatgcagttatacttaccatagagaaatatgccatttaaaagcacacagatcaaggaatgattcaataaacattgattgattggttaggcagctaggctttggggatgaggtattctacttttcttcctgatcccccttgtgcttgtcaagtttgaaagaaacaggcagtggatcatgttcttttctctgtcactatcacccatccactccacgaaagttagaatagaacattaaaacctgtacagaagggaatgggtcatcttgacccaatagcagagtatgagaacatgaggccgccttgcatactggcttgtcagacttggcctcgccagcactaggtagcagtgaaggcagctgccgtatgcctttgtctttgtggtcctcttctcttcctccacccccattctgttctttcatgtccttcttgtgaccttttactattctttcttccttaccttactagagtagaaaagaggagcgcatacaaaaggtggggaaaaggaagaagagaaaggaaaataaagattaaaaactttacaatgaggtagtggggaaggttgggctcctctctttctctttctccttctcagtatgacggacttgataattttactttgtacctcatctttaagtttgacttcattcttttctttagttacctttagtccccgatcagtgacatatgcagaaaattataaacaggccgcatgataggaaccagtatcctgcctctcagcagacttgtatcatctaggactggcagtagttttagaaaggacagctgaaccagcctgacatgacacataagttagagtgacaacacatgttttgcagtttatagagttcaattaatagatttgattgccatggaaagagggaaggaaaagaattgcatgactcgtgtactgagtatgagagagcttattcatacaggttggaaaagcaaaattaaaaaatcagaaacaggcccaccagcctagatatgtccaaaactagtactttggtaacctattatgacttccagcagattaagtttcaaactgtggaaagggcttcggaataagggaaggcttagcatcccactaataaggcttattaagtttagataaaacagatgtttttcaatggtagcagctctgagtcaccaagatcaaaatggagaaagaagagaacaaaaacaagctaacactttcattaaaaaggtactatttttcttaggcattttcagaacctgctcacatttatacttaatactttcagttaaatcctatgaacggaagcattaattggggaaaaattccttaatactgattaaatgtatatacatttatgttgatttgctgacattctgaaagtggtactatgaaaagagaatgggatttagaggcaggcggtcctaatttcatatgtcagctctcttacctgtttttgtttctttgtttttgtttttgttttgagatggagtctcactttgttgcctgggctggagtgcagtggcgcaatctcaactcactgcaacctccacctcctgggttcaagtgattctcctacctcagcctcctgagtagctgggattacaggcatccaccaccatgcccggctaattttttttgtatttttagtagagatggggttttaccatgttggtcaggctggtcttgaactcctgacctcgtgatccgcctgccttggcctcccaaagtgctgggattacaggcatgagccactgcgcccgaccagctctcttacctgtttttagaaccattggcaagttacttaatctcactgatcatcactgaacctcagcttcttcctctacaaaatggagttgttttgaggactaaacaacttaatgcatgtatagtaccttactcacagtaggtacttagcagatattggctttctgagattttaagctgcttttgctcatagtgccatgtctaaatatcttaggaccagtcttctagagcttgatgaggagctttaggccatccaaagagggatgcacctgaaggattcattgtggggtgagataaaaatattagaaagtctatttatatcattttagataaaatataagaaagtatttaaactccactaatgtttaacatgtggattgaccctgatgctctcctttggtccatgttggagagtcactgtcatatactctaaatgagggatcccgagaaaagtgtgagatttcttgatttggtgagagttcatggtggcatgcacattcttttgctcactttaggcatattgtaacatatttcagtttacatgtacctagttaagtagatttctagttcttagtacaggttgagcatcccaaatccagaaatctgaattgctccaaaatccaaaacttttgagtaccaatgtaacgcttaaaggaaatacttcagatctcagaattttggatttgggatgttcaaccagtataatgcagatattcccaaatcacaaaaaaatcccaagtttgaaacacttctagactccagcattttgaataagggatattccaacctatataatcttcatcctgtggtttctttgcaggaatcttcttaagctgtttgactattgtgtgtaggtcagttaaagctagataaactaacccacgcagaatggacaagtggcttaggaagattcctgcaaggaaaaaaatgggctgatgataacagtgataatgcaagggcaagaaaatggtgaactagctgacacttctatgagtttcctcttaatttagccaagtcatgaagtgaaaacaaaaataatctaatcaaatctgacaagatgtcagccccaaaacaagaaaggatcaagagcattatttaatttatactcactgtctttaataacaaagcctactctaagtatcatgctttgatatattagcctgtcatagtagtacaagtatatactttataaatatacatattgaggatgtgtgctcaaactttttttagtgataagaatactcaatcaaaactgtttggatcctggtgatgacagacgacattgtcagccaatccccatgtggtagtgaggacatgtcctgcagttctgaagggattctatggattttttttaatttaaaaaacgaaaaactaattttaaaaaaaaacagcttggagactgctattttaaatgaggaaagcagttgctgcctatggaatctctcatctctcattctgtatctgctgcttagaaatcatttttcttgtttttgttttgttttgttttgttttttacctaaggattttgctatagtatgaatagtaggatagagagtaatatatctaaatccatcaaacatgatttagggaactttatttctgataaacatttcttctacagaagtaaaagaacaattcctgcccaaaagatttaaaaactgtagttcaagaaaactaagaaactgtttcaaagcagcatatgaatccctgcctgcagtataatggaaactcttgatgaagatgtaccttacttgatgtagatttgtttctgaaaaatatatatatatcttttttttatttctgtaaaactccctgtaactctgagtcagttggtaaccagtaaaccagtagcatattgtaaaacagatcttttcaaaaagagcgctaacctgctctgattattcctctcagcagtcctatagcatgattttaacacgtattttatacatatccatatattatttagtaatctattcttatattctccatggctctttgcataataaaaagcaaatagtgggtgtttaatacttattttgaaaatgaaagaaaatgaaatgaaaacaccagaacctggaaaggtagtcattatcccccgagatggccacatttaattcctagagaagataacttgtttagttcttcccacagcacagcttagtcctgtggctccctttctttcaccagagccataatatggggcagccctgtggacagacggatgatcaatcagagttctttgacagccactacttattgagtaggttagtaaaggcacttgtgcagttattattattttatttgttacagttgctccattaggtgggtactgttatgatctccatttcataaatgaggaaatgaaggctggcatagattaagagacttgcccaaatgtcacacaactaatgtatagtggagccaggatccaaatgcaagtatatctgactccagaacccaagctgttggccattgtaatatgttatgttctagagaactgtgaaatagtgctcattaattaacgattacttcaattttgcattttaggagctatatttattggcataagtcacagagaactgttgttataccttggagacacacttttgatgggtctggggaagtaatactaatttgggattgtagaccaggtttctaaattccaattcagttcaagaggtggttcattcagttttatagtatatcctaacttaagagaacacacggatgagatccctggaaattttgccagtctgtgtgttacacagtctcttgaaggtagagacaatctcatatcttcacatttccaagcttataattgtcagtggtcatatcgtaatcttttccaaacccacacatttttttcttgccaaggcctcgagagcactgttgttatggtgtacagtaacaaatgacccagttatattgagttttaaagatgaaccagattcataaagagaaaattaaattatattcattttactttggcagattttcatcagaaaaacataatttaaacaaaaatagtttctagtagttcatttctaaaaacaagatagagtaaatctagaaactctgcagagaaagcattatgtagacattttgtagagggaaataagaaatactttctgtatatacaaacatttagccatctgtttctttatgtatcttttattttccagttttagctctgctccactaaatcaaattcagacccaattctcttaatttagaggggaggaatttgtggcctaggaggcagattctgatgatacttgctggtcctcacagctggcagctcacagggaattttcccttcctggtgggcagctatggctatctcatagagagtagaggcttttaagaatgcaagatcagagcatttcaggaactttaatcagagggcagtaagtgataacactctaaagcctaagtgaatctcataggatagaagcccgataatatatatcaaaacctactgaacctgttatcctttatctccctctcctctctcttacttttccattctccctttcttgctttctccttgtttctttgcatatgtctctatttgagccctttctaagtgtcccccttttttgtactttctttgactcctacttcttttttcagcttcttgcttttctcttcctttctctttttacatattcctttttcctttttctttcttttttttttttccagaattggataatatggtttttttttttaatttaagttttagggtacatgtgcacattgtgcaggttagttacatatgtatacatgtgccatgctggtgcactgcacccactaactcgtcatctagcattaggtatatctcccagtgctatccctcccccctcccccgaccccacaacagtccccagagtgtgatattccccttcctgtgtccatgtgatctcattgttcaattcccacctatgagtgagaatatgtggtgtttggttttttgttcttgcgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccccgaggaatcgccacaccgacttccacaatggttgaactagtttacagtcccaccaacagtgtaaaagggttcctatttctccacatcctctccagcacctgttgtttcctgactttttaatgattgccattctaactggtgtgagatggtatctcattgtggttttgatttgcatttctctgatggccagtgatgatgagcattttttcatgttttttggctgcataaatgtcttcttttgagaagtgtctgttcatatcctttgcccactttttgatggggttgtttttttctttctttctctcctatcttctcttccttttgttccatcccttagttctttcctctattccccatgaattacccatcatatcatattaagcatatatattaaaattaataaatgttaatggtcattgagcagcaagaaggttttattattactgtaaaaggaaaaacatctcccagttaagtaacactgtacatatagcttacaattgaaacttttcttttgagtaacagccctcaccaaaataaggcacctttcctccttccttaaccataattgtgtcttttgttcttcctctctacccttaggtttgatgaataggcacatttttacattttgttttgtgtccattacttcgtgaattttagaaagctaaaattgctacttagtgagacagagcggtagataatttttcagatgtgggtttaggattctagtattctgagtttctggggttcaaacatgccatgtatgcattctattccagaagctctagcagggaatgacagaatatggaatttcctggtggttgaaacccctcatgaaaaaactgcttttagttttagactaaaacatagttgaattgcttctctttgcctgtccaaacagggatttttaatttgggttttaattacttccttgtcctgaataatagttatatgtaatatgaagcccctctcagtttgataactttccagcagttaaccgattaaggtcaacaatattttagaaagtgaatgaacaagtgagcaaatgactagacagagtcccttaaattatttctgttacatgctctatcgtttacgatgagccttgtaatatctaaggttttgcctcttttcagcgacttttttttctttttagcatagtttccaggcactgtcacaaactctttggttctttcatagctaaactcttaatatcttttcttaaaatgttcatttttattaaagtactatataacattatatattaactttgacaaatgttaacgttccttctcaattaggtgaggtgtattcttgagaaggtgccaatttgaattgaatatatttgaatttgatatgtgaactaaactgtaattgtttaaagcttacccatccatcatatgggtgatggagcagctgactgattttacatgtaagtgttttgttttgtttttctagcaatatttaaacattagaaaatgatttcctattctaacaaagagaaattcatatgaatttacttacaggacccccttgtcagttccttagactgcctagaatttaaattggcagatactactttggtataaaatgctttctatggacagtattaatattttaaaatgttttactcctgcagatttccagtagacaggaagtctagctctgtttaccctttggctactaatgagtgctgctgaatgattatttatcatctttaggtagaggtaccacaggtatgagatcagaattgccaagtaaggcaagcatttaattttaaaatttgaaaacaaatccatgcaaaggtgacaactaaagtatagatactcgaaagaattttggacttgagtcagaaaatctcagttgtatccctacccttgtcattaacttagctgagtcaccttgagtaagtcactgcccaactccagattacagtattctctctaaaagcacaatttcaacattgcatattctaaagagagcttggttaaggaaagcttggttgaggaaagctgaatcttgttgtttatcagctatccacaccagcctggcagctctgaggtcagtctccagctgtattttcatctttttgtaatctcttaaatccttgcaggctttcattgctagttcatttccctagaaatttacatttagagacattgaggacttcctacctttgtaatttttctgtgttcatgaatttaatgaaaaattacttagagctggctaaaaaatgcaagaatcaaaagtcttgtttaaatgtctctgtaaaatcagactattcccatcatgactaacaacctttactatttcagagttttgaaatcagtatgtttgaatcttgacatggtgaggcaccattgtcattttatcccattcattgttctagcattttcctactaactccttgttctaaacattcttctttttttttaagcctagaatgagtgaacaaacaacaaggctccatgtcatgagaaaagcactgtagcctgatcttcacttatgttttaggtatttgaaaattacattgatttcaaatagtttgaactgcattgagctaaaacttatcttttattggtctgctaggaaatgaactaaacaaaataacttgcctcaaagtattgagaaattaactgtatagcgacttcagcatgtgtatttttaaaatgaaaaagctagagctaggtacaaaatgtgcttcattaaaggaggtctagcactatattcaaaaggtcaaacaacaacaaatattggtgtggatgtggagaaactggaactcatacattgctgctgggaaagtagaatcgtgcagccattgtgagaaatagttcattggttcctcaaaaagttaaaggtagaattacctttatgatccagcagttccactcctagctatctatccaagagaaatgaaaacatacatccacattaaaacttatacatcaattccctagcagcactatttataatagccaaaaagtgggaacagcccaaatgtccatcaaccaatgaataggtaacaaaatttggtgtatccatacaatgaaatattattaggcaatgaaaagaatgaagtactgatacatgctacaacatggatgaaatctcaaaaatatgctaagtgaaagaagccagacgctaaaggcaatatattgtatgatttcatttatacagaatgtccagaataggcaaatccatagaaacaaagtagattaatggtttccaggagctgggagtggtgccaatatgcagtgactgctattgggtacgtagtttcttttaaggatgatgaaaatgttctaatattgcataatggtgatggttgcacaactgtgaatatactaaaagccattgaattatatactttaaaagggtgaattttgtggtatgtgaattatatctcaataaaagtgttatggattaaaaacattagtgactgtattactataactatttgaaattataaaagtatatttaaattacattttatgccaggactaggggcgggggggaatggggagttagtatttaatgggtgcagagtttcagtttggaaagatgaaaaagttctggagatggaagatagtgatagatacccaacaaatatatttaattttacagaactatatacttaacaatggctaaaatagtaattttatgttatgtatattttaccacagtaaaaaaatccataaccccctaagattatattttatattattctaatgaatgatgtgtcttttactctttttcttcttttaacagtaaaactgaaaatgtgattggccttttgttttttatgcatataattcttctggtctgtattttagaacttctttcctgtgtggcgttgggggatgcgggtggttacacacacacgtctttatcttggctttgaatgagaacttggaagtattttttaaaacttttatttgtcagtaggaaaataaaagaagccaaaccataggaaatttacgtaattaaattataaaatagtgaaatgctgttctcagagtatgaattatcacagatttcctgattttcttggttaatcttggcatcttgaatgggaaaaacatatatacttttatacatatataacatctctgtatcttcctataagcattttcctttgtatagcaggataaaatgagcaccaaaatgtggtgcaaatataaaaacgcagtggatgagcttcaaaatgcaaacaaagggatgggaaaatgaaaaaaagaaaattcagcagtgagaaagtcactgaaaaaggaattaaattctttccaagtctatggaactatgttatgacccaagcagtttgtagagtctgagtttgtaacctctgaggataaatccatgaaaatatttctaagcctggctactatctaggacatttgaagatggatgttatgaataccagtagtgccattaatatagtaggcaatcagaggtatgtttgtttttcttaatcaggaagtggtttcttttaaaagtataaggaacacacactgtgtgtgtgtgtgtgtgtgtgtgtgtgtgtgtgtgtgtattttctattccgttgcaggaagaattatggtttttccacattttacagtggggttttctagagtttggcactatgatatcctacacttgattacaggatccaatcagagttgatgtactcagaaattcattgacatgattaatggtctcctaatcatacttttatttcctagattagccctatttcctgtagtttcacaatttttgagtcatatgttaaattatcctttattgggggcctgaaattcttatgagtatttttagtctataatttgcatgattatttcttttctttgttttttttttaattgaagaaaatgaaattttgatcttcctttgaattctttgagtgctgttctatggtgactggccttcctagtataatcttttttaaaacaatattgtatatatgtgtatgtttgtatacatatatatgtatacatacacacacacatatacacacacatatatatataattttactgccaccagcactagatccagaaatcttcctacaagtttccactagtctagtttttattcttctcaaaagcaaaataaaacattcttagattctacaagtagcagggaaagacatcaggaaatggctgtacaggaaatgtaattgatgattctctctttacaattgaagtggtcacaagattggctagcaaacacaatctattaaatgaaaaaaaaggtgacttctaaaatctttggggaatttgaatacatttgaagcttgttggtacctttgacatcttactgattctttttgaaactcttacctttttcaaacaattgtttgcatttgaaattgggaactttcatatccagtgattgctttaatatttgctttgtttttaacagtgcccttaaagatagccgttttcccccaatgacaagggatgagctgccacggcttttctgctcagtgtctctgctcactaactttgaagatgtctgtgattatttggactgggaggtaagattatagaaaaatttttaaagaaaaatgaaggtaactcttgaggagatgttaaaaattaggcccagaaaataactctttcagcccattctctattgtaatggaggtcgagagtaatatggatgaataaacctcacaactgaacgagatataagtaaatgagttttttaaaggacaaagtgccacgtgttgttataatccccaaactgaatttggttttcatttttctcctactacctcaccaaagcacctcataaaagctgttaataagtaataagaaggactgactggaatttatttctcctcttactttcattctggtgcactctggtataaccgccactaagtaactagttggtcagaggatacatctcagaaacaagaagaaatatttaggataatacaccatttgggggaatcagcttgtgataacaacaaggtattgattaactagagttaaataatgtgaattcattcttggctaccttagtttatacacttaaacactctaacaaataatactaaggttatttctagggtatctctgtgcattgctattgttagagtagcttatattgatcatatttttattcttctttagtacatggggttggctaacattgttagtgaagttcaaaggttctcaccatgatttgctttggtggctgggaggagatgttgagtgtaggtctattgggtctatgaaattttacacacaagcatgcccatattactgaatgcctgttttattccaggcaatgtgctccatgtataaaagtggtaagatttggttcccaccatgaagcatgtcataatttagtggcgagtaaatgtgtatagaaagtatgaagaaataagtgctatgagaatgaaacaatgggaactcagtgataaacataacattctctctcacacatacactcataaatggcattattgtatccttatgacagattttaattcttctgctgttttagaaggaccatcccccatagtaactgaactattctgccttggagacagatcactgtcttcacagtttattagacttgaatttaattttggctttgccctgattccttgtgagactttgaacaatttacttactccactgcaattcagttttccaatatacagaataagacatttataaggttcttcatttgaaaaaaaactctatgatataaattattgttgttataccagagctatttaaaaagttttagggggtggggtgaaaaaaaacttttctacagagagtacaatgctagagtcccctctgggttttgtgctaagattttctggagcattatcagaatatgaacacatcttaggatttttgcaaaggaagaaataaaataaatttatactgttgttcctaccaaagttggaatgtagaaaaccttttgtaaacttgaaatttctgatttattatttgctataagtttgttgttcttacttgatttttcttaaagaaaagtctacaaatattatggaaatattccttagtactttatttttaaacagccccaaatcatgttccctacttattaacatatattatagtctgggtggttcttttactgttttaaggctgctgtttcctcttccgcagccagatttacttttgctttctggattgcagggtgttgtgtatgtagtagtggggatgggagtgattatatgggaaaagcctgagatccaagggggatgaccaagctacaagaacacttctactcttgcagctactgagttggaagtacagttctggcatgtgtgtttctgtgtgtgtgcatgtgtgtgtgtcacaaacatgaacatactagtattacataaatgtgtgtgcatgtgttttgggggaaggaaaaaggggagaatacaacagctgttacataggcatggttaagcaccgagtacatcatcatcatctttagcccagttaaagcactatctacagctaaaattaaccttgatattattggactattatgtccaaaagatacatcagctttctgtttgttaggagagtgggatgtaaagcccttaagaagtagtactgtgtactccactatatactctttcaaggcatatttatcctctttggtcaccatctgccagcctgaatttccagaagattctatattgttcctacttggtattgtgtatttaatatattttagggggcttaaatattaatttctattaagtattagttccctattgaagcaaaaaatacactttttttttttttcgagacagagtctcgctcagtcgcccaggctggactgcagtggcgtgatctcagtacactgcaagctccgcctcctgggttcacgccattctcctgcctcagcctcctgagtagctgggactacaggcgcccaccactatgactggctaattttttgtatttttagtagagatggggtttcaccgtgttatccaggatggtctcgatctcctgacctcgtgatccacccacctcggcctcccaaagtgctgggattacaggcgtgagccaccgtgcctggcccccattttttttttttacttttaatatacaagtatttgaaagtgaattagttactgttagaatggctatgctaagaggaaaagcccatccttttcagttagttcatcattgtttcaggtatttggcagaagagaaatttgtatacaacgaataagggtggaaattatatttttaagtacaagaatgtgatttggtcttaaaaaaatatgtaccttactcagtgattgaaaatggagtaatagtattgtgggaatgatattctaagggttatccttaatgattctgaaaaagcattactaaacacagaatgccaaaatggaattaaaggcattaaaaaattatacgttgacacaatttcacttctaggtatatacccaaaagaattgaagtgttgaaacaaaaacttgtgcatgaatgttcataacagcactgttcacaatagccagaaggtggaaacatcccaaatgtttatcaacagatgaatggataaatagaatatgttatattcatacaattgaacattactcagccataaaaagaagtgaaatacatgctacaacatgaatgaaccatgaatacattatgctaagtgaaagaagtgaaacacagaaagccacattccgtatgactccatttatgtgagatatccagaatgagcaaatccatagagatagaaagcagattaatagttgctaggggctagggggaggggtaaatgggaagtgactacttaatggtacagggttgccatttggagtggtgagaaagttctggaaccagatagtggtggtggttgtacaatattgtgaatgtatttaataccactgaattgtacactttaaaattgttaaaatggcaaattttatgtgtattttactacaataaaaatggaaaataaactttatacatatattctgttcataatagcaattttaacttatcaaagaagaaaattttttaaattaaaaacatataatgagagaaatgtgagtcatttataattacaccattctgagaataactactgttaacattttggaatatttctttccattatcttttatatattatactaagactttttaaaattttttttccattctttatctgtctttgtatcaataaatctgaatatttggttacataacagatcatattgaatatgcaatcactatttaaaagattgtggggaagtctttatggtttatctttgtatataagtaaattatattttgaatttcctttttgagaagtcagtctatattatgaaagtatatgcttcacgagaattttcacactaataggtacaacttttcttccaagaaaaaatatcctattcaccataagtatgcaattttaacctgaaatgtgaagtcctgtgtatgtttatgccacaggggaaaacaaggagattattacagaattttaatacagaatgttaaagttgaagatagataatgagcatgttttatacaaacagaagcttctaacgtagcacttttctggtggaagtacagtttgagaattgacccccactggttaagtgtgttactgcagtggaattcctaattaaagggatgaaaatgcccagattaaagcaggaagagggcaaagtctagaagtcccaaagcatagaggtagatatcttcgctaccaagacagatatccctgtggtcatgaggatgaggaacgtgaccacgatcagtggtaatagccacccagttttcagatgatcaggaaacaaatgaattgccacgcgtctggctaccatcttactgtctttttcatgcaaggtttttaactcggtctatttgggaactttcttctgataacatgtctctaattttataatggaagttagtaggaaagtaggatttactttagaccttgttttaggagctagagtgcttctgtttgataatgtgagggatgtttgacaaatggttttacaaatggctgtaactaatttcaagtcaatattgaattgacagactaatcaataatgcttccatatgttctatttcctcagaatagtaattataacatttaaaataagtgtttatgggtagcctctgaaggaatctgggcagtcattaaaaataacagccatccacaaaaggcagtaaggacaaattagagcagtggccccacccttccaagaataactgatcattgcccacatcatgatgtacttattgtcctagtaggtatgagaaggatgaagagtgaataatttgaggaaaaatttcattagctgataaattggaatgtctacctgcaaggctaaaatggttgttaaatgaggaaaattgctcccctagataaatctgacatgatatgctttgtgtttgaacacggaaactcatcaccattgttctgtgttcttcagttgacatcattttcttaattctgaatgacagggtgattgacagacatggtgctttgtaaagaaagaaaaactcatgcagcatgttggagcctgccaaaatgacatagcctggaacttgtagagttaaactgtttgggagccatgtttcctttttaaaaatctgaaaggatataaaaccagacattacaatggactggagcttgacttgaggggtgattctatgtgtgtcacctcataggtgctcattttcaggatgatataaatgaataaactttttgtttgtagaagaattcgtatagcaagtatgttaccagtgattttgtggaagctaatgtagcaatttgctgacagaagtcaaaatattttctaaattgtaatcaagcgtcttttacttctgtgctttagagacaagatcacttgaaggcatgaagtaaaaatattctctgtattctaaagtaactccttagatcagatttcaaaagattaatgacattttcacaaaccattagtcactttctcctatatctggctacctggatcactggtatctcactttttctatacagctgtcacctgggcaatacattgtggtcccaagacagactgttccattggagcacacaatacgtacatggaatcaacccatgctgggtggggctggccagcacagttattgtatgatgccaaaaatctgtccctggactataaagctatacctcaggcccctgatctcactctgtccctaaagtaccaaagcatctgtcattgtatttgagcctcgttggactcctggtactcagaaagctgtgtttcactttaaaagcaacctccaaggcacacctcttgagtgatcacagctcaattctgacgtgttcagttgcagttaataatagggtgcttttgtaacaaccttcgtgagagtaaacagatgagatgaataaattggctactgtcattatctcccacatattttagaagttaatgttcttttcaccctcactccccccttaaaggtttacattttttagctcctcttaatgtgccattgaaaacagagttcccattcatacacagatggtaagcatgactcatgaagtcacccagcgaaatgacttctggttgtatatgttatgtttcccctcttggttagtttttcccaactatgatatacatcatgttttttctctcttctaacttaaaaaatatgagcttcatatatccaggaaaatgcttttcacagtacatattttcccagggacgttgagtttttttataagatgtcactatcattaagattagtcctttcttgatgctctactttaaatgttttttttttttttaagtgccgtggagtgttgggaaaggaaggcttcaggcttcctggccatctagaaagagtttgctgtgcatcaacaagtcaatgtataagaagcctagtggggaagcaagctgtacaaagtaaagtaacttcttagaaggtgatttaatgcatacaaatttccattagctgttggttctcttagcaaaatgcgctgctgattagtcccttctcaggccgcctcaagttgtctccagttttactcgcagcatgtttattggttggaggaagttagcctgctgcttccccagaattccataaactccctgccccttccctagtacttttgttatagctattatttcatgtatgatttgcctgtgtgtgtgtgtgtgtgtgtgtccccagcatttaattaaaagaatgctgaattttgggaataaggagacctgggttctgttcctgactgccactgcccagctctgtgagctttctgggcctcagtttcttcaggaacctgaagaagttggactaagtgatacctaagatctctttggactctgacagaatatgattctgtgacatactcctttttaaaagatggcttctgtttcattgtccagagaatgaatcaccactagccatttagaagtcttaagaagaggtccctaactttcaaagtggccattgccaagttaaatgtaggcaacaaacgtgaaaaacagtccagtttttaagttgtaccttctagatttcctgttcacaaaaagaattcccttgaggaagaaaaatgctctaagccattaatgtctccatttaattactgtatcatcctgttttaagtcaacattatatatttaagtctaaattaggcaaatacattagggagcgattcactttatgaatacgtattttgctttgtagaagaactcactatagaatgttattgttttcctcttgactttaagattaattcatttatgtaaactcaacccacatgtaactttttaggaacaaatttcttttgtagactaagttaaactgtattgagtcagatactcaatgtacagttctaatgaatacaattttatttttcttaatttcttattaggcaaacagcattatttcatattaggcatgtttgctaggaggtgatttcttccccccgcccaccctgtccccactagcctttggaaagtaaactaagtcacatctctaggttttgagaaaattttataactttagttttcttgtctgtaaattcactcccttattcccttttttaagaaatggaaggaatgcatttttctaactttgatagaaagcacgctttttatttaaaggtcacctgtgctgcctgaacatttcttgggaagctttaggatgttaagtttttatgggatgctcattataattaatcattacagagaattgggggttttttccccttaattgcactctgagctgtcacttgttctctgcaaaatcttagagtaagatcaatttccttcattgcaaaagatatataaacatgtttggcttcagagtttttcaaagcacctcttcattagccatactttatttaaaattttactaaaatttcatggtgactattagagagatcaggtattttaaagctgtgtgtcagctattaaaataaatgttaccagatcgttgttcagtggcttttgtgaaataagttggcaggcttttgttcctgatagacaagtagtctgtctcctacataaatcaaaattggccctaattagtcctttggtaagctctgtaaaagccaagaattggttcatggagactgaactaatatctaagccaaaggtgactaatctgcagggattttaaagaagagcaacacatatgtattttggtcaaggggacctttttcataaagtaacaactgagaaaaaaagaaaaacttcagctgagacagatgatgaagcagaggttttatagtagagtacgttaaaaggttagtcatgctcaggtgatgactttgtaatcaattatcctttttgattcatgtttctggtattctgcttctaaacgcatctcaaaggatatttgaaaataaagacaggtataggaactggtcagataatgtataaaaacagcctaaaatatagtctgtggtggtatctcagttggttcaggagaaaaataatttttacgtcactaagataagagttatctctagtcggatggtactaggattacaggccatctttattttctcctttatgctttcctaaaaggatgctttatttgtttgtttgtttgtttgttttttagagacagagtcttgctctgttgtcgaggctggtctcagactcctggcttcaagtgatcctcctgcctcagcctcccaagtagctgggacaacaggctcgagccactctgcctggctctaaagggaatttttttgtaagacatatgtcctccttttataaaccagaaaaaaagatgcatgtttacagtttctaaggtttacaagagtaaataatactcagcaaaaacaaaagctgaatcgcagcaacattgttataaaaatttacaatttggccagattatgaagggatcatgttagatagatatgtaccttcagaactccagaattgcttttcaaattggtggtcaggttgaagtgatgcagagtaacaactgtgaggatttgatgggcagatcgagataatatgtcatctaaatttttttttttggtagtatcagatttggggaaagtggttcattaggatctgtacaaatccttatcagcttctatgattaaattcttaacttttctagctcaaagaattatccaagagaaacttggagtaggcctaagttcgaagtatttttctcttttatgttgaatttgctttcactaggaaaaggaagagtttctgttttcaaaaggctaagctggagtagtagggcagaaggaactgtggggcaataagttcaagagtggaccatgctgcaccatgagttttgtgctgttaggagatatagcacatagttttttcctcctaagaatgtcagaaacaccagactctgggtcagacccatggactgtccaatacagtgtttgtttctggctgtggtacccagggttgttttgtgagagagcatgcattccttctgtgataccagcctctaaaggttagggggtgtgccaaacatcctgagctcctctcattaggaacagtgtcctttcattcacttcaattggactggcatattgagcgtggcaggtcagtcttatgtgaatggccagtaactggatgctttgttaattgcaaagcatattttgccaaatgatttcatccaaaaagacatgtcaaacaactttcgattctttgacctcctgatatttcttatgctattcagatgaactcactgaaaatgagtagagtaagccatggccatattattacagggaaacccagcatttggttctgaaaatggggaagaatgggactgaccatggtatttgctaaaacaggatgccacccaaggtagtagagtgattctgttggccaggatgtaattgggaagatttagctttgagggtcaggactatggagataattgtggacccaaactgtcagaagtttacatggaggctactcaacttagccagagcacattttatactcatttatgcttttagccagatgactctttttcatgttttagcatattcagattgttggcttgctgacaaggctcacaagtaaaagtgagactcttttgtagtgctgcttgtggatcacaaggctaacacttgccttattagacagactagggtatattaagctttgactgtgcaattacaaggaatataatatgggagaaggtacttttaaaaaatgctcttgtgttgagggtcactgcattagaggataatagttttaaatgaagccacatttctaacacgggactagataacaaggataaatgaaatctgcagacagtctcaaagcttaattttagccattatttataatctcttctcctaccaaaccttttactgtgtagcaaaattgattaatttgtgtgtacctcttctttctgtgaccacgtgctatctgatagaggagtgaaaaaatagagaaatggacaagagacgaaagaggatggggctgaggccaggtggagctggggatgcataatccctaaactggataatcaaccccagaataatcaagatatattttagggtcttaacattaatcttgatatttaatcattctgaacaatgttaaaaacaaaagattgtataatagcattaataaaaatcacttgctatggaatggttcagaataaatatggctttctttttagcatgaaatatgaatccgttgaactggtcttaatgttctatcagcacacacagatacagctctgcttaattccatatcctcttatctataagtcctacatttaatttactaccattggggttgatttttagctttgcttagcaaaagtagtcttgattaaaagaatattatcgcaactgatggacctcgaaagcatttttttcatagaccatctagtaattttgaaaatgacctgcagacccataaggctagatttgcaagtttccagtttgtacccacctggctgtacttcaaacagtggcaggattagttaggggtatgtttagtgacatagtattcccacatgctgccccctcatccatacgtagaaagttaccgtggtagtgttttaaagatctgcttcggggaatcccagttccctggttcgctgatcttttatctagtttataattgcaactatagcctttgtctcttgggatgttgctgggccagaggattctccaatatgtataagggaagattcaattatgcatgagggttacattttggagttgtagctgtgacagatgcctccctgaaacaatatggaattagttttggtgctcatttcattgcaaagccagtgatttccacaggttggccagaattggtcattctccacagcaggccatgttctccttctcctgttttgattgttcagtatgactatttagtggcttgtggttctaggagtaaagaaaatgctgttgctcaagaggtaacagaaagaaagctactatgattttgttaagaacattattaccattctcctaattctactagctgaaaaaaatgagtcactctggtttgggctttgtagctttgtgggagtatttttgacctatgaaaaaagttcataaaaagaattcactttaaaaccactatacttacagttcaatttacaggggctttcaattgttcagagtcataggaacccagaaaagaattaaaagttgtaaatgtggtactaaatcaaaattggagaatttggggtttttttcttatcaaatttgatggtaggaccttctcaaaatgcagagtaaataaagcagtcttattcgtgagtaatttttgttttggccaatatgtcctttgtatccatacacacacagctttattgtgataccattcacataccatacaatcagtcttaacttcttttaattattaaattactagacattaaaaatctgatatttttgttcaagaacacaggatgtactcctataaagaaaggacttaagtgtctaaattaaccccatttgcctaaatcacttttaaaaatcttagtatgtagccacagtttgtcagaactagaatgcttattagaggttatctagttcaattagaataaaaattacctggggagctgttctttttccaaaacgtatttgttgaaattctgataaactttgcagccccgctccccaccccttgccagttaaatatcattaattttgtctgacactctcatctcacagatagggagacattcttcctatcacaattttgactagacaccttaataaacaccaaaattcttttcaattttaacatgacgggtttttgataaatagagttgaagattcaaaattcacttcagtggatgatggagtataaattacttatgctgtgtatcttttaaaaaacaaattatgaggaatctgatattgtcaaaggaaaaaaaaattcaaagctactgatcaggaagtcagtatacaggaaattttgcaaatttgtcattgtctcatcaggcactggagagattagtagatgtcctttatcctggaaatgcctgatagctaagcgctcatatttcttctcagctatatacgtagttatttcccacacagtatgggaggcaagtattgtgttagtttttaaacagctaccctggtcgcatttttagcagaaagagattcgtaagagtactgatattaaatagatagaagaaatagccagagatatgctttaataaaaataaaaaaccataaattcctcagaagatctgacaggctctaatggatagatgtgtgaagacctggggaaagatgaaatggattttcccagaggactttttattcctgaaaaaattggaaaatttgagactgggggtagaagaagcaaaagaagttttcattgaccccctttcctcttctagacctttacatccatacacatggaaagtataaaggtttatgactttactcacctgctctgaaaagaagcctccatcttgggtaataatgtttacctggtcttacatctccattccagtaccttgcacaacctgaccctccacttgggaaccattgatctgaggcaaccacagatccaagagaacagaatggtgtcattatgcttttgaaatttcgtttttattatcaatgttcacaaagaagttaagaacttttaattttgatctttagctctgtatactattctatgtgagatatgaggggaaaggacagatttctttcaatcatatgctaatcaaaggaaaagcacattattaaaaaaaaattagcaagaaattgctcacagttacttagaagactacctttttaagggcatcaccacaagcttgttttacattaaaaagttacagtggtctctgggctagtatataaagagactgcaataatgcactacagtgaagtgatttgaaatctttattcttaaatttagtagagctgtgtgaagacaatggtgtagatggacagtgaaggtctgctactaccccactctaagtcataatgcatttttaaagaaatgctgtctacactgggtgatgatgtaggatctggttgttttcattattaattttcaatcttacctgactgtgtttgcttgcctacgtataatttaatgttttaaacggagtagacagtttgggaggggatcagcaccaaaaattttggaacttaatcagaagtggtgagtgtacctgcaaaacaggatggttgtttgctatctctttgaagtcagtcacctttgtctctagttctttattggcatgagctacaatttgggagtggggcaggatttttgccatcaaccgtcttattctacagacagcttcagaatagttgttccagttttccaaacatagtatcatagcctagtgcatgttgggcacatgcaaatcaatattttccctctccgtggccatcataatggccttcaaatccaaagtcaaagctttggaaagagaaaacttatacgtccttctaaaaacaaagggaaaggaagaactgcattctcttgaaagttaaattataaccttttctttctgattctatgaagaagactgtactaataaaactgccaatttctttcaggtgggtgtacatggcattagaatagaattcatcaatgaaaaaggatcaaaacgcaccgccacctacctaccggaggttgcaaaggagcaaggtcattgttgtactttatttcatatgatctggtgaagaatttaaacaaatatacaaactgaaatgcgttatctgaccttgcagttatgtctaataattgaagtgtcaaattataagaagtgactcttccatcactgccactgcaatgtctgtatcaagtcggtgaagtactcacagaagttgaatccctgcattgaagtttgatggcataaacccataagtgtatattttttaaaaagcagaatttatattagttggttttcattttaggcaacaatttgctaccgatttgaaatgcatttttcccatattccattgtggcataaacaagccttttgtttgacaatcagccacatagttctttgtcattttaagtatcaaatgtttcattcttaggtggttgccattactcatcctgctgatactaagattctaggtttcccactaagatcagaggattgcgaaaacatgaagtgttagtgttttatatgcttggtctacacttcctaatcagaattttcctgtttcacacatagagcatagacctgtatgaaccaacattgtaacacaaagtaacttttcactctgtagtattttatcctttcttagcaactactaaattctggtttcatgttggtcgaaatgaatcttttatcttggggagcttttcttctcatcagaaagcatttgtaatttggttttcccgtgtttgtcttataaatgtgagatacataatagcaaaattaatgccattaaatccccagatcagaaagtcttcaaggcagttacttgaagatttatttgggttgctttagaaaatgtcttaatctcctagtatcattaactttgtaaagcatacataaaagatagagggcctcagatactagtataccatccatgtcagaactaatcaaaatacccttgaatactgcacacaaacttgaatgattacagaattacagaagataccataaggaacaacaattactgtgaggtggtgtgggagtcctaaatattgacttggcaaaatggcatataggcttttcactcccttttaaagatgtcactgttagaggaaagtacaacagatatggtttgttacagtcatgactgagcaatttctgccagccccttagaccccttgacttcgaatgcgaagataaaggagccagtgttgtttggcattgtggatagctagaatttaaggagtgtggtgatgaccctgcttttgtaaaggatgaaatcttagcttttctgtgtgattgtttttaggaccaaaagatttgatggcatttggtgacagtgatagctgacctctacaaagtcattttgtatttaatgaaaggtgtttgttacatgtgcttgactgatattttatctggtcatctctctacaggatgggaccatatacagaccatagactccttattgaggaaaggaggatacaaagctccgattactaatgaattcaggaaaaccataaaactgaccaggtacagaagacattttctagcacaaggctaacctgtacattttgatgtgtatgcctataaccctttgatttctttggtctctctaactacacttcttttttctgaaacagagtggaaatgaatggcagggtcatactgagggtggatacaatggaactctgcttcgtagtaaagcctgtgtgatgtatgagcctatctttcccatctttagctctgtgtgattactctggcttttgtacgagcaagcccttggagattttagactactttattggagaaagtacttgaattagcaattggctagcttttgacattactgagcagaaccccaggattctgataaacagtcctcaaattcgaatttaatctcagaattttggcagtgatagaagtctaccaagaaaacttgttagcttgctgaaaaacacaattgagctaaactcaaatgctaaataaatttcagcatgaaaaaatagggatgcttatttaaaaaggaaaataccgtacattttaggaaaatgggctgctggttccatttatttcaattccataaaactacattgaatgcttatagtctaaaaatggcctattctcagctctgaggagttacaaattcagaaatacctccatctctgctctccctgagttcacagtggaggagaatagaaggggcatggacaaaattattaatctaaggcagaatatgatggataatatgagatccattcccataaagtagggaaagaggaattctaagagggtgggagggggataacagatagtttcaaagaggtcagctgggggctgggtttgaagaatggatagaatatttgacaggtaaaaagggatttttttttgacaggaggaaagtgattcccttaaggaagaccttgtgagtcaagggtggtgaagtacaaagcaagttctgagaatatgaaatagtctgattgggctggtcttttagtgtaatagagaagctgatcattagaggaaaatatggcccagaaggtaggttgggcagaccattgagggtcctgagttccagagtaattagtttggacctggttctataggcaattggtagctattgaaggattttaatcagatgggcttggggaggtataagaatggaattggaaacaggaaaatgagccaggaagcgttggtattatctaagaatctgtggcagcagtccaaaagaggtgcaacaggggccttaactagagctgtggcagtgagatgggaagaaaggttgggatcgatatgaaaataatgtggaagaaatgaaaggactgggtcatcatttagaaataaagaagaaagtcaaggcgttaatctagataaaagggaccaaggtaatccctttaatcaaagtagggaccacaagaggagtgtgttaagtttatgcatcgattttggatttgaggtgcttcttaggatatctatatagaaatatctagtaggtcaatgaaaatgtatgagctcatggctagatatgattgaaattgtaaggatagggttcactgtggggggacagtatagagtcaaaataactgaatacagaaacataacaaaattctacaaggcagggataggagcattcagagacaaggagcaatctgagaggcaggggagaaccaggggcatgtggaggtatagaatccttagcaccagagagcttaagggcatgatgggcaaatggaaagatcaagctgagtcaggggaagccttctgatggctatttccatggaagggtggcagcagaagccaaggagcactgagctgagtagtagtgtgagatggggattgaaggcagaaaatacacacaactatttgagaaatgtggcaatgaaaagaaagccagacatggggaaaagtgagagttcaggataccagaattaagaaaagttgtttttgttgttgttacttaatggtaagacctaagtagatgtgtggacagagaaaggaacagtaaaagagggagaggtggaagatttctgaagaaaaataatcaactgaatcgaatgagatgcatactcctgttagaaaactggggctgaggggacaataaaatttttaaaagaacaatttaaacaaggagtagtagagtgcaaagagcactggactcagacttttgatttccaagttctgatcttagctttgctacttactatctctgtgaccttgggcagtcactgcttctctctgggaccccgtttcctgatctataaaattatctttaaggtccttcctagcagtgacaatggcatgtcacctacttctcaatgttaacttttctcttccctgactttctttcaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaa

SEQ ID NO: 3621 - DNA, 92065 bp, human; identical to SEQ ID NO: 3618

SEQ ID NO: 3622 - DNA, 37277 bp, human; identical to SEQ ID NO: 3619

SEQ ID NO: 3623 - DNA, 243823 bp, human; identical to SEQ ID NO: 3620

SEQ ID NO: 3624 - DNA, 92065 bp, human; identical to SEQ ID NO: 3618

SEQ ID NO: 3625 - DNA, 37277 bp, human; identical to SEQ ID NO: 3619

SEQ ID NO: 3626 - DNA, 243823 bp, human; identical to SEQ ID NO: 3620

SEQ ID NO: 3627 - DNA, 92065 bp, human; identical to SEQ ID NO: 3618

SEQ ID NO: 3628 - DNA, 37277 bp, human; identical to SEQ ID NO: 3619

SEQ ID NO: 3629 - DNA, 566 bp, human
tggactgcaggaagatggtccgcttctcttacagtgtgatttggatcatggccatttctaaagcctttgaactgggattagttgccgggctgggccatcaggaatttgctcgtccatctcggggagacctggccttcagagatgacagcatttggccccaggaggagcctgcaattcggcctcggtcttcccagcgtgtgctgcccatgggaatacagcacagtaaggagctaaacagaacctgctgcctgaatgggggaacctgcatgctggagtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagctggcatctgcctttctatacaaagctactattaa

SEQ ID NO: 3630 - DNA, 121984 bp, human
actctagctctcgccacaacctgccagccccagacctcggacgagagcgccccggggagctcggagcgcgtgcacgcgtggcagacggagaaggccagtgcccaggttagtgagcagtgcccggcgcccgcttccctcacctccttttccagcctttgcacaggtgggttgccttctcttggccggagccgtccctggaagtttccccagggtgccccaaattcccctgccaccccaacctgttctgtgctccagcagttagcaacctggatggaggtggggcccaaggcttctgaccaaagcaagttgggggtctctgaattcgaactcacagctcgtccctccccactcggcctgcatttctttatgctctggcgctttgagaggtcacttaggtactccaccctgagctacccaagggactctgcagtccccttaatcactgcctgtattcctgagcctgttttctcattttgctgatgaatacatggtaaagttaatgtagcagggtagatgggcgaaaggctccctatcctatcctctggccatctgcctcattttttgtccctgactacgggggtcagaatttgagacactaggctctggaagcaacgtggtatattgccagaacatagggcccggaaagcctgctttccagtccctcccagccctgccactaaagttatttgagttctctgggtccccccagtgcccattttgaaggtggagttgtgtggaatgaaatgaaatgatagaaaggtgttttgcaagccaaatgcgaggcattgtttgtcagtcataagcagcaatgaaagcatttcctccaacaagagataccctgggttaaaactgccattttcagtggcaacacaccaccagttaactgaacttttcttgctgggtggtagagtggggagaggatttcagctgatggacaagggcctgggactccagtgtctttcttattgtttgtcggaaagaaaattgctaccctaggggctgtcccacagatgatagtcaatgtgagattacaaggtcagtcaagcctctcaggaggattaaagagacactgtggggcgtgaagaactggctgacatgtgttcatcccttagccttcctgtggggatgtctctttgcttctgttctacccaggagacctgttctgaaagtgggctcctgacacttgatggcccagattgccttgcagtcacagctgggcaaggagcagttggtccctttgcttaacgcagatgaacaatgtgaatgcttgtttcatggaagcaccttaataaatacctttcttttggtacttgatacatttctctttctcttgtaaaacacaggaactctcccatcccacctccactacctgtgttagttgcagggttttgtttttttgttgttgttgttgctttcttgttgggtcctggatcccctgaagcatgtcaatggctacatgtctaagtaacctgtaaaagagccagtgcaagttcaatggcacaacagcctgtgtgaagcagacagagagttaatgcagaaataactccagttaactgggtcaaagtataatttgaaaaattaaggacagtttggctctttgcaagaataagagtcggctaagttcgctgagcaatgcttgctagtgtttactgctgcagtcccaacacatgttttgaaccacccccttccctaaaagaaaaagctgaagagataaagagaaattgaacagtgaggagatctggggagggaactcttcttggttcatatttctgcacagaatacaaaggcaggacttcaggatcttgtaaatcaaaagtgaatatttataaagcgattcattttctgatgttctccatcacagcctgggaggccacacagatgacaggaacgccaaaggagattaattgctctctagttaccaacttttttatttgctcataatattagttgggacctaagaaaggcaaaaaaatctatgagctgttttcttgccaacttgagttatgaagcaatgctacagttcaccgaatcgcccaaccattatacaagaaaagcagccctgttgattctcgcatggggagaccctaaaaccatggtttcagaaacacccgttgaaatccatatatgaatgtgataaattggatttcagtggttaaaaatctttctcttttggaggcttggggaataaacttattagaataggctcaggaagaacctcactgaggtgggtagctgtgttaaattgttaatgaaaatgatttgtttcgaataaacgtggtagccctcaagggacagtaacattctgagtgattgtaagtgggccacaaactcacagaggggaccaagacatcagaactcaggtctttagatgggtaggaacatgtcctgagagaatttggttctttaaggagcagggaggaggtaaagaaggaaggcagacggtgctgcaaatcttgtttgatagcacagattactctatcatcagttcttccttggttatgcattcataattgaaacagtggattttgaatgacccaggcaacttcatagcatttaagtaggagctgtagcatctacttcagagcccaaagatattcaactctccaaaatgatcgttttgcattccttcaagttctttatgtgcaatatttaggttggactttctggaaagatcaatgagttcatttcccattcagattgaatctggtgtttttagaacatttcaatattttcagatcacccattggaggaattttgcaaactctaacatctgtggaaatgatccgtgactagatgtgagctacagcaaactttctgtgttccaaggttcaaaaggtttaagatttctaccccttatactgggaatgccaatctcatgttttgaagaactgtagttgttttaatggtcttttgcatggtggtgcaaggtgaacaaattatctatttaatttgcccaatttcccctaaaaatggcccatttaaaatttccattttacaatggacttcttgggggaggaatatgttggaaccattttaagcagtaaaacttttcaggtgtttaattgcatccatttgctaattacatctatcttttgcaatattagttgccaaaccaaagatccttgtagatctcatagaggacacaggagaaactgatcaatttgtacttcattccaaaaggattaaaagtagtcttgaagctaagattagttaactttcatttcagaaattgcttggtctcatgcttgttacttttaccttgtttgctaaaataaccgtttttgcaagctaaagtttcccttttctcccaaaaaaatctcttgagaaatcaactttaattcccttagaaaggaagatttcaaaatttattttcattttcctataacttgcctgtaaggacttagcctcagctttggataggaatgcaccctcattcacttgaattttcacccacaagccttgcaagacaggagaggcaagtcctttatcttgtgcaggcagacaatacttacacttatgtaaattctaggacattttttttttattctagcaggttagaagcctgagcatcagtgacctctatcatttccagaagatctgtgttaagtcttttttctgctttcttcccaacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacgtaagtgtcttgcatttggaaaataatacactttttataatttctttgaaaatgtggctataatctgtagcaattatgatttagcccaaatgtggccgtgccattattctaagagaagaaagtgaatgttactggtttatgcatgaattgataaaagaatgagagctttgaatcaggccaactaaatttggggctgtttttctgattatcatgtagtctttgtctcatagaacatatgacacattagcttattttctcttccctgttctaaactatacaaatctcattacattttacgtaactctagaaatatctgacagatgagctggaattttcccaaatttcagactcttcagcaaaggctttcagtttatgaaaaataatgacacagaaaagaaaaaaaaagaaaaagaaaagcaggctctgcctattcccttatgccgaaaaacgaggaaggacgaaaccttcctatgaactgggctcagatgaaaaatgttttgaggaaattgagattccagggaccgttagcaaattggatgccatttattgaaaagaacatccccgcaaagccagggaatatttctagaaagtcagcgatccgtgtaatgggctaacacattggagaaagcagagagtggcaggaagtgggggcgggggggataattaaccctccttgctgccacgtttaggagatttatgagtaacggtcgacatatccgttcttgctgcctttgcacaatgtgggtcttaccttctttgggccacttgcagccatctctgaggtagatgcttgctctaaatttgaaggaaaagcctaagctctagttcccctttttgacagcatcaaaaaaagcacaaaatggaattggtccaagaggggcattctctgcttcactgaacttattcatgagaaggagctgtgaaaatattcttggtaggaactgaagcagcatctgaagcccttcacttaaacctttatctcttttatcacataagttaaatagatcaggcagaaggcttgctgacaaggagaacagtgccaagcctattccatccttaagtgtgtttctgtcccactacaattttcatagtaagtgtagtcttcttcctgggagaaacagtgtttaatagtgtttttgattatgcttttgagcatgagcggtgtatggtgatatctagtatgattgggacacaaaaggaagtttagtggggcatgatctcagcaaggaagcttggatcagcctctactcttgtatccctcaaattgcttccttcttcttccacttgaatatagttcatctcagaatcctcctcttccagaagccttccttgatttaagtggatgtgacagaagcatccatgcattctcagctcagctcacaattagctgggcttagggatgaaatattactcaataagtacaatgtacattatttgggtgatggttacacttaaagtccacactttatgcgatatatccatgtaacaaaactgcacctgtaccccttaaatttatacaaaaaaatcttcctgtcttagagagaaacttcccttatagcctgttaatgatgacctcatggggaaagcttgtaactctcagaagaccatctcttatggaaagcctttcatatttatgaagaattgaatattgtccatgaaacttagacaaagaaagatgtgacttaaaaaaattacaaacccaaatctactactttctaatatttccttgtgctgatgaatttgtcccaagcccttttgatattcaattggtgccaaagtgattatgtaacagatggcctagggcaccagatctggtccagtgtttcaggcttattgtcagatgatgacgctaaggtcatggtccttcccttagtgagccactgagcatcattatgtgtgtccatgcccaagctaactgttctgaagacatgcaaaatcatctctgctaaagggaaaacctcaaagcatatgtcctatatatgctgtcttgatatatgcatgcacatacacaaacacacacaatatgcatgcacagagatttatattgcagctctaacagtgagaagtcagaagcagtggaaatgtcagttcatagataaatagttacaaaaatgatccaggtaatgcaatataatgctactattaaaaacactgtttattgaaaatttggtggccctgggaaatgcttgttaacttatttttaagtttcttaaattataaaattaatatatatgcttattatacaaaacaacatgaaagcatctgagcttcatatggaacatgtgtccctaaactctcattccactctcctgggataaccattattagtggtttgctgtgtgatcttccaaactactttctttgttttataaaattatatatacatgcctgtatgatattttattttacaaaaataggatattatatacacttttctgtgatttgcttttgctcaataatgtgtgtaggacatccttccatgtcaatacattgcaatgtaatagtgccatattctttctaatgcttgcatggtttgcagttgcataagtttgcattggtttatttaaccagtctatatttgtagatattgaggttgtttccggtttttgctattaaaagtaagacatttatgaacatctttaggcacttattcaagtatttgtgagaaatagtcgaagtgcatgttcagttttaatcttcataagtactgtcaaattgcccttcatataagttgtattaatttatgctcccaccatctatgtatgaaagtccatttctaattccttcaccaagattataatcaatctttgtattttggggccattttaataggagaaataatctgtaagttttgcttggtatttttctctttctgcagcatcttttcgattatgtactagttcaattttatttcttcagtgaattgtctatttttagtttggttgcttgtgatatttatttgttaaaaacttacttattaaccttttatattttaaatattatttttgatatgccacttgttttaatctttaagttgtatttttcccatatagaagttttaaaattttacgtagtcagatctgtcattcattttctgtatggcttctggatttcttattcctaggaaggtctttctcaccctatatttttatattttcttctactgctgccataattttatgttttacccatagttctctattccatctgaaatttatattcctgtatggtatgcaatggggaactaattttttttaaatctccggatggtaggtttatgaatgttatttttgctcacttttatgcttctgtctattccaaaatttccacaattggcaagtttcacttttaaaacaggagaaaagctctttttaaagtaaaagtacatcttatttcccatatttttactgtgcaactctagagacaagttggtatgtgagtagatgaagaaacagaggggttttctaaaattaaaaaggaaagcaactggaaaaacttcagaaaatgggtaagagtaggcctgggtcataaacccttcacgtctctccttgtctgacaccattttaccaaaagaaggcaaagttttttatcttgcaggggctggttagaatataagcttttaggtcaaggaatgtgttttgtagcctgtttgctctcctatttggggcatcacaggggaatgacgggggatgccattatggtcaaagatgctcactcaattgattcagaaatctgaagaggtgtggaaaaaacgctttgtttgtggaaagctcatcacaaggaatggtgaagatgggtgctgccacttgctggtagctaattagccatagttacaatttctcttataagagagaagacaggctcaggaaacccgaaaatactgatagtgcattgcaatggatgaatgagccatttgttgcttacataaaagtttgttactgtttagcatcagcaaggtttgagttctttagctgggaaaaggtccttgtgtataactccattatgctctgttgttaaagttgtagtcaatgaggccaggaaactcttttgaagttcaaaggagcgtaacattcacagcataatattcatgcaaatatgggataaatgggctgaagagtttgcccatttggcagatctaacttaggtaatgaactattgatcaaagtgaggttgaagaattgaattgttaagaatattcaattatgtatttctaatagaccagcctgtgccaagtctggcaaaggttctggagagagaaattgttcatgtatttcatgcagtccactcctgctttacaaggtagttaactggatcttcaaggagctagattgtcacttatttttctcctcaagagaaaagcttccaatattcagatttggctaaaagtgggcctctggacttctcaggaaaggcaagccaccaaaagattgaagggaaggaagaagatacttagaaagtttgaaacatgtgaagcccacttagaacttctctattgtgagagccagccaggaaggcatgggttttcctcctccagattctcccttggtcatttgaggtgattattgagcaagcaaatgcgtggacctgttcacatcttagaagtttaattaagtggaattagacgaaaggaatacctaaaattagatagcttaatgcttttcaaagtatattcttaattgttttttattttggtgagggggcagtaggttttgtcatggaggctctgtagttagcctagatccaatccccagctccttgacttacttatgtaccttgggaatgttacctaacctctccagctttcgttttcttatcagtacagtgggggaaataatagcataatgagcgtgagcattgtcatttgaagaagaaacgagattgtgtacaccaagtgctttgcatagtggctggcacatagtaagtttttcataagtagttgctattagagcaactctcttacaagccaaagatattatccccttaattttaaggtgagaaacttgaaactcaatgaaatcaagtgactttgtacaaggacaagcagcaagtcccagccagagctagaaccaaaacccaggtctccgaattaagtgttctgttcactatacccatctgcctcttggaattctttgaggaagtcagttcattgtcttgaatagaagcccagtcctttatacatggcagccacttaacacataagagatgatccaagtaaatgaataaaaattttctaacccaaattcctaagagggatagtatactatttgggagttaaaagactgagacaaggactaaaaatttttcaggaacctacatttgctaagccaaaggaaagtagtgaggaaggttaaaagtatgtgcgtctatgtctatgcttcttatatttccctgacttctcagtaggattggaatgtcttcatagtttaatggaaagaggactgtgcttaaagtcaagagacctggtttccggtcagtcttcccttgtttgccgtgtggtattggttgaatcattcgtgttctatgaagtaaagattcactacttacaaattgaaaagaattcttgccttctggactgaaaactaaaggagaatagtataggggctggggaggtggaacaagggaaacgaaggccctggttttgtgtacttggagcaaaccacatggatatttaatattgtcacaaggtaattgcaaagaatattttatccatttaagatttatagcctgtctgcttctagaaaggttagatacacattagagatgaaagaataggggcaagataatgtttttaaagatgaaataaaatagagatcatctgaagaaaatagaaggaatagatgtttttaacatttggtttagtagattatagcatttataatgtaaatctggcttatgcctcccaaaaggatgaaaagagaaactttgggtttgttgtcaagagaaaatttacagtttcatctacagagattattcccacctctaacccactcaagcagtattgatcctgggatgtttgaataaggcacattctgggtaaccttggtttcatagaaaaaagaattgtctggcatttctttactgatgctttgtaaaggaagaaggcaaatattaaattataattcaataaaggactttctataagcagtaaggaaatgcattccaggtactttccctttgaatgatctaaattggagaatagaacatggaaatgttaaatagatgtttaatatgtctactagactggattgtcaactatcagatgccctaagcaagctttctattaacatgatttgtttctgattttaaaaatagatgctcattgttaaacattcaaaaggtacataaaagtatagggaaaacaaaaatgaacagtaatcacaacgtgtatggataaccatagttaattgatatatatatatacttgtagtctttttttctaagctcagttatacaaacatattagtttacaaaactgaagcactttttaaacagtatggatcagggtttgtttatttatttatataaacttaggggagacaagtgcggttttgttacaaggatattctgcatagtggcgaagtctgagcttttagtgtagccatcacccgaattgtgtacattgtatccaataggtaattcctcattccccatacttcttctaccctcccacctttccacatctcctgtgtctgtttttccaaaatgtatgtccatatatacacattatttagcttccacttgtaagtgagaacatgcagtatttggctttttgtttttgagttgtttcacttaagatcaattcacaattggagtctctaaaatgcacttgtagtaaagacaacatcccatgttgtctgtaagtgaaagctgggcggtttagacacgagttgcaggatatgcaaatttgattctattgtgagaagttcaagagctcaacttttattctctaccaaagggaacaaaagtattcctgatcaaacagaaagcctcccttcacagagatttgcaccgctaaagtgctgataggaagaacagtttggttttttgaacaggcatttttatttttgcccaaagttctatgccatatgacatggaagagatgatattagcctgaaaaaatattcaggtcaggtttcatcagcttagcagcctttctgtaaaaggatctcctcatggcctcatagtagacactaatgagaatatcatcaactcccagttatttatgctaatgaaagatagaagggcacaataaattgaaatttcatggaaaatctccagttctcatcttaatggtgtcaccttgcttgactgccaaacttctttgaattatggacccttttcttttcgatgggtttgcccacctgctaataggaaagtaaaataaccacaaaacaagtagtgagagggccatgctgtgggaggcccaggcaggtgaatcacgaggtcaggagttggagaccagcctggccaacatggtgaaaccccatccctactaaaaatacaaaaaatttaggtgggcgtagtggcgggtgcctgtaatctcagctactcgggaggctgaggcaggagaatcacttgaacccaggaggcggaggttgcagtgagccgagattgtgccactgcactccagcctgggtgacagagcaagactccatctcaaacaaaaaacactcagtatataattttgggcaggtgatccagcaagtaggaaaaagctaattaacttctgaatgaaggaaaaagctgcatacacaggacggagaatgttgcttcttcatgactttctttttttctctggcgtctgcaggctggaaatgaagtcttaaagtcctgagaaaacatgaaacagagtcttcaactctagaaacccaattgtcagtgaaataagaaacgttttccccttaactactacatcttgcccttcctacattctgcttcaagtttgataaatgacagaagagacgtacttatgcctttattttttcttcactcttctagtagccttttaaagaaaaaaataattaaaaaggaatttgtttacttgatgtgtccactcatataatgaatagcagagattcatctttttttccactgaccatgtgttataatagaataaatattattgtaatactgacatgacaatgtgtctacagtaatagcgcttatcaaaaacagttcttgggaatgttttcttgattttggactggtgatgaagttactgacctttgcctaatcctgggagctagtcagtaatgattggcaaaacattgatggcatagtgacacgtatctgttgttgtttactttttgtcatcattgttcctattaacaggggcccctaaagtagcagagatagccacctctaatgagggcaagctgatacatttgaaaaatagctgtgatgttgcaggttgaaggtccatctcacaagttagttggaattcctttgggaccaaattctactctcagacaccattagttagcagtaagtcatgcatctgatttgtgctttttgtccaagatgatatactgggattttatgtgttattgattatactgcataactcattaaattctctccttggtaatgtcaacaatttttaaaatttcaaacttataagcatatactgaaattggctttatcatagtttctcaaatttggtgattgtccaatgtgttcatggtgaaattagtataattgtgctaaccactcaatattggacaaccatgctcaaacacgtcttaaaaattatggtgttccagcacttttggaggtgaggtgggtggatcacctgaggttgggcacagtggcaggtgcctgtaaccccagctactcgggatgctgaggcaggagaatcccttgaacccaggaggcagaggttgcagtgagtcaagattgtgccattgcactccagcctggacaacaagagcaaatctccatctcaaaagaaaaaaaaattataatgtttacttttttgatatgctataaaaatatcagtgtcagtaattgcagaaacattgtttaatagcactaatggcgtgaccattcagctccttgtctgccttcagttcctaaatttgctccttccaggagttgtaggtttctgtctgggtcataattagccaaatcccatgttgctgagataataagaccaatacacttgatgaaataccattatgttttcattttagatcaggtttctatcagcagttagtgtttgagtaagatatttgcatcctcaagaagcatagtttggaagacactggtacgtgggataaatgccacgtgaacaaatgaggaaagtgctgttaggtttaaagagaatgaaaaataacttttagctggggtaatcttgtcttcccatcaagatttcaaagcccttaaaagcatgagcactattttatacattatgtgttgtcactgatgtaaatacaaaaatgcaaaatagtctctgccagctgcactattttatatagtctttgttgagtattacttgacttcactacaaacaacattgatttttaaaaggtgattaaagttgtgttaaaaaggtatagtggaaaggtaatttgagaaaaggttagtaaagaatatgtggaagctctttactttccaagttctaaaaacagtgacctgcaccttaccaactacgtagcaggagaggcagaattctgtaaaggttatagtctttggttctaaagctacaagatataggtttgaattctatttccataccttgattagtcatgtcaacttgggcaagttaccaaacctctctgtgccattgattcctcagtggtaaaatggggccaataatgagacctaccttgtagggttgttgtaagaatttagtgaattcagatatgtacaacccttagagcagatcctgcctcataggaaatgctcaacaaatataacttgttgtttttgttattgttatcaccgttctcatctggctctatatttttcttgcagttggttccctggctgctttttacacttatcatctacctcctagcctttgagctaaattcggggcagaaaattcagatggctcagctttcaaactttgtctaataatactccttagaggctgaatttgggggaaaatgtaatctattggctgaaatcagttagttgggttatctgtggttttcaagaataatggtgaactcacatatactgaagcgatccatttaatagtgtcagtgaaataatctatcttaaatattttttagagaatagatagcaacttgcctgaaagttatatattaagaataccttcctcatcacatcaatatatactgtccttttggaaacagactttcctgcaagtcagaatcttaaacagtttggaagagagttttagaaatgtgcaaatgaacttgaaacccacatttgtatagcttgttttatttcagtgcttgagtagtcttttcggtggtctttatcttttattatcccctttcttctttatcaagtaagaaaagggtaggtcattcaaccatgcagaacatatagctgataggaaaacatattcagtttcatattttaaataggtaaatattatgtcaacctctgattgagctaatctaagcaagaaaaataattcagaatcaaacacataatatacagttatagcttactctgcaatgtggatttaaacctacaaagtaacttttagcttacctccattcaagttttagtggccccagactcatataagtatgaatatttatgctaacctagtaatgccatttgaaggagccaccttgtaggatttgcttccacatgtatactcagattctttctgaaatgttgaaataagttgtatatgtgaaatgcaaatcacttaagtgtttgtcagtgagactatacatttattgtacagaaacagtaactctcatcccaccgaaatggtagagaaagatgccttatttagatgttagtcttgggaaattcataatcatctctcatcagttaaatatactgggattattaaaatatttaaaatatttcttaccatgtccttgaatgttgtggagcagaagtttaatttgtatctataccaaaaaaaaatgtattgctaagatttggctgaaaaacactaacattctgccttaaaagtatgttctgttttctttcaattaataaatattttgagcacctacttttagctcacaaatagagattaatataacaatgttgacgatgatagtatcataaaaggggaaataaaaattgttactaaaatgaatatatattcaaccttgccgataagaaaaagaaagaaatattggttccattttcccttacttaaccaagttgccaaaactttaaacagtccattgctgggcattctcactcactgctaatgggaaagtaaattactgtggcttttctggaaggttgtctggtaatgtaaatcaagaatttgaaagtactcaaaacatttgacccaagaaatctacttctaagattttgcattaagaaaatacctaatgttgcaaacagaactttatatgtaaggatctttgtcataatttatttaatggaaagaaatggaaacaacctaatatcccaagataggggattggttaataaattatggttcagctgtgtattggtgtagaactatgtaattagtcatgaggtatgggtaaactatttaatggcacaggaatgttctgatatgttaatttataatgtagtttataaaatgtatataatatatgctgttaattttgtaataaaaccttaatacacataacccatggaaaaaaaagatcagaaagagcttccagtttccagtctgataaatagtgatcttggaggttgtcattcctgttgtcaaaagaaaaaaaactgaatgaactgaaaatcaacaatagatgcagtaagatgggaaatggaaataaaaggtatacatattgggaaggaaaaaacagtattacctttgttcatagatgacatgtttttctgcatagaaaatcccaagggatcaacaacaatgacaaacacactcctgttactaataagtgattattgcaaggttgaagtatacaaagttaatataaaagtcaattgcttttctgtctaccagcaattaacaagtggaatttgaaataaaaaatacaatattatttatataagcagtcattaaaatgaaacaggtgtaaattcaacaaaatatgtacagtatctatatgatgaaagctataaaattctgatgaaagaaataaaaaactaagtagaatggagagatactccatgtttgtgtttaggaaaactcgatattgtcaagatatcagtttttcccaacttgatgaatagatgcaatacaatatcagtaaaatcccagcaagttattttgtggatgtcaacaaactgactctaaagtgtatatggtaaggcaaaacccagaacagccaacacaatattaaaggagaacaaactcactacccaacttcaagacttactattaagctatggtaatcaaagttatgagatattggcaaagtaatagaaaaatagatcaagggaatgtaatagagagcccagaaatagacccaaataaacatcatcaactgatctttaacaaagtaattcaatggagaaaaaatagtcttttgaataaatgggtgctggaacaactgggcatccatatccaaaatgtaaataaatctagacatagatttcacacccttcaccaacatttactcaaaatggaacacagacatgagtgtcaaatgcaaagctaaagaacccttagaggataatataagagaaaaatttaggtaaccttggatttggcaatgacttgcttttttaacttttagtttaggttcagggatacatgtgcaggtttgttaatacaggcaaatgtgtgtcacggggggttggtgtacagataattttgtccccaaatactaagcatagtactcaataggtattttatctgatcctctctctcctcccaccttcatgcctcgagtaggccctagtgtctgttgttatcctctttttgcccattggttctcattatttagctctcacttataagtcagaacatgcagtatttggttttgtgttcctgcattagtttgctaaggataatggccttcagctccatccatgttcttgcaaaggacatgacctcattcttttttatagccgcatagtattccatggtgtatatgtgcacattttatttatccagtctactgttgatggacatttagattgattctgtcttttgtattgtgaatagtgctgcagtgaacatatgcacacatgtgtctttatggtagagtgatttatattcctttgggtgtatacccaataatgggattgtttggtcaaatggaagttctgtttttaggtctttgaggaatcaccacactgctttccacaatggttgaactattttacatcctctccagcagtgtataaccttcccttttctccataacttgccagcatctgttattttttgactttttagtaatagccattctgatgggtgtgagatgatatctaatggtgagtttgatttgcatttctctaatgatcagtgatactgagcacattttcatgtgcttgttgactacatgcgtgtcttttgaaaagtgtctattcatgtcctttatctgctttttaatgaggttatttgttttttgcttataagtttgtttaagttccttacagattcttgatattagaccttcgtcagatgcatagtttgcaaatattttctcccattctgtaggctatctgtttactctgtggatgctttcttttgctgtgcagaagctctttagtttgattagattccacttgctaatttttatttttgttgcagttgcttctggcatctttgtaatgaaatctttgccagttcctttttctagaatggcatttcctaggttatcttccagggtttttatagttttaggttttacatttaagtctttaacccatcttgagttgactttttgtacatggtttaaggaaggggtctagtttcagtcttctgcatatggcgagccagttatcctaacactacgtattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctctttgatactataatagtggatacatgtcattatatatttgtccaaacccacagaatgtgcaataccaagagtgaaccttaatgtgaattttggactttgagtgataatgatgtgtcagtgtagattcatcagtggaaacaattgtacctctctggcaggggatattgataactggggacactatgcatgtgtggcagtggtaacagggggtatatgggaaatctctgtaccttcctcccaattttactgtaaacataagactgctctaaaaaattaagtattaatttaacatataaaaatacataaatactttaaagtatttatataatactttccctccccccacagtttatgggtacatcaaatttctcttcagcaactgcaagcaaagaaagaaaggagtgaaatatttaagttgttgaaagaaaaaggctaccaatctggaattctgtatttagagaatttatttttcaaaaataaatgataagtaaagactttctcagacaaaaagtgagagaatttgtcaccagtagaccttccttgcaggaacttttaacaaaaattcttcataaaaagggctaccaatctggaattctgtattcagagaatttatctttcaaaaataaatgataaataaagactttctcagacaaaaattgagggaatttgtcaccagtagaccttccttgcaggaactattaacaaaaattcttcataaagaagaaaaatgacataggtcagaaacttggatctacataaagaaaggaagaacattagcaaaataataagtgaagtaaaatatttttctttttcttaattgacataataaaggacagtttgttcaaaataaaaatagcagtgatatcttacatgtctgtagcttatgggaaagtggaatgagtaacaggtgtaataaggaatggaagggagggattgggaaaattctgttagaacatatctgttctacacatgcagtggtatagtgttatctaaaagtaaaagtggacttggattaatgtaaatgtatattgtaaactctagggcagccactaaaaactttcttaaacgaagtataattgatatgctcagagaagagagaaaatggaataatataaaatgttcagttaaaaccagagaagacagaaaaagaaaggaagacaaaaaaaaaagtaacaaaaaaactagggcaatgaatagaaagtcattgcaaatacggtcaatattaaactagcaaatcaatagtcactttaaatgtgaatggtctatataaaccaattaaaagacagagactgtcaggggattaaaaatccccaaaatccaactatgtgttatctataagaaaccactttattttaaaaaatatttctaataagttctattgtgtacatttaaggtatacaacatgatgttatgagatacatataaaaattgtaactgtactgaaacaaattagtatatttattcatcttacatggttatccattttcccccacaagagcagttataatcatattaattgaacaatttgtcccttcaagtcaaattcctcagttgtgatgggtcagattcctcaattgtgaccaaccattgcaggtgaaattcaaattttatttttttagtggttttatttttgagaaaaattttatttcacctctcccaatggatagacatttatttcaagatacactgcatcctcttattgtcaacacttcaaacctaccagctactgacatcttgaaacagcataatttgttatccatgactcctgaaagttcctcatgtcaccaacccttatatgatacaaatgtaaagatggctattcgtggaaatgtgttcaccacattgccaagtgtcttgggtctccttttgaaaagaatgttttttcacaaaagtcaacatttccctgaaaatgcagctccatcttctattggtatggtctgtggaagtcacagagactgaaatttcggtccatattatggttgataactacaatttctgttgcaaagtatgcaagcattactttgaactgcatctgatgcaacttggtggtctaggccattacttgcaaattgccaaggcctattttgggaacaatgctttcaattcccttttattgcatgtatcagaacaatatcctgttaactaatatgatggttcattttactgcatatatgagaagaatgtcctgttaaccaatatattttgacttttggttttagtatgttttagtacaaatatccagggacaaattcttcagttgaatacatccaagagacaatttgttcaattgatctgctataatctaatcatttagcaaaaattctgactacaatacactatcattagctatggttctcatgctgcatattagatctttagacttgttcatcctatatatctgctgcattgtattttttgacctgtatctcccatttccacacccctacaccaatcatagtcaccactgttttattctgtatctctgtgaagttgacctttaaaaaaaaaaagataccacatataagtgggatcatgtgatatttttctttgtgtgtgtggcttatttcacttattgtaatgcataccaaagaatattttcagctatacaaaaggaagagatcctgtcattgccataagatggattgacttggaggacattatgctaaatgaaagaaacctagtttaaatataaagacacagatgggttaaaagtaaaggaatggaacaatatatactgtgctagctctaatcaagagaaagctggagttgttatattaatttcagacaaagaagactttaggacaaggaaaattatccgggaaaaatggggggcattacatattaataaaggggtatattctccaagaaaacataacagtccttaatgtgtttgcacttaacaaagcatcaaaatatgtgaggcaaaaactgatagaaatgcaaggagaaatacaaactattagagctggaggcttctatacccctttattagtaatttatagatccatcaggcagaaaatcagtaaggacatagttcaatttaatcatcagtcaactggatttaactgatgtctgtagaatactccatccaacaacatgagaatatacattcttctcaagatcacatggaacattcgccaaaatagaccatattctgggtcataaaacataccttaggaaacacaaaataatagaaatcatactatacttttttttttttttttttttttgaggcagtctcactgtcgcccagggtggagtgcagtggcgcgatctcggctcactgcaagctccacctcctgggttcacaccattctcctgcctcagcctccctagtagctgggactacaggcgcctgccaccacgcccagctaattttttgtgtttttagtagagacgggatttcaccgtgttagccaggatggtctagatctccttaactcgtgattcgcccgcctcggcctcccaaagtgctgggattacaggcgtgagccaccgtgcccggccctacaatatatacttctacaccatactggaattaaactagaaatcagtaacagaaagctgtacaattccaaactatttagagattaaaaaccacacttctaaatcgcacatgggtcaaagaagaagtctcaagagaaattttaaaatattttgagctaaaagaaaatggaaataccacttatcaaaatttgcaggctgcagcaaatgcagtgcttagaaggaaatatatagcaaggaattaatatattaaaagtggaaagatttaaactgaataatacagactaccaccctgggaagctagaaaaagaagagtaaatcaaatccaaactaatcaatagaaaataaattttaatggctacaaaaatacagttagatagaatgaataagatgtagtatttggtagcaaaatagagtgcttttatggattgtgacattggtcatttctaaactttttgcctaaaccagaatcacaaagatattctcctgtttgttcttttagaagttttaaaaaattaggttttaaagtctataacccatcttgagtttatttttatatatagtatgtgatatggattaaggttcattttagtttatgttttgtatattactatccaaatatttaggcagcatttgttgaaagtactatcccttttccattgaattccctttgcacctttgttgaaaatcaattgaccacatatgtgggtagattttgaatctattttattctgttgatctatttgtctaacatttcgccaacaccacattgtcttgaaaacgtcagtctgttgttgttctttttgcttttgagacagagtcttgctctatcgctcaggctggagtgcagtggcacaatcttggctcactgcaacctccgcctctcaggttcaaacgattctcgtgcctcagcctcctgagtagctatgattacaggcgtgtgccgccatgcctggctaatttttgtatttttagtagaaacagggtttcaccaggttggccaggctagtctcgaactccttgcctcaagcgatttgcctgcctcagcctcccaacgtgctgggattacaggcatgagccaccacacccggccaaaaagtgtaattttatattaagtctctgacatgtttcttttgcaaaattgttttggctattctactttctttgcctttccatataaatttttcattagattaccaatttttataaaagatcatgctggtaattcgatttagattgtatggaatctataaatcatattggagagaactgatatcttaacaattttgtatctttcaatccataaataaagtgtatctctccattttttaggccttcattgattttttcatcagcgttttttagctttctaagcgaagatcttacacatattttgttagatttatacttcagtattttcaagttttgggagagctattgaaaatagtacactttcaatattcaatttctaattgttcattataaaatatataaatatgatttataaattctctatagtaactttttaatatattcttatagattttctatgtagaaaattatgtctatttgtgaatagaaagttttatttttttactttccagcatataggccttttatttgttcttcttacccaatttcactgactaatatctccaggagtagtgaagcagacatccttgtataattcctgatcttaggggtaaagcagtctcttgccattaagtgtaatattagctataggttttttgtagatgccctttatcaggttgaggaagtactcattctagtttgcagagactgtctgtcatgaatggatgtagaattttgtcaaatgatttttctgcatctgtggcaatgattacatgattttccttctttggtttgttgatatggtgaattacattgattggattttgaatgttgaactagccttgaatttccaggataagccccacttgctcataaaagtattatctttctacatattgttagatttagtttgttaaaattttgttgagaatttttgcatctatgttcttaagggatatttgtctgtagtttctgttcttgtaatatctttatctggttttggtatcagtgtaaagcttgcattaaatattcagttgggaagtattccctcctcttcagttttctggaagggtttggtagaatgtttgatagaattcaccggtggagccatctgattctggaattttctttgtaagaaagttttcaactacaatttaaattcctttaaaatatataggactattcaggttagatatcttttttttttttttttgagacagagtcttgctctgttacccaggctggagtgcaatggtgccatctcagctcactgcaacctctacctcccatgttcaagtgattctcctgcctcagcctcccgagtatgggattataggcactcaccaccatgcctggctaatttttgtatttttaatagagacagggttttaccatgtaggccaggctggtcttgaactcctgacctcaggtgatccacccacttcggcctcccaaagtgctgggagtacaggtgtgagccaccacgcccagtctcaggttaattatctctttttgattgagctttggtaatgtgtgtctttcaaagaattaatccattttatgttgtttcaagaattaatcattctatgttgttaaactaactggcatacagttattcacattgttccctttttacccttacccttttaatgtctgtagtcaatgcaatgaaaccctcttttttgtctctagtcttagtagtttttgtcttctctctttttatctataggggtttatcaattttattgatcttcctaaagatccagttttgatctcattggtttttccttattgactttctgtcttcaatttcattgatttctgctctttattattctattttttttcttattttgtcctactttttctagtttaagatattgatttgagacttttctccttttccaatatagatatttagtgatacgaatttccttctaagtgcttttttagctgaatccctaaatgatgtgctgtgttttcatttagtacaaaatactttctaatttcctattgatttcttcttcaacccacagactatttatatgctaccagcttcttaaaagtggttatcttcctgtactgggattatgtataatgtttataaaataacactctatattttatagcactttataatttacaaagtgcttcatttaatcctctaacatccacttgagaaacataatatttcacagatgttgaaaaggttatcagggtttgagtgacttactcaatgtcacacagagtaggttaggactcaaacctagattttctgtctcccagtttattattctgaagaaattgtaaagaaaggtttgaaaaataaattggaattcaccttgtgggtatttggaaagattcatagaggttctttgaagcaatcattgatatgaggcatctctctcagtttagttttaatttagatttctgattactagtgaggttgaacatcttttaatatttattctctggtatcgtttggctatgtctccacccaaatccatcttgaattgtaactcccacaattaccacatgtcgtgggagaaacccggcgggaggtcagttatgggggcgggtctttcttgctctgttctaatgatagtgaatgagtcttacaagatctgatggttttaaaaaagggagtttccctgcacaagctctcttctcttgaatgctgccatgtgagatgtgcctttcaccttccaccatgattgtgagacctccccagccacatagaactataagtccaataaacctctttcttttgtaaattgcccagttgcaggtatgactttatcagcagcatgaaaatggactaatacgttgtctgttccaatttcttcttttctgacttgcctatttctgtacttagattgtttttctattggattggttggtcctaattgatttgcatgattaaaatattccaatactaatattttgtttactatttgttcacaatatcttctcttagcttcatgcttatctgtctttattacttcaattttgatcgtcaggaaaatctgcactggactgaagaaaatttgtgtgtttattataagaggagtattgctttattttgagctagtatgatgaaaagtgggagatagaagaggatgggattagaagataaaccacttgatttggaaattcaatttaccaatcatttgtcagttgcttatgcttgcatattgcctataattgcttattgcccacagtgtactaggccatgtgatgaatagagagtaaagaataaatgttacctactttcagggactctgatggagaaatatatcatgtacaataaggcagttaacatggtatgtgctcaagtgaactgtggtataagataagctgtggctaccaaaatttctgttccagcaaaggagagtgagtggtttgagttagttgggagttgtattagtcagggttctctagagggacagaactaataggatatatgtatacatgaaagggagtttattaaggagaactgactcacacgatcacaaggtgaagtcctgtaataggccgtttgcaagttgaggagcaaagaagccattagtggctcagtctgagccccaaaacctcaaaagtagggaagccaacagtgcagccttcagtatgtgactgaaggcccgagagcccctggcaaaccactggtataagtccaagtgtccaaaagccaaagaacttggagtctgatgttcgagggcaggaagcatccagcatggaagaaatatgaaggccagaagactcagcaagtcagcttcttccaccttcttctacctgctttttctggccttgctggcagcaaattggatggtgcccatccaaattgtgggtaggtcttcctctcccagtctactgactcaaatgttaatctcctctggccacatccaaaaacacccagagacacccagatacacccagataggatacacccagaaggatgctttgcatccttcaatccaatcaagttgacacttaatattaaccatcacaggagttgtttaagcaagaattctgtaagttgaatgggagcagggactttgtataaaaattttagttcttttcgtctgcaacacttagcatattgcctgacagtgctcaaatatttgttaaatgattgagtgatgttaacatgtgtaggcaaagccaatcatagagacctaacacaatgcatcatctatcattcctataccaccaacagctctgagaatgttctgatacatccacatttcagacattagcttgcatttccaaagaaagggaacacaaccttttcaagaaaaagaacacatgatatgctccctttatcattgtaacggagtagtagttaaaattttgtattgctgactatggccttatagtatagtttgaaatcaggtagcgtgatgcttccagatttgttctttttgcttagtcctgctttggctatgcaggctcttttttggttccatatgaattttagaattgttttttctaactctgtgaagaatgactgtggtattttgatggggattgtattgaatttgctgattgcttttgtcagtatggtcattttcacaatattaattctacctgtctatgaacatggggtgtgtttccatgtgtttgtgtcatctatgatgtctctcagcagtgtttttagttttccttgtaaaggtctttctactcctttgttagatgtattcctaagtattttattttattttattttattttattttattttattttattttattttattgcatcctttgtaaaaggggttgagttcttgatttgattctccacttgattgcttttggtgtatagaagagctactgatttgtgtacattaatcttgtatccagaaactttgctgaattcttttatcagttttaggagctttctggaagactccttatggttttcaaggtaaacgatcatattgtcagcaaactgggacagtttgacttcctctttactgatctggatggcctttatttctttctcttgtctgattgctctggctaggacttccattactttgttgaagaggagtggtgagagtgggcatccttgtcttgctccagttctcagagggaatgctttcaacttttccccattcagtattatgttagctgtgagtttgtcatagatggcttttattacattaaggtatgtcctttgtatgccgattttgctgagggttttaatcataaagggatactggattttatcgagtgctttttctgcatctattgagatgatcatgtgatttttgtttttaattctgtttatgtggtgtaccacatttattgacttacatatgttaaaccatccttgcatccctggtatgaaacctacttgatcgtggtggattgtctttttgataggttgttggattcagttagatagtattttgttaatgattttagcatctatgttcatcaaagatattggtctgtagtttccttttttggttgtggcctttcctggttttggtgttagggtgatgctggcttcatagaatgaattaaggagggttccttcttgctctgtcttatggagtagtgtcaaaaggattggtaccaattcttctttgaatgtctggcagaattctgctgtgaatccacctggtcctggacttttttttgttggtaatttttaaattaccatttcaatctctctgcttgttattggtttgttcagggtatctaattcttcttgatttaagctaggagggttgtatttttccaggaatttatccatctcttctaggtttcctagtttatgtgtgtaaaggtgttcatagtagtcttgaatgatctttcgtatttcagtatttgaagatactcctgttttgtttctcagtgaggttatttgaattttctctcttttcttggttaatcttgctaatggtctatcgattttatttatcttttcaaagaaccagctttttgtttcacttatcttttgtgtcttttttttgtttcaatttcatttagttctactctgatcttggttatttcctttcttctgctgggtttgggtttggtttgttcttgtttctctagttccttgaggtgtgaccttagattgtctatttgtgctctttcagacttttcgatgtaggtgtttagggttatgcactttcctcttagcactgccttagccttatcccagagattttgataaggttctgtcattattatcattcagtttgaagaatttttaaatttctatcttgattttgtttttcacccaatgctcattcgggagcaggttatttaatttccatttatttgtgtggttttgaaggttccttttggagttgatttccagttttattccactgtggtctgagagagtgcttgatacaatttcgattttcttaaatttattgaggcttgttttatgacctatcatatggtctattttgcagaaagttccatgctctgttgaatagaatgtgtattctgtggttgttggatgaaatattctatatatatcttgtaagtccatttgttccaaggtatagtttaaatccattgtttctttgttgactttgtgtcttgatgatctgtctagtgctgtcagtggaatattgaagtcccctactattactgtgttgctgtctatttcatttcttaggtctgttagtaattgttttataaatttgggatcatggtactggtataaaaataggcatatagaccaatggaacagaatagagaacccagaaataaacccaaatacttacagccaactgatcttcagcaaagcaaacaaaaacataaatgtgggggtccttttcaacaaatagtgctgggataactggcaagccacatgtaagagaatgaaactggatcctcgtctctcaccttatacaaaaatcaactcaagatggattaaggacttaaacctaagacctgaaactataaaaactctagaagataacattggaaaaacccttctagacatttactggggaaacatgccaccaatatttcaacgtaggttctttctattttccataaatgtcaaccggctaagaaataaagagaaagagtacaaagagaggaattttacagctgggccgctgggggtgaaatcacatatcggtaggatggtgatgcccacctgagccacaaaaccagcaagttttattaaggatttcaaaaggggagggggtgcaagaacagggagtaggtcacaagatcacatgcttcaaaggacaaaaaagagaacaaagatcacatgcttctgaggaaacaggacaagggcaaaatcagaaactcctgataagggtccaacaaagatcacaactcaaagggcaaaagcagaattactgataagggtctatgttcagcggtgcacttattgtcttgataaacatcttaaacaacagaaaacagggttcgagagcagagaaccagtgtgacctcaaatttcccagagcggggtttttccccaccctagtaagcctgagggtactgcaggagaccagggtgcatttcagtccttatctcaaccacataagacagacactcccagagcagccatttatagacctccccccaggaatgcattcctttcccagagtaatccttgctaggaaaataatttagagatatcttccctacttgcatgtccatttataggctctctgcaagaagaaaaatatggctctttttgcctgaccctacaggcagtcagacattatggtcgtcttcccttgttccctaaaattgctgttattctgttctttttcaagatgcactgatttcatattgttcaaacccacatgttttacagtcaatttgtacagttaacacaattatcatagtggcactgaggtgatgtacatccttagcttacgaagataacaggattaagagatcaaagtaagacaagtgtaagaaattatgaaagtattgtttgggaactggttaatgtccatgaaatcttcacaatttatgttcctctgccacggctccagccagtccctctgttcggggtccctgacttcccgcaacagacattggcttagacaaggatttcatgaccaaaaacccaaaagcaaatgcaataaaaacaaagataaatagctgtgacctaattaaactaaagagcttttgcatggcaaaaggaacagtcaacagagtaaacaaacaacccacagagtgggagaaaatcttcacaatctatacatctgacaaaggactaatatccagaatttacaatgaacaaatcagtaagaaaaaaaaatcctatcaaaaagtgggccaaggacatgaatagacaattctcaaaagaagatatacaaatgcccaacaaacatatgaaaaaatgatcaacatcactaaagatcagggaaatgcaaatcaaaaccagaatgcaataccaccttactccttcaagaatgaccataatcaaatgcaataccaccatactccttcaagaatgaccataatcaaaaaacgaaaaaacagtagatgttggtgtggatgcagggaatgtaaactagtacatccgctatggaaaacagtgtggagattccttaaataattaaaagtagaactaccatttgatccagaaatcccagtgttgggtatctatgcagaggaaaagaagtcattattcgaaaaagatacttgcacacgcatgtttatagcagcacaatgcacaattgcataattgtagaaccaacccaaatgcccatcaatcaatgagtggataaagaaacatatagataaatagatagatagatagagagacagagacagagagtcagtatgtgtgtgtatatatatatatatatatatgtttctattgattatatatatgtgtgtatatatatatgtgtgtgtgtatatatatgaatactactcagccacaaaaaggaatgaattaacagcatttgcaatgacctagatgagattggagactattattctaagtgaagtaactcagaaatggaaaccgaacatcgtatgatctcactgatatgtgggagctaagctatgaggatgtaaaggcataagaatgatacagtggactttgggcacttggggggaagagtgggagggggacaagagataaaagacaacaaatatggtgcagtgtatactgctagggtgatggatgcaccagggtctcacaaatcaccactaaagaacttactcatgtaaccaaataccacctgtaccccaataacttatggaaaaataaaattaaatttaaaaagattttgtacatcattgtcagacaaacctgggtttgagttccatctcagcttcttactggttatatgactcttgattttccttatctataaaatgagactaataataatatctaccttatgggtcattgtggtgaggatccagtgagcaaagtatgtataacactaatcccctaataggaattctataaatacttgctatgccacttctcttgatgtataataaaatggatggaacttgtgattgcttttgaattttgtgacttggttgatgtttcctaacaggcatattctccatctccttcttcacagattcagagacatattgcatgtttcaagacaagaagtacagagtgggtgagagatggcatccttacctggaaccttatgggttggtttactgcgtgaactgcatctgctcagaggtacaatctctcatgacatgtgatttcccagtttgctcctcagcatgccgagaggctttcagtgcccaaatggccagggaccatggatgataaaatccttaaagaaagtaaagaagcagaccgatcgcactgtctcacgcctataatcccagcactttgtgaggctgaggcatgtggatcacttcagcccgggagttctagaccagcatgggtaacatggcaaaaccccatctctacaaaaagtacaaaaattagctgggcatggtggcacatgcctgttgtctcagctagttgggaggctgaggtgggaggatcacttgagctggggacttctaggctgaagtgaaccgagattataccactgcactccagcatggttgacagaacaagaccctatctcataaaataaaagaagaaagtaagaagacgattgcaagaaaaataaacattttctgtcttctgtcctctcttgctttttggcttgattttcatgggttctctgaatatttactatggacagatatttatgatctcttagcctaatgatatagggcatggttagagaaggcagaagagcctgatagtgggagtggaggcaaaagctcaatagaatgtttagattgtaagacaaagtagtttttgaaaattattttaaggctgacctttagggagaatattaggacaaattataaactggttcattgggagagtggattctatgttgtctcagccaataactgtaattaagactgagtttgtgaaacgttggcctgtacctcttaaggattagagctcccttggcttagccttggctcttgtccagtcatttagaaaggattttggttggcataaatgccatctttgcaatagataaagcaggttgttccatcttcttcccatggtcttgacccaggagcacagctgtggtccatctttctcaacaaacctctgccattatatgttaggctagagtttcttgtttgcactatagatatttgtttgggggctgtcctgcgcattgtgggatgttaagcagtatccctggcctctacccattagacaacaagagcaccaaccccaatcctaataaccaaaaatgtctccagacatggccaagttgcctggggagcaaaaatcacccctggtagagaagtggtgcactaggctaattggaaagggaggccttgtactaggcattgagaattctgaacttacacaaagaattttcaagaccagcttcttacctgagaccttttgtaaggactgcacctcttccctcatgcccagctagagcaggaacaatcacttgcaagcctgatccatttaccatttgaacataattttgggctgtcagaattttgagcatgtggaaacataattatcaggtaacatcaggcagtattaagaggctatgaggttctagaataaagacagaccaagtttccagccctgcctctgccacttatgagccactggacaagttacctgacctctgtgatattcattcatcttcctctttttataaatgggataatgatattaccatttcatatggttctgataaggattaaatttacaaatccatttaaatcatttaaaacaatacttagtcttggtaaacattcaagaaatgttaacagctgttattgtcatcattgttgtccttatcattgtggttatcatcatcatcgttattattattaatctattagctctagaacagaattcagtatatagcattaatgaggattcactttagacctcagctgggaggtgtggtttctgatgtgcttcagtgatctcaattcaagattataccacctgcctctgaggagtgtgatacctgaggagcttctgtggtgttgccaaatgcaacactccaaaaaaaattattctagaaagtacacaagaaaaggaaaaggttgggataaggcaattccaatttggataaaagaagcccgcctctttaaatggttagggcatgtattaaatagatcatttggggattgattaactgcctgggatggcctgattttgtcggattcttgacgcgacacatttcgacacgttggagatggacagctaaccattgggagctgaggctttgatgtctgcaacgcagtcaaaatgttaaaatgatcccaatgccaacagctcaagcacaaggcattttctatttctatatcctcttcactactttcttcccccacaacagcctgacaaatacaagtagcccttgctgcaaatgatttatggatggaaaatgtaaatgaaaaatttatttccagactatgtctttgttctagaaatggttgtgagctgtcagagcgaggggtcttgtaattgtaaatcaggcagggacccagtcgccccacccaggcatactacctaatcagctaaattccaaactctagctcgtcctcagaagaattttggctaaaaaggaaatgagaagaatcacttggcccactgggccaaggcagatttatatggaatccaggatccacctgctagggatgcctccttgcccagggctgggtagcagctcaggggacccattgctcattgtgtctttcatgttattggacaggtgattatgaaatcagagtaggttcttggaaaagacatgcagctagagctggggaatggtagaaatgccatggagccaggccagaagaagcctcccacaattaatgggaagctttgaaaattggaggagtggtgatctcagccttagaaaaatatgccaataaactatcaaccaacccagcagaggtgctggtgatgagaaaaggaaagaaaatgttgaatgcattcagcttcttgggaatgcattattcactgcctgggtgagtccctgcatgactgtttcccaaactggcttgatcccagcgacctttgaaagacatttattttttctcattgccttctctttttcagaatgggaatgtgctttgcagccgagtcagatgtccaaatgttcattgcctttctcctgtgcatattcctcatctgtgctgccctcgctgcccaggtaaagcaatttgtctctttctttcctagctgtggttctccatttccctcttcacccaactcaactcatctccataattccccagaagggaaacttccagacagataacaataggaacctttaggcagtccaaactggcctctaaatactttttatagcccaaatggggtacattctaggctctaataagttattgggtacccagtaacagatttttattgggcttttaatcatttgaaggtgggtgtcaatcggagatggaaattgtggcccagagattttctgctataagcagcctcttcctgccatgggcagcaggcaccaggagagttgcagcatggcggcatgtgtcttatacaattagtgctggaattgcatccgagcatagcttctaaattatgagggggccattcataaatcaaaggagctgacccagtgaggtttatgacagtataaagctgcctgcctgctgaatagtcacctcctccagactgcagttattatgtacacattgttaagtgtaattctaaggggcagccaggcagagaatttttcacacaactgttaggacatctactttcacgatttgcagctacggtatttgtctgaggcaggggctccctcaatgacactttgttcatgtctgactggggcccgattcccaccccaaaagcgtgtggagtgattcagagaatgcctgtgggcccagtggcaatcctagaaaaagctacttgacactcttgggctttgtgaagtagaagccttatcatcctgtaagttgattccatttccctttagggtagaaattcttgaactagggttcctggatgggcttttgagggtcagagaaccctttaaaattgcttgcagtttttggtgtaactatgtatatttgtaaattcctttagagaacatccgcagctttattgtcagtcccaaaggggtgtacaggaagaaccactaccccagctaaggtatagacggtgctttttaagtggtgaggaacttccagaacttataagagagaaaccaaatgtatccaggcaaaaatgttaggaataaggctgggaatggggttcaatgaaaacccagtcaactgaaatgttccaagagtggagaatttttttttaatggagaagaaacacccaaactctttttgtcactacctttataaaatatattttcctgcatcagtaaatacaccctaatgaacacaggtgattcatttccagatggcagaatatcatgccatatcacaggtttttaaattctgagtgttggtgctgatagtatatgctttgagatgtcagagattgacttggcatatgaccaacctaaaagttgttgggttttttttggaataagtccctaagccaggcttactgtttctgtatgtgtttatttgcttcttcttcctaaactggattgcaagaatgtggtatgggtgggggtgggggcgctctggtaaatgggaacaatgtttctgataaagttgccactctggagagcttctttgttttttttttttttgtttttttgttttttgttttttgtttttgttttttggttaacctgccaggtagcctgtcagacagccttataaaagctttttattcctcagaagtctccaaaagtggtctaatgtcataggaacttatctaaacttctgtgtaaagattgttcttccctgggaagaaggttgaggcatgacccagacccagagcatggggcaaaacaacatagaatagaatatggctgcacctaccccagctgcctaacaggaagcaagtattgagaaaaagggaaagtataagctagcagttattttgagagaaaaataaagtgttaaaagaactgagctcaaaaattccagaggtgaaagcgttgaaagaaataaacaccattatggttaagacttaaaaagctcattttatggtatggaggatagaaataaactattccttttcttttccttcttgctcttgcagctcacttctccatgagttcatttttcttcttgttaactataacctttaacagctctttctgtgggtagtagttctaaaattccttagtccttatatacaaaaaagtgtatttattttacaaccattcttgaatgataatttggctgggtatgaaattataggtgcatgttcatctcccctcagcactttgaagatattactaaatggtttgttggctttatgtttgtttatttgtttgtggttaagaattctgctatttgtagttcttttgcgggttcttcgttttttttttcttctagcttttaaaactttcttcttttcattgatgcacacaatgagatgtgtaagtttgattattctcttcagcctgctcagcacatgattttttcagccaaaggagtcaaatttctcttcaatttttagtcagttttttttttgaaaattatctcttcaccttcttattttttctcattctcaaaattgtctttggtgtatattattgcatctcatttaatttatcctttatgtctcctaatgtctcctttatttttccctcctgatattctccctaaaatgatatattacttcaactctgttctccaattcatgaattctttccatgcatactatttaggccatgtgttgggttttgtttgtttctttgtttattttcaataaccttgtttcccctcaggttttcaagttatttaaaaagacatctacatgatgctaatttataacctgttattgttttggggaatcttattctcttttttacttctttaaagtatttaaaagtttatttgaagtccatttcagattgttcaaatatctaaatatttttagatgtgaattgtcacctttgttgggtttcttgacagcttttcttagttctgaattttccttggttttctactttttctttcaaagctcattatccatgggtgttttgggtttgttttgtttgtttgtttttgtttttgttttttcttacatgagcccttctttgtgggatggttgttgcaggctttatagttcactttgctctaaaccaggtcatatattaatgactcggtttgggctgcctcatgcctgaatggtctatttctacctctgttttcttgtgcactactagtctctgataatgatcatggactgatctacaactgcctcatctacaactgcctaacttggacaatcagtgttttttagggaacactgagtggggagagctatgtcagcccctgtttacatgcgagtagtgtgaccctagtccccaacttcacatgggaagccacttgcaagctgtagtttctcctcagccatttggatccaaactatccatattcagtcccagctgctgatggaccatatggctttggctcccatttattgctgtactttccttctatattttattccacgaagagtttttttgtgtttctgaatataattttgcagttttcacgttttatttatttatttttctagttccacatttcatctctctttgttttgaaaataacagggagatttctcatgtgttctctttgccatattgaaccagaatgcaaccagctattctttctttctactgaagataaaacaagagtaaatagctttaaatcatagcagagaggagtggagcttgacaaaaggaagaactttgaacaccgtggctgttaaatcctagaataaatgactaaggataattttagtctctttacttaatatttctagaaataaaaaggtacccacccatctgagatagagttggcacagtcctgctttgagacagggcaatggatgtgatgactcctctgtgttccttccaccccagtgattattaggcatgaggaaactcatgccttcagggccacagaaatgtttggtcaaagaaaagggctctggttttccatcttaacccaatggaaggcactgtgatgaaaatgtcctcatttaagaagaaaatatttaaagccaagatgatgaataagctccgtataaaaagacgacaaataagcaaactgtataccccagatactggctttacatactgtcctatagcagtattgatttagagaagcttttgcctaggtggtaacagactcagtggaagtgtcctacctatcatgcttagagcttagtttccattgaaggagacagaggagccatctcatttcatttgtttatgtatttcccatggctcttgctttctaaactcgttacccctaaaatttccaaggagcccacctgtatttgaaattgtctcctacagctcctgctaaaccgtggaaatcagagtatgcaggcagctcttccagaaataccagagagaaatctatactgattcccacaaagagcaaataaattttttttcatcagcacttgtccaagtcttggcagaggtcaagtcttagtcacataccacagtgctctactgggcccaaagaggctacatggaggctggaacattcttaatggaaaagtcaagactgcataggactcatgaacgtcattaaattcatcctggtctctaagcaagactctgtggagtccctgataattaagagattttagtgatttgaaggaattaaattccctatcttctcttttgggggaatgaagtggtaatgctggaagggaaagtaaaacaacatgacttattttcataatatgtgtatgtatatatttcataatatatatattttattttatatatatgcacagagagagaattttatcacaaaaagaagaattttatagtgatcaggagtctaaatcatgatattatctaagagggctttttaaaatggtcattccactgagaatttgctattcagaattaataaatttgggttttcctggaggtattccagcattcctgggttattaaagagctcttataaaattgccaaaataactgatttgatctggttaacagagacctaatccacagtgtttccttttggctaggtgtgaaaaagtttggcactatgaatggttttaataggaatagtgacagtgtggtttgccaagagagacaccccagtcttagatattcaaggtaggttagggaaaagaccttaccagtgttgcactatagtatgtgttcccataaggagaatgtgggaagccctgtgtcatttctctttcaacaatagttgggttgtgagtgagctagcaaacacaggcatttctgccacaatacaatatgcacatatctgaaaatcctcacattctacaaaattgtacactgaaaaatcacagggcttaaggaaaaagtagcattagagaaaaccactcaaaacttaggcaactttgtaaccagaatattaacaaagcaactatactaatgaaatactaacacagtttaaaaaggcatcttacatttctaataaaatattacagtaaatatagacttctagacttcaccttttaaaatggtaacattagcttgaaggaacagtgtttaaggaaggattgaagctgctaagttatagagacaacagtaaattgcacaaagatcacggagaatcatgtaataagcacttacaagacagagcatgtggcccaactgaggcaagaggaagaatgtagggcaaatggcttcctgatttcagttgagttagtgtacttggcttttagctgctgtcacttggtagtgcaaaatattaatttgctgggtaatcatgtatgaactaatgcaatttctattttataccaacttcattcccttatttagcactcacatatgaaccacttgtgttacacaaatccacactatagcacagactgtgtaagatgaggtgggtacatggcatttgactgtagacaagtttagagtaagagttgaaaatcacttgtttactctgaatctgcttttttttgtctttaatcactgacctatctgcccttgtgttccccttttctcccatcccatgtatttatattaaaaaggagtctagagtctaggtctatgactatgtctgtctatatctgtgacttccacagttacagtaatcaagtagacaggccttttgtgtttcctccagtttttttctagggaaggttcaaaagagagatttatttatttattattgtggtaaaagatgcataacataaaatgtatcattttagtgtataattcagtggcattaagaacatttacaatattgtacaagtggtaagaacatttaccactaatctagtttctgaaatttttcaccaccccaaaaggaaacctattacacagtcactctccattccccttttcccctagcccctggtaaccatgaatctacttctctatggatttgcctattctggacatttcacataagtggaatcatacaatttgtggccttttgcatctagtttcattcacttagcatagtgttttcaaggttcacccatgttgtagcatgtatcagtatgacatttctttttagggctgaataatcttccattattatgcatagaccactttcgttatccattcatctgttggtagtcatttgggttgtttccaccttttggccattgtgaataacgctgctacggacatttatatacaagtttttgtgtggcatatgttttcaattattttgtatatacctaggagtggaaattctgggtcttatggtaattttatttttaatttattgaggaatctctcttaaattttaaggttgccccatcttcttttagttcatttctttgagtacctactgccagccatcctcatggttgctgctgatttgctgcttttgccaccatccatatctgatctccattgctctcttctctcttctattctcttctgaattctatattcgtttgtctcttggattttatcaaaacagatcaattcctttttaacagtaacagccaattagcatattgttttccctagtaaggtgactacaatagctgtagtgtgcaagatgatcaaccaggagccactcctttgcctgcaaaagattggtatatatattacacataataattacatatatatatatatgggtccagagttatccaaaagcctgaggattctgaaatgttggtgtctgaatagcagatattttgctttattattattattactattttaggttacagaggggctgccaaaggagatgttcacttttgatcactagaccctccatgtccatactgactgttctcttagacccctttaaccatcttccatgccttatttccactatttttctcatactgttggtccttggacacttgacacagtacaaggggttaaaaccttcttcaagaaagtagcatttgctgggtgcactggctcacgcctgtaatcccagcactttgggaggccgaggcaggcagatcacgaagtcaagagattgagaccatcctggtcaacatggtgaaactctgtctctatttaaaatacaaaaaaattagctgggtgtggtggtgcatgcctgtagtcccagctactcagaaggctgaggcaggaggatcgcttgaacccaggaggtggaggttgcagtgagacaagatcgtgcctacccttcccagcctctagtaaccactattctactttctgtttctatgagatcaacttttttagcttccacatatgagtgagaacacacggtgtttatcttactgttcctgacttattttgcttaacttagtattttcaagtctcattcatgttgctgtgaatgacaggatttctttattttttatggctgaataatactccattgtgtatatataccacattttctttatccattcttccgttgatggaaacttacgttgattccatatcttgctgttgtgtgtggtcctgcgataaacatagggatgtagctatccctttaatacactgatttccctttttttggatatatacccagtagtaggattgctggatcatatagtagttttatttgtagcttttttaagaagcctccatactgttttccatagtagctgtactgatttacattcccaccaacagcatatgagttcccttttctccacatcctcactagaatctattacattttgtctttttgaacataaccattctaactgggctgagatgatacctcattgtggctttgatttgtatttttctgatgattagtgatgttgagcatttttatatacttgttgtctatttatatgacagagccttgatacattagtacccattatgaatctaccagagaggtatatgggatgtaacattgtctaaatttattcagccataatacccattttttggaggcactttgcagaattagggttctttgttatgtgcttcaagaagtgttgtattttgccattcaatttctaggagcaatgtatgttatagcaataagctattggtatatacagtatcttagtttggagaagtttgttagggtagtaggcaattttagcacaagaccctaaactagtactactcaaattttaacatgcttaaggatcaccttgggagatttgataaaatgcagactcccagaccctacaccaaaaatcctgaatcatttaggctgcagtgggtgtcatgcatttcacacaagcatcccagttaattctgatgcagtcggattgaggactgcactacagtaatagggcccaggggagattttgagaaaggaggtcaagagaactgcccacagaaagccgttctgggtaagatcttgcagcagtgggatctccagagggctgtgggcaacatgacaacattgtttcgctgataatggagcacatagacactctggaaacacattttccttgtgtgacatttccccaggactaaccctgcagtaacatgtgcacaatgtgccatctggcctgcccctctgctttcccagagctcccacccaaaggctgcctcttctgccatcttccacattcagagtccttggctgtcatgtccagaaagcaagaccctccgtggggagcttccccctctaccccgcccattgttcatgacttgttgttggcgagaaatgaatggcatttctcggaattagcccaggaatttctgctgataaacaaatgaaactctcaaagggaaaagcaatcaacatagtttgaaataaaatcagtgttttcagcttagtctgtttttaacttagtttgaaataagagtcacatctagggtattttaaggaaaggattagcaaaatgtcctgtagtgggcttttcatctgagttgccagactgacccttgaaccagggcctgttttcttcttgagtaagcagaagaggcaattattaccttgatttcctgtgacctgtgattctgagacctgtccagccatcggatcagctttgcccaagcccacccccacttccctgccaagttgcctgacacctgaaattgtcattacagcttaatcttttaaatttaggccttgtcctgataaattcaccaatctttgaaggtagtaaattaactcttattaatcatttttactttcgtctgaacacaggatttagaaagcagattttgattgtagaaagaggagacaggtgttgcggggggaagatcccgaggccactaagctcagctgggcacctgaagagttacaaagggagaggggcctgttgaaggaagggcctaaggagtcaagctttacctaccccaaagtcctgcagaacaccagtagtatttaggataagttctttatttgtagcagaggacacagtggtttctagaatgagttgccagctctcaagtttttcactttagtgttgttaatttaaaaccaatatgttctcaaagtaaccagatatccttgctatctgttgcctagagccaaagagttttacttcagggttttggacttaaaatgactgtaacccaaaaggtttgccagattatttgcagccactaagataagcaattgtctttattagaatgatttttgtctgatttttgtgtttagaattttataccatcagctattccctaaaagtgattttaggaactggcagacttagggtgtcagttattgaaatctgttccaaaatccgcctcctcacaggactccatttttggccatcaaagtagtctattttataaatgtcttgatgtgttgtcttttgtctttgccacatatactctaagacacagagactgggaagtggttcagcaaatatatgtatggctacttacaaagtgttttctagagttatgctcccagaattggagataggctaagaaatatatgtactgtatctctcagtaaagggctaaatcaaagctgtctgcaggagggggaggaagagggctgcttggattttagtttaattgagaagacagagaaatacgtcaaacttgggagttgaggttattttttggaacatgaagataatgtaagtgtccccacaagctctttttcttttcttcaataaattcatcctgttttgatttcttcacattcacaagattgtgccctcagggatctaaggccaaatcagagtccacactcactatcataccttttatataatatattcttttattattttaatagagaaatggatattgagaaggagaggacaaggaaatgtggcatgctttcttccttgttttctttctttgtttcccttctttccttccctcattccttcctttttattttcattctcttttttgtttaatttgtgattattttcttgtgctaaaaatccataacataaaatttaccattttaaccatttttatgtgtacagttcagtaacattaagtgcattcacactgttgcacaaccatctccaccatccatctccagaacattttcatctccccaaactgaatctctatacccattaaacactaactcctcactttctacttcctgtctctatgaatttgactactctcagtacctcatatgaatggcattatgccgtatttatccttttgtgatgggctttttttgcttagcataatgtctttaaggttcatccaggatgtagtgtgtctctttttcaaatggggaagagagagaagaaatttgagaagaggctggtggtagaaatgaggaagtgaagtcaggagacaaccaaagagtcttagaggaatctagcaaatgttgcttttcagaacacattttttctggaagactccagagaccacactgtctttgaaaatgacaggcctgacaagcagtaactagtattactgcctgtgtgaaatgctaggttttgaaagacgtgttccttattaatgttccccagggaacttcagagagtgtcatctattaggagctgattactggcaagttttgtcatctgcttttggagaaatccataggaatagaacagtacccctgtttctctttatctggagaagtacttttccaaaagggcctcttctgcgattgctttctgagggaaattgtgtctggagccattcaacatagctttattagaaagattattaaaggattagagtatgaaacctatgaggtgatgttgaaggaaaactgtaattactgaaactggtgaaagaaagacaggggccttcaccaagtttcagaaacataaatgggtcttagaggaggctgatcagctttctccttccacttccaaagggggagaaagagtagaagtgagcttcagtataaaaaacttaggcacaaaaaagtagttccaggcatagataagggaagctgaagtcattttacagtcaatatattatattaatagctcaggctcaatgctgagtaaacacaagacacacataaatgcacaaacgcatacaatatgattccattaatatcaagttcaaaatagggaaaagtaaactatattgattatggatgtgcataaatgtgataaaactacaatggaaagtgaagaaatgattatcacaatagtcagcatggtggtgagttgacctccattggggggtggtgcttctggggtgttggcaatgcactctttcttgatccacgtggtagtcacatgggtgtttgctttgaaagcatcagtacaactctacatttatgttgtacgtatgtaagttatatttcccagtataatataaagtgggattacattttcatttgttcttgatggttctgattggaggcaaaagtaccagaagaccttgcaagattacaaccaagcataggattctgtatgtgcatatggcaatttgggggactgttatatttgtctacttgtttgcattgttttggtcttcttgatgtttggttttgtgtgtgtgtgtgtgtgtgtgtgtgttttgttttgatttttttttttttggtttttggtttttgggtctttttgtcacaaagaatagcagtaccaaaacctagagaaaggtgtgctccttgtcctctaagtgggctcttggaattagtaagtaggcatttgaggcattgatttctaagctgtagagtgcacagtgtattggcatctggatgaagccatctggctccaggattttatcactgaccagagggccagagggcatgtttggcttccaggaagtcaggctggtcaggaacccctttgggaaggaagaagggctttggacctgtggagtatgcctgccttccctcaaagtgaggttttattgtgttatcatggggggaggaaggcagggggggccaataaagagatggggcctcgctctgctgtccttccagttcactgtgggacattcacagagctgattaacctctttgtacctattttctcagcttgtaaaatgagatgataattcctgccttctcttaaagtttgcattgacagtgaacaagaaagttgatatgggaaattgctttgaaaagtataaggaggtatatataatcaaggcagtgatcagcaatgaaaagaaggtatttaaatcctgggtccccagatttcatctgggcatatctcaatatgggcaaagcctgaaaccatagcattttggtacgtgttcctctagatcccaatgatagcagcctcataaccaggcattgaccatgtgtctccagcctcagggaaaagatgaggggagtctaaaggaaacaagtgacaggtttaatgactgtcaggcaaaaggcattaaattaatggcatcacctctgccttgcctttctatttccttctgattagattttcagaggtgcctgtgtgagtatgccgcacaataatgctgatgttctcaaagctgagtgagctcttaacagaaacataaggtagtgctgagaatgcactcagagacaaggtaaaaatctctagactgccttgagaaattgaaggggatttttctgggggagggctagaactgatacctcctccctcctaaatcataaaaagagagagcaagattcaccattatgtgttgattaggctgccttactcctgtttggttcctaccttctgctaatccgtggtcttgctagaggctgtcatctggcgcctcttgcaggagcacagtgtgtccgtactgcagggggcctctcagaccactgggatcagggaaatgagccattgctgtagtgttacttccaaaccagggaggatcagcacacacacacaccctttctgcccccaccaacttctccagggctttagaaatgtctgggaactgttttgttcgtcacagtaatgggaggatgtcattggcatttagtgggcagcaacaagagatgcaaaatgttccacaataagtaggaacacaacgcatggaagaagtgtcccacacaaaattccagtggtggctctattgagaaatactggacagcagccttagtcagagaagcctagtgaagggcgtctcttcctaaccagaagttggtggtatgagtccacacattcattaattcactcactcactcatattaatttcacaaacatttacagagtataagctttgagacatagcccatgtatggtgctgaggtttcagagttcctgcctcgacgagttcacaatctagtggaggagacacgcataacaagattattaaaatgtaatgtgatgagtactctggtagaagtgtggacaagggctgtgcaggcagagaggggagaagataggcactctccaagagccaggaatcaggcacagtcccagaggggagtggacatttgagctgggttctgacagatgaatggcactttgccagatgtagaagagggaggtggggagggcacgtgcagaggcatgtgtgggatccgtgactgcagttgagtatggtctgtgtaggagggaggaggctggaaatgtcagattgatggaggcccagtctcaaaggaccttgtacatcctgtgggtagacattattttgcagagccagcccactgcaaaagtagggaggaggtgcagtttgtctttagtgttcttggatgtctttttgcatcccctttcctctcttgcagtccctcatatcctcatctctctcccagccacttacaaaggcagctgatgagactccttccagcagaaaggtcaatgcttagcttaactgtaagaattcactaaggatagatttctggatgtcaaagggagagtctttgggcagagaacctggaagaactgagcactatggagatagggcagaggagctttgttcagtttacacacacttgatgtaagtgtaagtgtatgtaagcgtgtgggtgagcatgtatgttggagtgggtgacattgtgtggtatgtatgtgtgtgtgtgtgtgtgtgtgtgtgtgtgtgtgaatgagagagagggagaaatgggacaatgatagttcctatctcaaaggactgttgtgaggattaactgaattaaggtatctaaaggagttagcatagtgccctgcccatagtataccctcaataaatgcaaggtattgttggtattattttagaatgcagggccagaattcagtctggagaagggggaacatgcttactaccaagatggagatgaagattttacactaaggcttagtggctacgtctggctagtttcaaatatgtgcctaggacacattctatcactgggataatataatttttcagcatgttggcttatcagaatgtacatgttcccaagtggagccatagcattacactgtatatatttgggtactttctccatctctactcatggaacacatggcaggtagaaagctgttgttttacaaatgacgtggacctgtcttgaggcccagatcagctgatctgtcctcatgtatagcaacataaaatagaagaaccacagcactagggccagagccagggagatgcattagaaaggaattaacttgggaggatctgaattagggaacaaaagtactagccagagaaggaaggaagaagcaaaaagggggaaaaaaatcactaaaaggacaggatacataagatcatccagctgcccccaaactgaacttacaatgttttctgtgttctctttggaagaggagttggcttgtccagaattcaatggaaacttgttgattgacactgaattgggcacaagttcaatgtgagtgcgcctgcagctatttatttgattttttaaaaatgcaccctttgcagtaagactgtttagtttctactggcgccctggggcagtgagtttagattgttaaaatagcagccattaacactctctgtgttatgacactgtccttcctaccccactttagaggaatcaggcatgaggttgtttgacaaaagtttaattctcctctccccaccaaaagaaactgagattcctcctctgagtcagaggcacgtttgcccagccctaaccctgaaaacctccaagtctgcctacccgcctcaccaccatccccacaaacacacacacgtgactctcatgtacatctggaacacacacactttcacatacactctcacaggctcacacccacacccatcccacaagctagaggaaccctagggagcccttgtgcttgtcttgctgttcttttgttttgctttcctgtatttgctttgttttgatttgaaatcagtctttgggattacattggataattttttcatgttattaatagtgctgtgcagggagcatgtaaggacttcctcctcagtcctggccatgcttgcttccccaaatacaatgctgactctcattgatcaatcaaactgatctttgtcagactttgcatacaatacctcatgggcaaatagctcagggagctctaaaagatgcctgaattctgggattatctagattattcatgagtctgcttaaaaggaaattttttaaggcaggactggatagctatggctttcccaaaggccctggggaaaaatcaaaggagcagagacaatgtggaaagtgtggaactgctcagctcccagagcaaggcaataatctgaccaaacactaagcccccacccaaagtcagcattggtcaggctgaacagccatcatgagcacaagcctaggaggcatggaagggaagttctgtgttctctggacatctgtgatacatgttgtctataccagcactgtccaatagaactttttgcaatgatggaaacattctatatctgcactttccaatgtggcagccattagtataggtggctgttgaacatttgaaatgtgactggtgtgagactgagaagctgcattttaaattggatttaatgttaatcggtttaaatatgaatagacatatgtgactagtggttactgtggtgtatggcacagctttatcccattcgctggatacttctgtgcggcagtgaatttaattttgtacctcctctctgttcagtgtcttgcaactacatcataaactttttgagggcaggaatcatatattgtacaactacagaaagttataccttgaaaagatattttttttcagctgcctctccccatatttgacaaatagggagactgcgaaagactctgtaactttcttgaagtgacagcactcattagtaacattacctgagcctggaacccaggtctccttgcctcccggactgtgcttctaccacatctcccttgcagacaagttttcgaaagaggaagagttttcttcctctccactttcttcactgtttatatctgagattcagcccctgatacttggaaataatttggatctcaagtctacatttatctcctcatctgccaaggcacaaaataggctctggacaaatgtctgtggggtgaaaattctctgaggtctttctgttgtctgttatcttctatatttttaaagaaaatctttttctgcctcagtgtgtttgagacaaccattacttatgctgtttcagcccagggagatggggcctctgtagatgtggccctggcctgtgcaggtgctcaggtatacattagagaagcctgtgcaacagcctggcaggctgataaaaaagctgtagcagtttgggacctgggcccctctgtcttctaaattctctagacttgatggtagacaaggatgccatcagacatagcgccctcccttcaccacattttcatagtaacctagaactaaagatgcttcagggaggagtctagggccatatcttactggttactttagaaagtaagagaaaatacccagtagaaactaacctcagaatcacctgctaaaagaaagaataattcaacttgtaggtccaagtaaagtatcctttcatctctcttctcctttctctgttttccaccccaggcctttgccctcaacccagagccaacctatggtaacacagcaatagctgaattgaagcaaaacctgttaacagtcaccaaaggctgagtttcggccaagcagatagctcctccaggcagcccttcaaaagccaggcagaggcaagggggtaaatagcctgtggcctatctgcagtagaatggccagatggtttgctggtgccaccaaatgaaggagtgatctggtactaagatagaaggcttccagggaccctcccagccctaaaaatcttaagcccaagtgtagtcatcagatgccaaggacactggagaaagtctttggagcatgtagaacaccaagccaattggagtgcctgctaggacagcacaggattcctagaattccggccacaccatatacacccccacccccagagggcagccagtggccacagcagaggccttacccagcaggctgagaccctcatcagaccctccaagagcctacttccttacttagggcctgcctgcttgcactgtgctgagttcagggaggtggacaaactgtacctcccactttagcctaagaatctgacttgccatggactctccaggcagtgaatcattttgagcaagcacttaagcaactttccactgagtcattctgaggactgtcaggtttgctaatcctgatatatactgtgtataccctttgttcagatcctatacccatcctgatattggaggagaggggttataaacaacagaactttaaggatgtgctcattagaagtcatttgtattagggttccctttgccctactgactctaacagggcctgaagcactaagagaaatcctgctggtaccaacttttgatttgtgtatgcttttggttacatagctatcaagagtatgtactctttacctggagtggcagtgcacattggatttcttttccagaccctccatggatctgttttcctttggcttcttctagactaggggccagcatttctttttttctgtaaagggccaaatagtatatatgctagcattagcaggccttgaagtctctgctgtagcaactcttgcattgtaatgtgaaagcagtcataggcagtatgtaaataaatgggcatgaatatgttccaataaaactttatttacaaaaacaagttgcaggtcatatctggcctataacccctgttctagacacaataggctaagtcaaattagtagctgagacttagtttcagctgctagagtgcttaagcatatcacattggggaaaaaatcactcttatcctccattcttttggggaagagaggtagaaattgcaggaatattttcatctttcccattttgaatatcaaagcccattcctcatcaaatattacatactccatagtaatcagaattggctaaagtatgatgcagtagcaacctacaaagttcaggacttaaaacaacaaagatttatttcttactcatactacctctttgtcttaggttggtgcctgtcattatcaccaacagactctggctgacagtgccgcaccatcgggaatttagttccagcactatgggaagggaatataacacactgtggtctggctgtttaagacttttggccaggagtgatacagattacttctgctcatctggcattggccagagcaagtcacactaccatgacttgacttctacaggacagggaaatgcaatactaccatgtgcctggaaggaggagaatttgaatattgatggaaagccctaatgacaatcacacactctaagaactccttttcagtttcttcttcatgtcattccttgcctacctttaggttatctggcctagttgtatcttttgtccaaccctacctggccttcctcagacatgctggtcattgacattgatacatgggggagggacaacttagggactaaagcattgggacagtaattattccctaaaatgctgtgtagaccagcatgaacatgaagtcaggcctcagagccaggtcttacatgccgttggatccaagggttgattgccattgggcagcaagcctgagaaaaattggacctcccataactctggttttgatttcactttagtttacttttaatgagaatttgaatcagagaggaagttctaagcatattgactttaggcagtgccttcccttagtgctatggagagcagttatcaagagggaagaggaatatggaatgtgaaaggtagaaagtataggtgatattaatgcagtattatgggctaaagtgaaacatatggcccatgattttagaagaaggaatatatctgcaaagacaaaataattagttgggataagcccattgctctaacaatccccaaatcttagtgactaaagacaatgaatgtgggagtggaggggcctatggagagggagggcttttgctccatgcagtcattcagggacccaggcccctttcactctagtggtctttctttcctctagagtctcacagttcatcactggagcctctggtatgtggtccttagtttagggaaaagaaagcaaggagagttttgcaggacgttttataggtcagtcttctaaggcatgtttatcatttcttcccacattcaattgactggaactcattcacatggctccacctaactgcaggcgagactatggaatgtagtgtagctgggtgccaggagtggaggatggagatgggtttaatgagcacacaacattgtgtattccgctgcatacttgtcttgagcaagggtgattttttgtaggaagggttcagtctgactgagtcttaactgaagtcttcatcaacatactctcaatattgaaatgttttccccttacagagcactgtcggccttggttgaacagaagactagtcctgactgcagaggccttagataaatgcaattttgccagtccttacattttacttcataattcacatggcctctggacagatatgtaagagcacttgcattctcattggtacaggtttgggatatgtatcctggggcaggaacgtgaaatagatgacattcaatggtatcgtgagcaatgatcctaggaaattcattctgaatcctaaactgggcgtaaaccattcttaaaaagtaaaaggaaaccattaaaattggaactacataactaatctttgttccatttttggcctggctaccagggcattcagagtcctttaacacactcacatagaatacatagaataattatgttaatcctattcattgtttttttttttttttgaaggagtctcactctgtcacccaggctggagtgtagtggcgcagtgtcggctcactacaagctccacctcccgggttcacgccattctcctgcctcagcctcccacgtagctgggactacaggcgcccgccaccacgccgagctaattttttgtatttttaggagagatggggtttcaccgtgttagccaggatggtctcgatctcttgaccttgtgatccacccgcctcagcctcccaaagtgctgggattacaggtgtggtatttcttatagctacttctcggttcaggtgttttctattttcaattacttcatgatatatgttgtttgttgagaacaggagaaaaaaataaggcatggcttcttcttgttttatttaggctcggtttgaagactggcatttgtgaaaaagatttttctgtgtctatcgtgacttcctgagcagttggttttatatggtgtagttttggagatgaacttcagctgaaagaaaggctcaactctaagtttgatgtgagccaaaggagtgcatcacctcttcaaggacagctagatctttgctgtctaatctaaagctgttcaccagaatggagaaagcacttttatgttccttttctccctagctatatttcaaacatttagggattagatgatttgtatctattattttttctagtccagagcttcgcaaacactttggggccagataattctttgtcatatcgtctatcctgtgcattgtgggatgtttagcagcttctctgacctctacccactagatgccagagtacccttctcaactcgtgacaaccaaaaatgtctccagacattgccaaatgtcccctggggaaaagttggccccagttgagaactactgtagttgtaaatttttttttaattgggggtagataccctcactttcccagaatcctgttctgtatttgacatttcttgcagagatgggagttggaaacaaaggttatggatgtcagggagctcagttctaagattgcctgcatttatacctccctggggtgtggactcaggccatatggaacaaatatgacatatgtttgtccagtacgggcagtaaaaaggcttctcaatactcattaacctttgagaagctgacttgtttctacagcattattgaaggttctgaataagatgaactcttagaatctgaatcactgggaatcttcctgaagtgcagatgatgtttcagtaggtctggagtgtgggtgtgagattctgcatttctaactagctctcaggtggtattaatgctgctggttcccataccacactttgagtagagggttggtggtctctggagaagaggagctggctaactagacactatttttaggttctgcagaaggaattgttctttccaagattattccattggcccagtaagtagtgaagtaatctgcagttcttaaacattccctccttctcctctcaagaaggtacaacccacagtgatagtctccctgctctctctttcattctctgcagccatttaaggctaatatgaggtaagctagtcaagtacttccttttgattagctaccttatattttttggaccttctgtgtgtccgtgtgtaagagagagagtagtttcctttccagaggaaatagtggggataacttcggaaaagccattacagtgtcagaaataggtggctattttatcctagctggagtttcagataatggaaaatccatctctagaacaatgtagtatagctccacttctgggatcacttctggttggccacttcctagcctttgtttcctcatctataattgtagataatagcaataatcaccttagagggtggacatagggagaaaagaactaatgaatatcaacctgaagccctgagcacagaaccagctcagtgtaagcatgagccagtaaatattagttcctaatcttattggtgtggttattgtcattattggaactgggatcctcagactctttttgcctctaaattgtttgcatatattgtactcctatcagtgacatctttcatcatgtgcagtgattctcaatcagggatgaggtggtatgtggagtttgaaaccactcccaccagacaccatggtctccttgttcctcttttgagggttattggtctaagcaatgactgaatctcatattgtttttccagccttggtaagtccaaagatgataatataccttatttatttgtttgatctctgacccctatcatcacttttcactctaatcactttaatatgagcatctggctgccaaaagaagcccagtttcaaactggaaatttttattaatatttgacatatttttacttttcacacctttctttcctaaggaattgtcaccatcccatggcaatcaatggtggagttctttagaatccagatttcctaacaccttccctttcctttctgtgtattgtgtagtcttaactaaataactctccccacatcaggaattttggtctgggttcttaaagaatttcctaggagaagcaaaatgatactttgtcttttcctctagtagttccatgacatggcagatgagctgcctccttggtcgtcaggaagaggtagactggattttcctaacagcgttcccactgctccagcagcctggagccttgtgtgccaccactttccttgcaccctctgccagtggcctccagggaccactttctgaagccagctgctaacagttttccaaacaaaataatatgtgcattgggggataacttttctcaattaatcttcaagtaccaaatgcctcttttcttcctttatgcctaatgtgatagcaatgggctctttcagtcacctcctgacatatcctgtccccgagctcattatctcttttccagtcatctcagaatagtttttcaaaaatgtaaatctcatcaaatcatttcactacttaaataacttccctggcttctcatcatatacaggaaaaataccaccccctggacttgacttctttgtgtctccaggtgcctgatgtcattgggctgttgttgcaagtggttctggttattagcactatacagtatttcacaggggagcattttctcttgatttatagggcttgctaatgaaagaaaagatactggagatgctatcagccatctaggagtaacgtgttaggtcttagctgaaggttgagtgtgactgaagttgggagtgcggttctggattcagcagataatagtgtccatgagatggcgaatatccagatcctcaaaatatctaggttttgatgtggtgcagggcagtgctttccaaggagtgtttctggggcattcatagttgttacctaggtgaaaaaaagagtctggtggataagtaaagtcagagaaaatgctgagttatcattaaacaggtttctttactatgggacttgtgagatccttttaacatattgaaagggacactgaatgttgaatgtggatcttttcccaactttatttaagcacagaattttgttttcacagagcatcttgtggactagtagtgctctgcagagcagacttgggaaatgctggtgtaggcaatacaaaggaatgcttgactgaactccccactgtctcatccagatgcctcacattgtttctgtaaatgctgcttgagggtaatgactaatttgtccatttcaaagggtcattgaccttcaaaaaaaaatctagttctcaaaggattagaactaaccaagtaatagtagaactcattcttaatttattcagggagaagaggaaggcagtgagtgacaacattaccacataacctgttattaacaatgaggcatcgtgaagaatcattgatttaacattacacctcctggtaattagaggtttttaaaacccatagtacagtagcaaaggaataatacaaatctatcagattcaccatggaagggattctttttgttgggctacataatccaagttcacatgaagatttgaggttgaggaattagcctctgaaaacagagggatttgtgttttatcttccgcaattattagactggattttagtgggcttctctagccctcacgttttgctgctctaggtaaaatgaagagacctaaatttgaatctttgctttggcactaaatagcagtgtccccttggcatctctgggcctcatttccacctgtcaaaagagaaggccatttccagtttcctcttggagatagaaccctaggaggcttatgtaatgagattggaatggtccatgagctgaataatggagctgatgataaagctgttcagtaaagtggaagaagaaattttgacaggaaagaacatagaggttgcctctgaagactggattatgagaaacttccacaagtaagtactctcagcacacagaaagctgaaaacaagtgtgcataaccttagagccacagaatctggacagagttgtttgcagagatctcatactgctgaagtgaaatcctcagcccccctgctttgtatggcaatagagagggtacttcttttgggtcatgaaatcctgagaatctgattgaacccacagacccttttcccagaagaaatcgattctgtaactcacttctgaatcacttttgaaaatcatacttatttctctccagctatctgcccttaaatgaagaatcaccttgcctctagatatgcatatttatatgttaatgaaattaataccagactcttaaaattagcatgtatcactatttgaatatttgttccttcttgccatgctctgttccttttttttttttttttttttttttttgagacagagttttgctcttgttgcccaggctgtgcgatctacagcacaggctgtgcactgcagcagtgcaatctcggctcaatgcaacctccgcctcctgggctcaaccaatgatcctgccttagcctcctgactagctgggattacaggcacctgccactacaccaggctaatttttatatttttagtagagacagggtttcaccatgttggccaggctggtctcgaactcctgacctcaggtgatccacccacctcagcctcccaaagtgctgggattacagtcatgagccactgcgcccagccagcatgctgtgttctaatgctagagccagcaggagatagagaagtagaaggcatagaccctgtctcctttgcacttattgatcacttaaaaagcggcacactttatattaggtgctagatggtaggatgcaaacaggcagaccatgagagttgctgcagaaaatcagagtgtgtttgatgggccctgggggctggatatgagtaagcaaagagtagtctgtgggggcagttggggctagcatgagtcagggcagaattggccaatcagaggtagagcattctttagccaagtggcacatcctcaggggatacatctttgacatgaacttcatgaccctggctgggccatgctgtggtgtgggtccgtacatggaactccagtctttggggtgtgcttactcacaagcagttgactgacactgcaagactagagttgctacctataaggcagcacatcacaagctgaagggacttttctaacttctatgggatgtagtaactctggacactggaccatcaaagcagacaaaattatacatctctttttgccttcaggtagaatgcatttggtaagcagggagataatcataatcagttgactttgttgtatgttgcttctttactccctgaatctttttgaaaaacataatcatttttgttctttataatatatccctgtgaaagagaagcaggtgaaatgattacctctgacacacacatacacatatccacacagaaagttctttagaaactgaagcctagagatgcaaagtgatagcagttccatcacacagcaaacaaatagtacaacttagctaagaatacatgggccctccccctgccccccaaaaaacccccaaatctatgccatttgcaagcactctttgcttcacagagacatggccctttcttgcacactctctcctcaagccatccttcctagccatctgtctgacaagacggcatattcaggcagggtcagctactgactgacagcagctgaaacactgacggaagtgggatgaaaaacagcctgcagatggggtccggatgaggagggggagagctgggattagactaggatgtgagctttcagcgccctcttccactctcttctcgccagctggagcagcagatgactgtttcctctcactcggcaccttcttggttgggacagagtgttgtgtctgtctgtttagctgcagagtgatctgttgaatctgctacaagaatttcctggcctgggacctcactgggggttgggccaagggtagaagtagggaggccactagtcttgttgaaggtgtggtcccacagagtctcctggaagctttcaagcaggaaaatcttccccccatcaccccctcctttagctgagctgtctggctgacccactccatctcccaaagtggatacaccacggctggggacactaggcaaaattatgacttgagattgactccctctacccatttgtgattctccctttctttttaatttacctttctcttcttcaactgcctatcacctacaaaacaccttcatttttttcaggcccgctccgctctgatacccagtctttgtgtttgtattgtataacgtttggaggttattttttttttttggtaacgctttattgaggtatacatacctcatactgaggtttacatactgtaaaattcacccttttatgttgtaaagttggttttagtatatttacaagatgttgcatccatcaccactatctaactccagaatattttcgtcatctctaaaagaatcccatacctactagtagtcactcccattctccccttcccccagctcctggcatccagtgttcttctttctctctctatggatttgcctattttggacatttaatgtaaatggaattatacagtatgtggtgttttgtcactggccttttttttcacttagcagaatttttcaagtttcatccattatagcaataatattacattttatggatataccatattttgttcatccattcatctactgatggacatttgcattgtttccatcttttaactattatgaataatgctgctataaactttcatatacacatatctgtttcagttccttctttcaatttttttgtgtatatacctgggagtggaattggtggcttatattggtaactctatgctcaactttttgagagactgctagattatcttccaaagcagctgtactattattatttttttttacattctcaccagcactgtataagggttccaatttctccacctacttgctaacccttgttattattgtcttttttattatagccatcctagtggatgtgaaatggtatctcattgtaggattccccccaatagcgcctttctctttactggggaatagttccagtcttgtgtattcatcactgtgaagatattaaacctctgggaaagatagggcccttctctaactaatgattgaatctgggggcatatcaggcattctggcagggtggagaggaagagagtttagggacatggtgaacttgccacctttggaagctctaccatcgcagaagcaatctgctctattgattgctttcccttcccacaaagagaccatcaagtgcagaagtaatcaagtgaagttttcttgaaaaggcaagacaagagctgggcaacgaagggtgggaggccaaaggatgtatgaagggggaaatggagaggcttcctaaactaaaaaatattaaatcctttctgaaaagcaccttcagtagtgacctaaaacaaagatgaaagtcaaaccaatcaacaattacttttgtttagcaattctggaaaacatgttgcaggagaggacactggaaatgatggttaaaatacggtgggagccatggcagttcaagcctgtaatcctagcacctcaggaggctgaggcaagaagatcagttgatcccaggactttgaggctgcagtgagccatgatcacaccactgcactccagcctgggcaacagagtgagaccccaactctaaaaataataataataaaataaaatacaatgggagtgttggccaaggagttcactttttctctctattccatgccctttaggactactcataatcacaaatacatttgtgacccttctgagcgtaaatccacctgtctggggtgctcaataagtccaaagtagagtctatgtgcttggtaaatggctctggctagaaagcaactgcttggctaaatcacacctgacggtcttcccactgagatgggaaaatggggcagatagtgtttgcccaggagctggggcataaaaggattcttagtggatgtgatggctcagaagtgaatctctagttaccacttgggatctgacagtttttgagaagttctacagggctgtgaaagactgcacaggggtaaaaacaaaccttgtcattacattacaggtgttgagaatttctaaaatttacagtatataatactgattgaaaagtaaatgtcactgctactttggagttcagcataagccttatacagaggcagggtctgccagtgtggtaagaggatggccactgtaagggttaagtagccccacatctctttccctaccagcctgctttctgccctccagaaaccctatcatttatagctagtagtaaaagaacaacaattgcatttattgggcattaatatgttcctggtactatgctgaacagattatgtcttaccttgtttgatcatcccaacaacctatggggtaggtaccattatcatcccaattttatagatggagaaactgagactcagagatgctaagaatttgctcagctaataagcaataattagcaatggagctttaatttgaatccaaatgggacactctgaagtaaggcttctcctctccctaggacaggtcttggaagctgcatttttagcaagttccctcattcaggtcttaagttctagaaagtttcacactctttacccggtgctctacagcctcattatgaataaaacatcaaaggcctatgttacaatataattatctagaaaaggaccctgttttaaaacattatctaccattttcatttcagtatgaattacttaacgggattagtattaaggcctgccagcatgacctcaatgtgatgggccacaggagagttaagttcttatgggggaggagagtttggggaaaatctagaaatcgttggactctacccgaggaaagcagatctagttaagtcatcacatcaagaggcccaggggaaaaagaagtgatggcagttgaagtgctgaaaaaaaaaaagaaatctaaaggtaggcatcattgattcaactgatgggcccatttgaagcagtacctctgatctcagggagcatcccaaggaaaatgtcgtctgaatccacatagcctcagaatatgagcattgttactttttggaggtggggggaggctgcagacacccactcttctttgtttttgtttttgttttgagatagagatttgctcttgttgcccaggctggagtgcagtggcgcaagctcagctcactgcaacttccacctcccaggttcaagcgattctcctgcctcagcctccagagtagctgggataacaggctcccgccaccacgcctggctaattttttgtagaaacggggtttcaccatgttgactaggctggacttggactcctgacctcaggtgatccactgccgtcgcctcccaaagtgctgggattagaggtgtgagccactgtgcccagcccactgtttttgatacattcatcctgcaagatgtgttgcatcctggatgtatgctcttactttgcctgactgagatgcagctagctcccagctgctcctccctccattacagcagtgctctggtagaaggccatgggtgatttcccactagcaaccttatttgtctatgttccttccatttgggccaaggactaaaagccagctcagatttacacaattactttaacattgtttaagaaagcaatgtaacaacctccactttgcccagatggacgggctcaatgatgtcggtggagagaacccattattggaataagactgggaacacaaagtcatagctaggatctctcccactagtaggaatacagccgggcttctgatgaccagctttgtaggattgattttctatggttggaatggacccaaaatgttcacctagtctagtctacggccttcaagtagaagttttttcaaacgtagtcttcaaatttaatgaggaatacatttatatcattcaagaatatgaatgcatatgtatatgtacatgtatatatgattatatatctaggtatacatataaaagaatgcaatagaatatcttattcaccccgtcccacactcacccaattcttatcttctccctacaacatgtagttcccccccataacttttagtggttatatatctttccagatttttatgaaaatgtaagcaaatatgaatatatatatatattttaaaaatattttttcatttacataaaaggtagtctattgtgcacatcattttaccccttgttttcatcatttaataatatatctttctgtattagtgcacagagaacttattcttttatagaactacataatattttgttataataatgagccatcatttatttaaccagatttctatcaatggacatagaagttgtttccatattcagccattacaaacaatgctgcaatgaataatttttatatgtttcacacatgtgcaagtatatctgtagaatgaattcttaaaaataggattgttgggtcaaatatatatgtatttttaaatgaacagatattgctaaattgcccttcatcatgttttaatcaagtcttcacagacttaccaagagagtgttttattcaaacttttggatttttctaaatctgctaagaaaaatggtatttcattgcagttttaatttatatttctctaatgaatgaggttgattttttcatgtctaagggccacttgtagttccatttctgtcaactgtctatttatatcctttttccatttttaccattgggttatgaatctgtttcttgtcaatttatagaagctctttatatattagggacaaataggattttaatccccaaacagcaaatatgtgaagagattctattccagtgttttacagtgtcttatggcagcaaactctttcttcaaatgaaatttaaaaaagctaataaaaacacatttcactaacaaagtaagaggtattctgttgaagtagaaatggggaagggattttttttttcacatccctcaagtacctctgaagaatcctaaagcagcacagaacctagtttgaaaataatttccctacatgcctagttggcctgtggttccagtttctaataactctttcagcaaggaatcttttttagtatctaacctgaatccttattgatgcagttgatactcctccccacttaacattggcaatttgtgattatttgacctctcttccattatgaacctttatgtgttatttaaatacattatcatttaacacctttttgtgccttcccctccaatgaaagcaggattttacttgaagtcaggggaatgtcctatttatctttgtagctttaaggtaacataatgccaggtattgtcaatgtatagtcaaggatctattagtgccaggtatagtcaaagacctccacaagtgcttgttgaatgaataagaaaacaagagagaaatagtgttttgactcatgtctccatagcacctaccatacacatcagtgcaaagcaaatgcctttcagttagttatcatctatggaaattgggaaaattccttcatattcttcaactttactgctttcctctctgtgacctctttctagagcaagatcatctaccatttattgtgaatgttatgtaccagatacctttgggctttttaaaattaattatcgctgaacctcacagccacgtaaagtagaaggcatactcaagccttcctaagatcacagaaccaagacatgccaaagctggtgtcttagtctgtttgaactggtataacaaaacaccacaaactgagtagcttataaacaacagaaatttatttctcacagttctggaaggtggaaatccaagatcaaggtaccatcagatttgttctctggtgagggcttggcttctggttcagtgatgataccttctccctgtgagcctatatagtagaaggggcgaacaagctcccacaggcctcttctattaaaagcactaatctcattcatgaggatgttgcccttataacttaatcacctcccaaaggccccatctcctaaaagccatcaccttgggggttacgatttcaacatatgaatttcagaggcacacaaatattcagatcatagcagctgggaccccagagaccaatgtttgcagaccccagagaccaggctcagttatcttctcttgcatcactgtgagatacgcacatagaaacagcatcctattctaggggtttctttcaaggcctttttgtcattctctcttcccatatatttctgagacttggggtaaagccctttagatgatgtagttttactttgttggatgtgtatgtctctctgtgtgtcatgggcaattaaagggactataacctcttctttctagtctttaccttcatttccatgtcccttctccagccacctcccaatagcctgcaaatgttctaggactctatcagtagaatgacagagaaccaaagaaatgctagcatcaggctcagccatcagaagaaaagtaggaaccaaagtaatggcagcaatggcaaaagaaaagatggcttggcgtcaaggagattagcaactgatctctgaaagctctggggaggtttgtatttataacactgggagcagatttgtctcctgacatacaagctgcttttctgactatccaagaactgtcctactatggaaatgatcattttatagggtggggagagtggggaagagagcagtcagcatgaggacttggttccagagtgtgggaagaagggtaacaccaggagaggagggaaggcgtacaaaaagaagtgaagtggaaccacaggcttcttggtaaaatttgccagttgctctgaaggacaaaaaaaaaaaggcctgtggcagttattcagactgaggtgttagttagtgacaaggtgtaagtgtaccctctcatataattcttgggattacaaaatctgattgcaaaaggtagccatttaacctagaggaatggacttccaatagtggcattttaagcatcagtgtgagaaaaggtggtaagagacatttgggataagggggtattttctgagcatcccggaaatcatagttctgcttacatatgagatcatccctcacttggggagaagaaacctcctctttcccaacacatctgtggtcacatgacttagtgcttgtctgctcaccctacaatggttttttctccagtcctcctcttagtgctaggtgggaatttgactggaaacagaagagatgggggaggttagaagccacgcagcctggtcattcctattgtagcattccctgaggggccctgtagccagctttgctttgaactgattttctgctagttttcagtcaggaacactgaatgtgttccaaggatatttgtttactagcccagccaccttggaaaatctgggagaggagaaggtaaaatatgaggtggtttttcttccttctgcagttaggaagcatgctgtgttggccctctaaagatgcaaggggagatttgagtccatatcgcattcctagaaatattgaagcttaaagaggtaaagtgccttgtacaagattgtggggagtcagtaccattgagttgggattgtgactcagtgatcctgctctgaagctttaacacccattctgtgaagagcacaaatttgaaagcaggaaagctatatttctgagttggctctcttgttaaacagctgtgtgacatgggacaaatcttttggagtactagtagcctcattttcagtaattcgccccccacccccgagatacacaccattaagggtgttgcaagaatgaaataagaatgagatgttaagaattttattgcataaaactagccttaagcatgaccataattggtttctttttctttgattctactgtgtcttcctctctttctctttctccctatctcctgttgagtagaataatagactccagtgccaggttactcagaagactattgcaaggaagattctcaagatcattcttccactggaaaatctcaccctgcagttgccttgccattgattccttggtagaaggcccggttcaaaaatcaagccacattcttttgaggcaaaataattccaaacttcttttttgttgttgttgtttgtttggtattccaaacatctgccagctcccataagagccgtgacaaatattattttgtaggtcactgtagatttccttcaccacaaaatgctgagatttggaataattagagcccagggggcaaatgggcctgcttctgtcctttctctgatgggtttcactcatgtctgccagctgcagctgtctgattgtatacgcttgtgggcaggggcagggcctcttagcccagacagagttaattagtatgagttaaactctttctaggagctaaggctgtctttataaggcaaaagtaaggaactttctttatatcctctaaagggtcattaataagtagttaacaccctgagagtgaattactcagaaattgatgttagatcgacttatatagcaaagtatagaattgagttagttacccaaatcgctgaagccaaaagaagtgcattgtctgttttctgggtattttaggccacaacattagggacagcatagccttcatgttctagtggtttgggttttggtttttaattaaatggtcccttccttattataggtttgaagtgattggcactttttttgatagtggttatgagggaaggttctagaatcagtcagacatcaagttatatcttagtgctgccacttgcaagttgtgtcaccttgggcaagtcaatctcttaagccttagtttcttcatctgcaaaatgggcataatcatgtctacatcagaacattattagtaagagccaatgagattatgtatgtaaaagcactcattcctgcctggcacatagctagggcttgataaatggtatctattcgtgtattattattattattatggatgttattattgttagccttatcattttcactacatactgagaataatttcattctttttgcttgtttgtttgtttgtctgtttgtttgttttttgagatggagtctcgctctgtcgcccaggctggagtgcagtggcgtgatcacggctcactgcaagctctgtctcccgagttcacgccattctcctgcctcagcctcccgattagctgggactgcaggcactcgccaccatgcctggctaattttttgtattttttagtagagacggggtttcactgtgttagccaggatggtctcaatctcctgacctcgtgatccgcccgcctcggcctcccaaagtgctgggattacaggcatgagccaccgcgcctggcccattctgtttttttttaaacagttgtattgaggtataacttacccaccacaaaatagactcatattcattacagttttgactgatggaaaagaaaggatggttcaactctctaagcctctccctaatgaaacacacagctcccctgatttctctccttccactgtcttatggcaggcactttccaagctctggttgtatcttttgttggtttcaattccttttttcaccactcactagctttgtgacttcaaataattcacataacctcagcaatcctatttccctcaaatgaaaatgaaggtaagaatttaccctacttgattcacagggttgttatgaagctccattgtaataatatatgtgaaatctctttgtaaatggtctgctgggttactataattcacaaatatgagtttcaataatattcaaatgtcatattgtgtgcttcagacattagatgccttgagagatccagattgtggctggagttatttagagaatgcttcgtggaggaaaggcggcataagctgaaccttcaagatcagataggacctcaatgggtggaaaagagtcagggagtgggcagtctcggtggagggattaaaaaaaagcaaaaccacagaggctggaacaaacagataagcacaaaagtgatttaaaatgtaggcggtggccgggcgccatggctcacgcctgtaatcccagcactttgggaagatggggcaggcggatcaattgaggtcaggagtttgagagcagcctggtcaacatggtgaaaccccatctctacttaaaaaaaaaaaatagccaggcgtggtggcaggcgcctgtagtcccagctacttgggaggctgaggcacgagaattgcttgaacccaggaggcagaggttgcagtgagcagagctcgcaccatgcactccagcctgggcaacagagtgagactcagtctctaaataaataaatgtgggagggaataaagttaccagggcagtataatagatgggtccccttctgaagcaactgggggaaaagattaaatgagatagcatggactccttcctttcaggaaagataatatcttattcatctaggaatattagctccatctaggcagggaccttgtccatgttctctgatccctctctaacacatattacaattcctggcacatagtaggtgctcagtaaatggtcaacaaataaaagaatggatggatggatggatggacggatggatggatggatggatggatagatcataatgtcagctgctgtacttgtctggctgttttaacattattcaaaatcattggtcactggagcggggactgtcttaaaactccctctatgtagtacagccccgtctgctgttgggatttatgaaattcttgtcaatgatgccaatactcagtgtggtttttctccaccctgttctagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggtaagaccctacatcttaacattcctgctaggccctactcaaatacaagagcttcctctgtacttgtactttcatttgtgcctgcactgtaaggtgtttgaataaaacatgacttgcattaaatcataagcctccttgacaatccaaactccctgatcttcacccaccctgaacaactctgttgaagggctcaggcccaatcatatcccagtcttaaagctgtaggactgcttaaatgggcaaaggtgagctgtttgtgttgatcggcgctccttttcataataattataccaccaaagcctccatctgaaggactcacaattatttgaagctttgggaatgctatgggtggaaaagtcactttgactatctagggccactcactccaattaacaagaaaatgagttgtctgttagttcccatatctgaagtattttactaaccagttaattcctagtgccctgcaatgagaaaactctctataaatgcttggtcatgatgactaccaggacattacttgtcagaagaactgcatttactttacaaacaacgtatactaattacatcttatctaatatgcagtccggagaatataatcaatagaactagaaaatggagtaaaatgagtgtttaaactgaagcaggaaggaatgaagttagatgtagtaacaacttttctgcctgcaagtggcattaagcactggattgtcaagggaagctatagaatctcttccctttaggacttttagtaagaatatagtatctcagtagtttaggagaattttcgtgtggccttgctttcttaatggccttccaggaatcattctagccccaaaagaatgtgcttctaagaactaagaacaaggtttaaggaataacatttgaaagatagaaatttaggaaatcaggattattgcaaagacagatgtaaccagcaagtaaattttatcctctcccttgccttgtgctagactgagctgtggccatcagatcatcttgtatagttttgtattaccccagagagcttgttcctttggtttggaagggagagtctagtgaatattacaaatggaagctatgaaataaatcttcattcctttaaacccccaatccagctgggggaccaagggtaccatgaacagagaagaaagaaacaagactataattcatggttcagaggctcatggcatccctgacagactactttgtaccaccttagaccatgatgctcgactaggattgctaacttttctgtggcttagtctctggcatggaggaattgtaggagaaaaaaaataatgcgtaataaaatgtaggaagtaccgagaactgacgatgggagagctggggggaaggacatgccgtgttttgagtccctgctctatttcaggtattaagtgaagcctttacacttatcctagatgcttctaatcttaattctgtttctccttggcaggagggaaacgtgtattgtggtctcaagacttgccccaaattaacctgtgccttcccagtctctgttccagattcctgctgccgggtatgcagaggtaggtgtgttatatcccaagacccctgggtgctgctatcctgtgtagtagaatttagaaaggaggaaaatacctgtctaatgtcctagggaaaggtaatttttatggtagccttagtttttaaaggtggtttaattaacaaagggaaaaataaataaagcattgattttaaaggccacagcctttaaaaaaaaaaaaaaaactacaggatggagtgctgtgcttcaggggaggatgggaaagagtcatcaaatgtgaaagtgaatatatttatttctccatccttaatcccttctagcttggcccttaaattattgtatcataaaacacagactattttcattcatagccttagaaggaagaatggaccttgcaaggaattgatgtggccattttgaagactgtgcagggcaaatttaggtatactttttaaaccccataataagatggtgacaaactcaataaaagcaaaacagaaagcattttctcaaattatattcaaaattgaattgtcttctcacattagtctttttttctttaggttttattttttttataatggcaccagttttttcgctaggttcctgggatcaagtgtaatcccctttaatttctcctttgttacctcttctcagattaccaaatctttcagcagttatctgtatctctcccttttcccactttcccactggcaatatccttattttgtcctttttccttctatccagtcaacatattttttgaccatctactgtatgctcagcattgtgctagaattggggtatttatattgataaatacagtagatatatagggtggtgctagaccatatggcatctttatgtgagttacaaaaaggattcccttacataagatactttattgccatttttcagaaaatcccagggaaagcacctttgtagctgtggcatccttttgcagcacacaacctacacaacaatatatatagcatacatagcagccaagatatgttctttgctcttatggaactcaccagaaaagacaaataataagcaaacgtggaaatacagataatgcaagtactatgcagaaaataaacataggactgagattaaaaataagtagtttatttaggttgagttgtcaggaaggcctctctgagaaggtgacatttaagctgagacctgaaagataaaaagaagtcacccatgcaaagatcccaaagaagaacattctaagtagagagaaaagaaagttcaaaggccccaggcagggaagagcttaaagcattcaaagagcctaaggaccagtgtagctgaaatgtagtgattgtggttgaaactgacatgggatgaggctgaagaggtaactaggaattagaccatgcaggattctgaaggccatgggaaggattttggatttccatttttaatacattgggaagctattggaaggttgtgagaaagagtatgaagtgatccaattaacatattaaaagatctcactggctattatttccagactagactggagggaggcaataatgcaagtggagagactagcaagatggttagggtagtactctttccagtgtgagaaaaagggtgcttggactgagaacacagtagtggttcagagtggagcctttggagccaaactgccttggttctaatcccagccttgctactttgtagttgaatgaccttattcaacctttctaccaatctttaaagtgaggataatgttagctcctaccttcaagatgtttgtgagatttcaatgagataatataagagaaggacctggcacagtgtcttgtatatactgaggacccaataattaaaagtggacaaatttgaaatacatttggagccgtggttctcaactatgggtgcatattggaattaccttggtagatttataccagatcagaaggaggaggatgtgattccaatatgcagctaaggttgtgaaccactgagttagaggaaaaaaattataggatttgctggtgggggatgtgtaggtgacttctatacattactgccattttaatcttccaaaaagcaatccatcaccgtgttacacccctgttcaaaaatttttatgccaacatgtatttggacttactatatgtcagtcccagttctaactaagcattttacagatatgaactcacttaatctcatgacaaccctatgtgaggagtactattgttctccctgttttatggatgaggaaactgaggcagagagcggttaagaatcttatccaaggtcaggtagctagtgagttgaggagctaagatttgaatcctggcagcctggctccatatttcaggctctaaccacagtgttctgccactgaaagggatgactccctgtcgccactcaaatacatgtcaacccccgactctgatagtgaaggcctttcatggtctaacctcaagttacctttataggtcaatattcttccattcatgcacctcagggcccactgcattgttcctgtgctctcttacctttttacctttgctcagtcctcttcctgtcagtgtttctcacactttagtgtgcttcagaattgctcagagaacttgttgaagttcagattcctggatcacacctgcagagattctgatttagtggccttggagtgggacccaggaatctgcatttaagcagaccccatcgttcattctgatgcagaatggtggtctgtggactgtcactttgagaaaccattcctgagaccatgtagataacctggaaccaaggatttgttttaaaaaatctgagtttagtgcacttaaattgagcacattaaaattctgaaacctgagtgaaccagtggaaaagcaaccaatttcagttcctgattggttaaagcatctaagtccgaccatatggcaaccaatttgagatgaatgagtggtggccatttcatgataaggaactgggatgaaaaggagacaaaagggctgtctaagtaacaactgcacatgtacaggttggatggagaaaatgtttcctctttctggaaaattctttttctccatccctgcctgtggaagtcctgctagtccttcaagacctagcacaaatgcagcttcctcagattctattgcaggccgtcctcaggtcgcattttgataagtagtagttggaaggcctttcttttctgccttcccacttccatccctaatttctccacccataaatcctgcttatccttcaaaatccagcctaattgccacttcttccatgaaatgtttttaaatcctgcaaactagaagtaaacctgtctctactctaggactcctcagcacttaacctgtgcttcttctggagcatttatcaccttgtcaacttctgttttttattatttgtgcccatgtattatcatccctattaatgcataagctcttcaagacagatactctttttcatttatctttatttctcccactgtgccaggcagagtaggtgctctttaaatgaatgcacactagattggaatgattactagaaatttagtcaggatttgaattaggtgctaccaaaaaagaatatggttgttgtgcatttttccccctgaattactgattgactgtggtagatggtgttgactatacattgattcctcgtcaataggaaattacttggtctcattcctgatctccaagttgttttcttcccctataccactttaggaaactacagttaacattgctttttggaaggactgagcttgtttggactaccagtgtatgctcatcccttttaatatgctatttgcatcagccctcataagtcaatatggatttagttacagcctaatttgatttatgctttggtaaggccctggatctttccatacatgtttctcacaatgtgtgtgtgtatatgtctgtactacagtgtagctgttacatttcagtcaagaaagatggatattttgttcctcacctcctttcttgtcttggccccaacttaatttcagtgtggctcaaaagaaagtccatactgagcagaggtgtacatgtggttgctaatataaccagttggtcactataatccagctgttaggctgatattattccctttggggaaaaggatatgtgaaatctaaactggaaaacaattgataatagaaaggaaaggcaacagtgaaaagacatgtcactgcaacctaggggcaatacggtataatgcaaaggacagaggctctgaagccagaaggtcatagatttgacattgcagggctaccacctacgagtgctgttatcttggacaaactatttaaccactcaaaaccttggttttctcaggtgtaaaaatggagattatgcttactacgtatgaaatgggttgtgtagattaactgagatggcgtagagtgctaggagatggcctaatacagagttattggtttataagtaacaattactatattttatatagtaattactatatttattacccccgagttaagtatcattgcaccttctcctctatctttgatagttttgcctttttaaaatgtaatctccatagacagaactttagttctagttcttcttgtggtaacagatcctggaactagctattttatgtactgttctatcgttacaatttaaatttcttttcttttttatgtcctcagaagcaacagataaaagctagttattactggccatgtattgtccctttatatacttgataattcattaagttctttctttgcaacctctcatccagcctaaatgcacaattttctttcatcttcctttataaagactaaatcctacacttttgtaaaaattgttgttctttcattgcctccagtttctttgcatctttcagctgtatataatgtggttgaaactcctttgaagttctaacttttgaagcacctagttattttttcccatggaaatgacgtttttacaatactgtatcttatataagcgtattactcatacagcagggaacccagaaacctctcccctatgctggccaccctgactgcaggccaaatactgaagaagaaataatcttttgactgctgaacttgcaaaccttcatataaagggcattgaaatagcctctctgcactgtccccaaacactaatgtgtgtctttcttcctgggtcagacagcaatcctagacgcggattgaatctcagacctagccttcattggctagacgtgtctttgaggctgggacagtcaaggagagcgttggcagaatgtgtgtcattgctagcacttcagcaaacctcattaggactggaagcatagtgcaaacagccactggaaccttaagggaaattttatcagaagaaaaaatctcttcagatcctgtgttagtttgctaaggatgatagcctccaactccatctatcttcctgcaaaagacatgctctcattcatttttatggctgcatagtattccatggtgtatatataccacattttctttatccagtctgtcattgatgggcatttaggttgattctgtgtcttcagaattgtgaatactgctgcaatgaacatttgcgtgcatgtgtctttttttttccccaaatactgcatgttctcacttataagtgggagctaaatgatgagaacttacgaacacaaagaaggaagtaacagacactggggtcttcttgaggatggagggtgagaggagggagagaagcaggaaagaatctgtacaacaaaccctcatgacaggagtttacctatgtaacagactttcataggtatcctcaaacctaaaataaaagtttttttttttttaaatctcttcagagattatactactgccacattctgggaaggcaggcttcaaacccaaacccacacccagcttccctccaccattgatcatttccacttcctgtcccctgctcatcttgccaaaacaacagggaaggctatgtacttggactctagacaagggaaaggtatttggggtaggtattaactgtattgaaagccaagtatgcatttagtaaatggtgtctaaatgtagcacgtacaatgtgccagacaatgttctaagcacttatgtgtggaatagctcatttgatcctggcaaaaatagtagcaactatttatatccccattctacagatgcggaagctaaggcagaaaagttgagtgatttgtccaaggacaaatggtagtaagtggcagagctagaattttaacctggtcagtctggcttcagagtttcaagctcttaacttctatactacctgttgggacccattcataggagtatgacaaggatatctcctagtacaggggagtaaaggggaagacgggacatgcatggcacattgttgtgtgcagatactcctaagagagtatcttaccacactgcccatgttttcccatcaaggccttaacttacccttctctcactctaggcttaaagtgtcttgagtgtaaatgtctactttctttcattcagcaaacattgttaagcaatcactaagagcctggcactgcaccagtgctagagatacaatggtgaacaaaaatggacatggaacctgccttcatggagttttagtagggaagatagacaccacgtcatgatataagtaattataaaattgcaactgtgccacatgccacaaaggaaagttgttataaaagccaataattgagaggggttgacctagtcagggaggtgaaggaagacttctgagactgtctctccagcctcaactcgcaccacatccctccttgttctctgcactccagggtgaggaaagattggctcaaaaattagggagataactggtggcagtcatacactcctgggatccccaacttctgatcccaccatgaatccagtccctccccaggctgtaggggtctataatgttctttctacattatacatgctacataataccctaatctaggaattttcttttactcttctttcttttggctgtttcctgtttttcagagacagggtctcactctgtcatccaggctgtagtgcactggcacaattatagctcactgcagcctcaaactacaagctacccttctgtctcagcctcctgagtagctgggactacaggcgtgcaccaccgtgcccaaccaatttttttttttttttagagacatggtctcgctatgttgcccaggttggtctcaaactcctggtcacaaatgattctcctgcctcggcctcccaaagtgctgggattacagacatgagcccagcctaggaattttctttttgagaaactacttgatcatgctaccatttcttaccatattatccaatctgaatttttcagcttgtttttaaagaccctctgtgaaacagtctgatccttccttaacctactttccagcctcatttctctgacaccaacacacacatctcctttaggctggctggctgatctctttgttctgttacatgctatgtttcttcctaccttccctcctgttatgtgcttcacttaaactgttatttttcacaagcttggaatagcccccgctcctcttctacctattcgcatcctactcatctttcaagggtccagttgaagttgcacctcttctaatagttttgcccaatcactctagttctcattgatcttctttgaccaccttcaggacttaatctggttcaaaaataagcattcagaaatatattcttgcactgttattgctttgtgtcttcctgtttcccctggcataacataatattaatcatatatcatgctgactggtttatttaatacaaaaagagccacagtcacaaaaagctcttgacagcattccaagtacagatgcagtagggaggcaggagaaatggtggaacttacaatttgctcaacccaagcccgttcatccaacatatctcaaatgagcccagggagaaaatggaagtcactttttatgaaattttgatatttctgctaactccttcaaggtaaatgaaactggaagcaattgtttaaaagtatattagtcagtgttcaagataagtgccattttacctaagacacttgatttctctttccgaaagagcagcaaaattgcacctcagatcccatctcagctagaatccgggatcttcagggaagtggtatgtgagatacttcattgattttaaacatcataaaaattgaccagtttttcaaagttttcaaaatcaaagaaaactgaagaaaataacagcaaatccaaatatagattctcacaaattagtctcaagttgtttatgttttggcccacattttctgcagaaacaccaccatctcctggtcatgatgataggaaagaaacattgttaatgagaaacactactttaaaaaatgaaaattcatcttgtataactgaaaccttatgcctgttgattagcagctccccacttccccctccaaggtgaacaagttctaaagatctgcagtacaacattgtgtgtgtatagttaaccatatagtattgtatacttaagtttgttaaaagggtaaatctcgttaagtgtccttaccacaataaaataaaaaaaattaaaattaactcagtaatttttgagtttatacattctcacctaaacttcaaaatacagtccgccctctatattcactggttgcacatccatggattcaaccaactgcagatagaaaataatttttaaaaacacgttaaaagtaacagtacaacaatctaaaaattacaaattttagaaaccaatatagtaaaatgactatttacatagcatttacattgtattaagttttataagtaatctagagattatttaaagtatatgggagtatgtgtgtaagttatatgcaaacactatgccattttttatcagggacttgagcatctgtggattttggcatctgtggggggtcgtggaaccaattccgcatagatactgagggacgactgtgtattgatatactctgatattttcatagctatagaagagtctcgctgtcattaataataccttttcaaaagtgaatcatttatgttcatgtgtatgggaccattttagagatttgccatcctcacctacctctcctcatctaaatcccaactggatctccttccatggaaatgttccagattgtttttgctttctctccatctcttgtgctcaaaattcatccccacgtacttgctgactgtcccaggaccccgtccctctaaggtcatcatgttccttcttggcatgtttcttacgtctagaatatttcttcttgaatagaaagtcattcagacagtggatgggacagcgttgactttcacattgagtttaacaaattaatagcactgattcctaatcggccatctgggttgtcctgtcagggtcagtaataccccattctgtttctgggattggaggacttttttgtgtgtatatgaatctgtttctataataaaaataaggaattcccagtgaagcatttcagagcaattatttcttcatgggtggttaaagccactctttcttcaaccttattctttctaactccttcaaggaattccatagctgcccagaaacaccattggatgtgcccattactcacattataatagtctttatgagcttagactccaacaatttatagaaatcaacctggtttgttgactgacagtgcaaacagaggtaaaagatacatgagaaggaagagcagtgtatacaactgactgcttttcattttcaggttgaccagacagtcagcatgggtaggtcattgagtttctcctctctgtcctgctttttattttcagttcatggatgtggtagcacagaactctactttatttggatacttggatttttttttttaagacagagtctctgttgcccaggctggagtgcagtggcatgacctcagctcactgcaacctctgcctcctgggttcaagtgatcctcccgcctcagcctcccaagtagctcagactacaggcgctcaccacatctggctaacttttgtatttttagtagagacggggtttcccgatgttgtctaggctggtctcaaactccttacctcagatgatctacccgcctcagcctcccaaagtgctgagattacaggcatgagtcaccgcgctcagtgggcacttggatttttaagacttcactttataactttgtaaattgtactcctaccaatgaagcagatatctttcctgtcaagcctcatttttagccaagagagaaaagagattttaattaagatgcaaactcttttttaaaaaattggaaatagaggactagcataattatgagaaattctaagccagtttagaaggtgtgagccgaagaaatctctctagccatttttaaaaatatctccaggaccctgtcttccaatgatttagagatgaaatgattccttttcaatgtgcaggcatgcagttatctttgctaggctttgtttgcttgtttgtttgtttgtttgtttgatccaagcccttttctttgttaaatacacagcacacttgtgggagtcccttaagccgggtattcccccatgtgtaagctacccttgaggagaaggaggaaaaagaagtggaggcaaagaatgggaagaaaggggattaggaatagcagctaacatttagctgacacagtgtgccaagcacaattctaaatgctttgcatatactaattcatttaatcttcacaaccctataaggtaggcattattgtctccattttagcaataaggaaactgaggcacagagaagttaattcatttgcccaaagtcacataagtaggaaggagcagagccagaatttgaatccaaactgtttggctccaatctgttctcttagccattatattatactgcctctcaacttggggaagcaaagcaaatttgggaactcttatttctgaggctaccgggaggaacagactgtgtgatgaccatctttccaggggccagatatggtaacaatccagcagatgcattgggactgctctgagaagcaaagattctgtttctcaccataaacttggatctgtttagccacatctccattgaaagagcagagtgtggatggtgggtaccatccagctcgtagtttctgtattcactctcttctgatttcctcctggaaacgcatgcattctcacaatgcactttttaaaaagtaagtatttatgatttttctggacaaataattttgtactcttcttcagatttggcttgctactgttggcaggaattccccccgttgtgtgtgttttggtatttctcaaggagctattttgttaaaaatactaagatcttatattgacagcccaaacaataaagtacttcatttgacaaagaagtattttttaagaaaataactgtctgatcctttttatggctgtatagtattccatggtgtatatgtgtcacattttctttatcccatctatcattgatgggcatttgggttggttccaagtcttgctattgtgaatggtgctgcaataaacataccggtgcatgtgtctttatagtagcatgatttataatcctttgggtatatactcagtaatgggattgctaggtcaaatggtatttctggttctagatccttgagaaatcaccgcactgtcttccacaatggttgaactaatttacactcccaccaagagtgtaaaagtgttccaatttctcatcctttccagcatctgttgtttcctgactttttaaggatcaccattctaactggcatgagatggtatctcattgtggttttgatttgcacttctctaatgaccagtgatgatgagctctttttcatatgtttgtgggccatataaatgtcttcttttgagaagtgtctgttcatatcctttgctcactttttgatggggttggtttttttttcttgtaaatttgtttaagttctttgtaggttctggatattagctctttgtcagatagatagattgcacaaattttctcccattctgtaggttgcctgtgcactctgatgatagtttcttttgctgtgaagaagctcgttagtttaattagatcccatttgtctagtttggcttttgttgccattgcttttggtgttttagtcatggagtctttgcccatgcctatgccctgaatggtgttgcctaggttttcttctagggtttttatggttttaggtcttacgtttaagcctttaatccatcttgagttaattcttgcatgaggtgtaaggaaggggtccagtttcatttttctgcatatggctagccaggttttcccaacaccatttattaaatagggaatcttttcctccattgcttgtttttctcaggtttgtcaaagatcagatggttacagataagtggcattatttctgaggcctctgttctgttccattggtctatatatctgttttggtaccagtaccatgctgttttggttactgtagccttgtagtatagtttgaagtcagatagtgtgatgcctccagctttgttccttttgcttaggattgtcctggctatatgggctcttttttggttccatttgaaatttaaagtagttttttctaattttgtgctttataaaacttgcagatttcttgtattgttgtatatcatcattggaagctcaaatgcctatcagtggagaatccttatactagtttccttttaaagcttctctcaaatttcagcacacttgctccctcccagcagaatttatagaattagatgtttggcagaggctccctaaagtcatctgcttctactcacttcttcatctctagcttcggtatggagcactggcattaaagtgctcccccatggaacccagctcatggtaaggagagacttcacaatgggtttattcctccctgctctcttccactttgccctgattctgctcatttcaacttctgcctcaaaaaatacagagaacatttcccctgtctcagggatttgtctcatgtccctttgccttatgattagagtgactatgtaatttactatctcaaccgaggcacattttgaaagcaagagctgcaatcttaataattatgcctgccagaaaaacaggcaataaaactgagttgtctgagataaatctgctctatggctaccctatttatgatgtatggttcaaaagtggccacatgctggcatagttttgctctctgaggcttatcttcatgggtatctcggaatctcattgtacacttagtccttttgagaggacagtttacctctctgacctgctcaagccaccagagattaatggaagccacaggagttataaacagtctgaatttcagcctagcttttggccatttttcaaatacttgttctccctttctcccactactagaaagccaacccattacagcttcatagggtaccactcagagagagtatgactgaggtttgaataaacaatacatgtggcttttagggttaaatgaatattgtttgacatacagtacactacacttgtttttatttcagttcaaaaaattggttaaaattatatcttgttgcttctcaaaattaattagaatccatctgaatccattagaatctctgttttttgttttgttttgttttttacaaaaagacttggctgaatgaaaaagcctccatctcattcagataatctttccagtgatcagacaaaaagagcaaagaaacaggttttttagggtattggtgcctactttttttcaaagtatgatatctaaggttgcaaatggacatacctattttcagctatccagacagactgtacccaggtctagagaaccacttatagccttataaaatgtcaacatctaagaagataattccagtttaattatgggttaaattaaatagaataattcaaatgttaaaacgtttagcagctacttaatagacttaatagaacattgaagtttagagaatgcaattttgatgactttgaaagctcagaggcaccagaaatgctaacagttcctagtatttatatatttaatgtatataatttataatgtacatagtatatcttatatataaatatagtgtatatatacatatatgtgtgtatttatatacaggttaaatatcccttgtccaaaatgcttgggactggaagtatttcagatttccgatgtttttggattttggaatatttgcattgtacttaccagttgagcatctctaatccaaaaaccccaaatccaaaaatgctccagtgagaatttcctttgagcatcatcagcactcaaaaacttctggagcattttagactaggaatactaaaacctgtatgatatatataacatacagttttagtatgatatagatgatatatatatatatatcatacagttttagtatgatatagatgatatatatatgtaatacaggtttagtattcccccattacttgtttttgtcaggtttgtcaaagatcagatggtatatatatgtgtctgtgtgtatatatatatgtgtgtgtgtatatatatatatgtgtatatatatgtgtgtatatatatatgtgtgtgtgtatatatatatatatatatatatagtctccattactttttaatgaagtgctgaaatttaggtatgcattcttgtctgcaaatgctcatcaaatacacatcacgacacactcatctgatttgtgttacagggtattagtattcttctcctatgcctgatagtgacttgcctccttgattttccatcttacctctctgctcatttgtaagaggcgctatgtgcttctataatgctttgagattctgactggactataagtatttaatgacactctttaattaaaatccttttaaaaactctagggtataaattaaataaactgaacttttcagaaggccagctaagtaaacattttatgtcaataccaatcattaaatctacattttaaaaggacatttgatgaagagaactagtctatcatttttcttttgcaacttgttttctcccttttgactacttaaattaggcttgaaaccacattatatagcttttacattttgttttgccatttgctggtaaatctttactggtttctattcgtctctctagtcccatattttatttggcccagacccactactgcccactgaaacaagggggacaagtaaatctaagctcatccctgctcaatcactgtccccagctctccagatttgcaacccaagagttgtcagatactgatttcccctttgccttccttccccatcatcaaatcttccttcagggtcttatcagtttcttttcatctgtaggagtctcattcaatccttcttgtgtgttattgcacagatgctcatggcctattacatattactatagcagcttcctgtatggcctcctgcattcgagttactccccaactagtctataccccattgccagaataggcttccacaaatatcagttttatcataggaacccctacagaaaaattggcaacataatcaaatgtgaattcttcagccttttacaaaattttatatttttttgaatttttactgtttactttttacaatttaattattttcttaaaattgtgtgggtacataataggcatatatatttatgaggtacatgatatgttttgatacaggcatgcaatatgaaatgaacacatcatggagaatagggtatcgatcccctcaagcatttatcttttaagttacaaatgatccaattacactctttaagttattttaaaatgtacaagtaagttattattgactatagtcaccctattgtgctatcaaatagtagcacattatttactacccctatttacctcaacaacacaccccactgtcattctccctccctccttcgctctccctctcctccctttctctctacaagttcaattaccagcgtaatttctcttgttttcatatctgaagtttctactcaagccacaccttgcttgctgtctccagtatgtgacttgctgtttacaaagctctggtcctttgccaatgtcactccctttggttgaggtactctctgcccttatcactgtcggtttatgctgtgcagtatctacttctaaaaatgtgacttaatggttctttcaggaagctttctacgattacatctgactgctcactcatcccattcagtgtctcctaagcatgtgtatttcatttgtatttgctttttttgtgtgtttttaggctgtttcctatattgatttcccatcacctccaacctgggtgtaaatatcctgagggcaagagcccagcctgattttctcctctttctgctgtagtatcaggctcttcacccaagaagtgttcaaagcatgttaactgactcttgggcataattttctagttataaacatagttgaaatcatctttgttttacagtagtcagtcagggtttccacagagttcagcttgcagtctacaatctttactcagacatggaataaaacaggcagaaaagagtatatatactattgaccaagcacttaattctgtatgttttactgcagttcaattcaatacatatattgagcacctgatgtgtacgcagcaatatgctaagtgctccagcctggttattcacaaactcctgcatccatcagaatcccctggaaggcttgtcaaaacccaggatcaccagcccccatcctgagtttctgacttagtaggtatgggttgggatctgaaatttggcatttctaacaagtttccaggtaatgctgatactgctagtccaggaagcacattttgagaagcagtggtctaggagatacagaggtggtctaagacataatctctcattccaaggaatttacagactctctagggagacaaggaaggcccagaaaacatttaacagtaataaatattgtacagtgttttagtatttattgattcgacaaatattgaataagtactatgtgcccagcactgccccagatgctggagttacatcagtaaacacaatagacaaaaatccctgctgtcatggggggattctaatatgggaaagcagacaataaacaaaataaataaaatataagaaatataagatagtaataactgctaaggagaaaaagcaaagagcaggcataaatatcagatgggggttggaactatagatagggtggtcagagaaggcctcccagttccatcatttgacaagtatttattgagcgactactatgtatcaggcactgttatagatgatggtgatatagtaacacaggtaatgaacccttttcttatggaatggacatacctatttgggagccaggtaacctagagttttggtgttaattctcacaaactcattattagactctgaatggctacttcccctctcagccatggtttcttcatctgttaaatggagcagttggacaaagttatgcttgacgtcctctatacttctaaaacttcaggatgcttagtcttttaggcaatcagaaatatgtaagagtgtttgaagaagactttgcagaggagagaaaacttaaatggttttcacaggcatgggggagctatggggtgtgggagatggaaggtaatttcagaagaagaataacatgagctacagcacggaagcaacaatgggagtccagtattcagtgaagagcaagtagctcaaagggttcccattgaagagtagctgagatcattgggtaggcagtagggggtgattgtagagagtcttggttgggaacccactgagggttttgatcagggaatgacacgattatacaatcaaagtggtgttttactgttttatgaagattaacctagcaaatagttaaatcctcaaaattcattatttttcatcagataatatttgaattatgaagatttacagtcatactctgttataagtcactgcctgattctaatattgctatcaaactaatttttaggtcgttttcaagcccttaaaagcctatgatactacctaatttcccctaacactactactacatgcttgaactggtaacatgttactctttttgtgtgtgtgtgtgacagggtctggctctgttgcccaggctggaatgcagtagcatcatctcggctcactgcaacctccacctgccaagctcaagcagttcttctacctcagcctcccaagtagctgggactacaggtgcacaccaccatgcccagctagttttcgtattttctgtagagacagggtctccctgtgttgcccaggctggtctcaaactcctgagctcaagtgatctgcctacttcggcctcccagagtgctgggattaaaggcatgacccactgcacccggcgtgttactcttatgaaggcttgagagagtaatcagaatagaaaattcttagtacttacacttttttgtgtttctggttatcttataaaatatatgttgaatattaggtttatcttcagccatatatataatttaaatagtactcatttcaagtgatgcaaacatctctaagacaaggctcttcccattcgcttgcttggtcagaggtaacacaagggcaatattcttggaaatgatcctcttgttttttaatcagttgaggtatatccacagctcttgtgtgtttgttgctctagaggctgaaagtagaatattcttcctataagcagttactttagaagataatgataaggagttctctgtccaaagagtgggtcatgtagacctagagaaaggtgtgtcataagaaattatgacagatcaaatcctcaaaactcattattttaatggtagtttaaacagaagtgaattatgacctgcaaaacacttaactgtcacgaagtaaaatgagcaaaagtgacagtgatggttaaattaggtggaaagtgattattttccttttattttccaaattctgcataatgttgctaggacatctatttagaaagtggcaactttcttcagagttgttttgaaaaatgaggcacacccagagaaatctttcacagccgctttttgaaggacagccacaaaagcaaaaacacttcaagaactttgggatcatagtaccaaaaatgttgctgggtcacaagggtgataactttcccttttatgaatgtatgattttctccttatttctttttaataaacaggagatggagaactgtcatgggaacattctgatggtgatatcttccggcaacctgccaacagagaagcagtaagtgtgaatagctcaaataattcaacactccacagcatcaggccaagctttcctctcctcgtggctactattctagcaaatccaaaaaaaaggcccgatttctaacaccatttttcttcccttttctcaaagtttttaatgtcatcaccaactggaaaccatttaagtacactgtaaaattggtaactggaggcaggaaatgtgcacaaagaaaccatagccccagccctttgtctaggtcagaagttggtactctttcaggatgacttgccaagtctttatgtgttctctaaggaagctaggtcactcctatcctcaacagtgaggaccttctgtagggttgtaggatacaaccatctttttggtgggatttggtaggtacttcagacatgtccacataaactctttcccaagccttaggctctcagtcatacagttggaaaagaggaaaggtagcagtctggattctcctctcttcagcctggtgatgtctcccttctgttctctgcactaatctcagaataagcctcacaagtaggcatctgtctatgtaagtaatagcatcttttgttcttttgtattttgaaggaatttataaaatagcattcctctctaaaaatatatgtctaagaagctttacactacaaatttcttaaaatctgaaaaggagatgttccgattcaaagaatctatcatacaaaatgcacagtggtgaccattgcacataaataggtgttcatcacatccttgtacaaaaaaagtatgcaaggacattcactgcgttgttgttttcataaaaacaaaacaaatggagacaacctaaatgtctactagggacttggtgtgtacatccaattaatgggacactgtgcagttgttaaaagaatacggtacatctaaatgtagtaaagtgaattgagctccaagatatgttaagtaacaaaacaaggtgcagaatgaaattgtacactatcacttctttatgtaaaaattgtatgtgcatgtatataaatgcatataaaccaatctggaaggtcacataccaacatgtcaggtgtgctaatcttaaaggagtagaagtgggcaggaggaaaggtagattttgactttttactttatattttctgtataatttgatgttttcctataagcatcaattagttttgtaataaaatatatttgattttctaaaaccctagaaaaatctcagcaaggattgaatatgaggcaggagtccagggaattacagggcaagcctgaggatattgagcatgtgaggaagatgttgataggggatgcagtagaatgactcatacaaacatcacagtgctgctgaggctgggcttcctggtcatcacatgggccacttctaacttgcatgctcccagcttgccaacacccaacccaaagcttcagcagtgagatggaaccatttctatttgtcttactctctatcagtattattttctgaacactgctgtttctgaatagttgcagaagaattggggaaaggggtttggagaacagtactctggacatctcaaaaaatcagcatcctgcaagagagggtaggcttccctgtttgctggttaatataaaccctgaggaaagattttctccacccaactctatctgctttatagtaagtgagattccttccagagcctgacaggagatgatgtcagtctcagttttctgtgttgtctgttcctctttttctcagcccctattttttattgtggtaggtagttgagagtggctgaattagtggctgtcaaccagatgtcattctaaaccaaatttagagtttagtcaccttaagctatgtgacttattccctgagaggcccccacactaagcactatggccaccttagcagtcttgctggtaatgccatgaattagcctttcttcttgacttcattttacactgccctcaattccagcccttatctttcagcttcattgacaggcctagtgataggcctggacttaatccagtacttcctgtagcaaaaaaggtcgggtacagaatgtgggcccttgaaatagttattgattttcaaaggagttcaagacctatctttagaaacaaacatttgtgcctggtagaccaaaatggccatatggtttcactttattataaataaatatttccctttgttctaaaagggatagatattgtgggatatgatttgaataataaatagcatctgtagtaatggaaaaatatatacctggcacatagtagtcacccaataaataaacattgaatgaatgggtgtgggaggtggcgtaaaatgtgtgtgatggtggagtggggagggggttcctcattaattttaatgcacaggaatttgtctcaaatcagagataaactcttcaaatttgttgtttgctcttgaccagcctaaaatgagaaaataggagaatcccttctgaatatcctttgcaggcccaacttcctcagggcaagaagaaaaggcagccctaacaacagatttcttatccaggagactgtccttttcgtaaactgttcctatttaccgggaaccagcaaaacctctgttcaacagaaatacagctgactggtttcttttgccaggtggtctgaaaaccatcggcttagcaagttttatgaagtgcacaggaagaggaaccagtggttcaaatatgactcctttgtaaaaacctgaaacagtttttgtttgatttctaagttgtaatttctcatgaattggtcctcgtgccattggtggggagtgtgtctgcgtgtgtgtgtgtgtgtgtgtgtgtgtgtgtgtgtgtgtgtgtgtgtgtgtgtgtgtgtgtgtgtggagtggtgtggtatgtggggaggaagaagtaggtgcagactagaaagccaaaacatgaaagcatgcataattttgttttggacaacagccaagccctgatttttgccccctgtagattacgttgaaatttaccattaaaaaaagtgaaagcgtttgggatagaaacgacatgaaacagataaaaatccatgtctcatttgtactgtcagaacaatggtttgggaaggaaattggcctaagtgtcttccagccagagatagtcctaggttggtagtgattaagatacaatgttttaatggctgtatggattagaatatattctgaagccgctttttaaattaaactttttttattttgagataactatagattcacttgcagttgtagcagaaaatacagagagatcccatattccctttgcccagtttccccaaatggtaacatcttgaaaatctatagtacagtatcacaaacatgagggccctttctggaccctgatgttttcttgtctacaccaataaaactcttatattttagactttagaacatgaaattcttgggggtcctctacaatagtggggatttttcaacactggaaaagaactgttttagagccacctctaaagcctgaaatatttttcagtctttcaagtaagtaaatcaaaaaataccaaaatactgagcaaaataaaagatcatagctatatggtcatttctaactggttttgacccgctctctcaagcaggctagttgcagctaatttttaagataagctccaatttcacttacaacttcagggcgttaataacctttttctcctttgctctgagttacaaggtcagaatggcccctcataagtctctttcatttgtttaggggaggaactctaaaagaaccattacccttaaatcaaaatcacacaccaccaccacccactccagcccccaaacagaaaatcctttatgtcagtgattcccaaccttggcttcaaaccagagtctcttggggagtatataaaatcctaatgcccaggccttcccccaaaccacttacataaggatacctcagagcgggacccaggtatgagtattttttacagctcaccgggtgattttagtgtatagccaaagtggagtatgtggtatatgtggttgtgaacattgtagctgaatgaacttttgtatctgaaagaacttctctttgcaccagcttttagtcaaatggttatagaccactgagtttgattggacattctttcttccactttctccttcttctccttctcttcctccttctattcatcttccccctactcctacactcctaccatctccaaaaactcaatcttcattatcaccatgagtaaactgcctctcctccttggcctcagtttctctgtctgtaaaacaaaagacttcaacaagattaggttctgggggactgactggtctacaatagggcctgtgatcaaaattcttgaggattttgttttttcatcatgatcattttcctaccattattatatgtcccaggtctgagacgttggtgctaaagaatggcttttcattttgtgttcaccatcatgagtcagagaacttctcgtacttgcagcttatcctgggtcaacaaccttccctctctaattctatcccagtccaactgcttctttttaggatcagtgggacaccaaccagccaaactgtcctctatgtgttcctttggcaaaactttgccaaacttcaaaaaggacagagcaacctataatggcctttgtggaatgtgagtgattatggcagaaaaggacatatgagccattgtgggaatgagaaatatttgaactgagaatcctatccatgtgcatgaaaacaaactgatgcaaatttttatttgtgtgaattttgatagcaatgcaccaacataggctcttcttagatagaataacattgtctttcaaaaggctaaaaaaggtcctcttacttcagctcctgtttactctccctttcccctaccagtggccccttcctgccaagagggcaataatacttcccaaagtgaaatttgcaacatgcctgtctgtggcccataactttaaacagtgttttatgggatatggtcaggggaccccataactatcttcccaaggttcctcactatttctgtcactgaatataaagaccttccttttcaattgcctgtgaaagagttttttaatgggttccccctccttcacccctaacaattgcctataaaatacaattaatcttacttggctttaagccttaaggttccattcttcattcatttcatcttcttgtacccccagcctactttagctcctgggagaggggtgggtagcacaatagtctggtcatcacgtgtgttgaacccttgctgaaagattacttgtatgacaagactctaagcttttcttaggtaccagagttttgttcactcaacaagtatttgatgaacaccttctagatgcctgacactaaaatctaggcactggagatatagcagtgaacaaaaagtccttgatttcgtagagcttacatgccaatactgtcatgtactatcaattcttctacctataaaatacctagggtatttgtactgcattgtatgatcttatgccattacctgtctttagagtctaagtacatcttatcaagactatactcgaatctcatcttttcctcctatccagttcaccctatgcatgatcaggattcaatgctttgaaacagttctgattacattatttctctaactttaaaaaaaaaaatccctcaaagccttctatgccctcacctctattgcttaccaaataaagtcttcaccccttagcctgtcatttaaagtcttccatgatctggcttcaacccacttttggaatgttattctgcaactgttcccttttatggactcgatgttctcttcttcaccttctcaacttgtaaacctctgcctggactattccacttaacttctgcctgtaaaaaagtctacccatccttcgtggcccaggtcacaagccctccccaactagaagctctctctttctccttctgatttgcacaggactgcttacttcttctgcagcctctattcacattctgccttgcgtgcagactactgtcttaactcttaaactgaaatgtgagagtcttggcagcaggaaggacgctttagcctttttggctcttttctccctgagaagtttgcctgtaaatctagtcctatcttttagaagaagagagataaaccttggcaagttgtcattaaaaaaaaattttaatgaaaaaaatgtcagctgcttgtacatgaccacatccctatttctattggtgtaggtaagcatgcagctgaaatcagagctcaccactataaatcaaaattattgaatgacttctagtatataacttaatctctgtgatctcattggtggcttttggactaaatttgttcttgttattttacagagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaaggtaaggggcatccttcttttgtatacttccacaacaaggcttcagcagccctggtctttgcagggctggagctgggaaaggaccctttctcccaggaatagcccatattcacttgtggctcacttagcatcaagtctgtgggtatagtcaggtgactccaggagactctttggacttccttaaatgcagccaaaagagcatagtccggtcccttttgtaaacagcctcttgtattttctcaattatccctggggattgtaggtcatttgggaaaatttcttgggtctttaacagaatgagtgattgtctgtgttttagtaggggacccaacattcaaaggtactcagtgccaaacatcactgaagctcttatctataccttagaaatagcaattctcacacctcaatgcaccccagattaccctggggctctcgttaaagatacatattcctagccccacactcagattctggttaaatgtgtagcatatgagactatccttagaaacgagtaatccaggtgcagtggctcatgcctcacagcactttgggaggtcgaggcaggaggatcactcgaggccaggggttcaaaccaggctgggcaacataataagactctacaaaaaaaaatttaatgaaaaaatattagccaagtatggtagtgagtgcctgtagtcctagctacttgggaggctaagacaggaggatcacttgagcccaggagttcagggttacagtgagctatgattgtgccattacactccatcctgggggacaaagtaagaccctatctctaaattaaaaattttaaaaaggaaaaagagtaatccagtgagaaatcccaaaaccacctggctgagcaccaggaagactgatcaggttaagactgacatgctgtccacttagttgatcaactggctacagcaggcacccatagacttccatagcttccaatgtcttcttacacagcattttctggcctccacccgccccctgcccccacccccacacacaccagtagcaggagtcagggaggagaaactcaatcaaacaattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaaaaattaaattgcttttgaaatttgcaggcttaaaaaaacattcgaaataaaaccattaatggaaaatggtgatgtagtagaagaattggaaatacttactatcgatctgtgtttgatttgtattttattatttttaagttccaaggatttctgataaaagcttatgaaatcaggaagaaaggtaaagatagcttgattttcaattctaaattgcctccaatagattccatttgctgtgaaagtatttcaaagccttttaaaagtgtagggaaatggattttgaaaatcctaaatcccataatttccacaaggtctctttaatttcagggcagaggctcatcccttgattttctccatgtcctacaaaaaccccagctggtttacatttattcatttgcccccactgatttggatgcaacagttctgttctgacctttctaatatagctcactgaggaatcacttgtccccacccccaactcccaagctggatgattcaaaatcatctcgataatttttggggtaaggagagggctatgtttccctgtccagaattaacttcaccccattccactgcagagtctcatccagtctagactattcctttagtccaaatgttcaggggagatggagcctagctatataacactgggaatcctgcctgccctgctcatcatggatcgttcttttccttacatctcttgctaataatgtggtcctctgatatatctacttggctccttgttagcatcaaataagagaaatgataggaatccaccattttgaacttgaatccagcctaaattttcttgaagcatactgtgtgtccacttgatcacattgtctagaagggaacgttactgtttggggagaaaaaaaaaaaaagaggtaagggcaggagagtgaacagcacatctggcctgtcttgtgtgatcctgtccacagccctgacctcacagttgaggtgtcagctctccattttgtctcattgtaacattgtgagccactccagtttaggttattggaaatctttacgtgggttgaccagttagagtgtccagtattctagcagctcttgcaaaggacaggaaaaggcagctaacattattcttatttcttaatgtgactcagtggacttgatgagaaagaactagcccagtgattcatccttctgaggccattgtcttgcagccaaatcagccaattcctagaaatgcatcaagtgggactatttctccccaacagcccagcctgaagtgatacaacccaccctagagatgttgttgattgggatgccaacaggtttccctgggtgtgatgaggtgatgggaataataagaaacacacccagtcctagtcatgacttgaaatctccacaatgtctcagcactctcaaaaagggagataactcatcctcggacttccccatctgcagccttgtgcagttatcttggagcctagctccatgccttatagtaggagccagatatatttggtgttgatttgcatagaaagatactcctgtggccccttccctttataggcccctcagcctgcatcctagatgcttgctccttttttgggtgggtctggggagggaacagggtctcactctgtcacccaggctggggtgtaatggcgccatcacggcttactgcagcctcgacttcccgggcccaagtgatcctcccacctcagcctcccaagtagctaggactacaggcatgcactaccacacctggcgactttcgtattattatttttgtagagactggggtctccctttgtttgccagctggtcttgaactcttgggctcaaaggatcttcctgcctcggcctcccaaagtgttgggattacaggcaggagccaccacacccagccagatgcttgctcttttaaggtccttcagaagacatggggccaatgacttaacttcccacttaacaaatgtcagactgccaaaggatatctgtgaagcaagcagtgatcagctgtagccaaatatctatagccagtatgaggtgggagactgaggaaattgcctgaaattagaggcataaaaggctatcccttcacaagttacccaggagggcttggtcctttccctctcaatcttgacttatcactttccttcctacaccaaacagtgccgaacaccattaagctccatacttatatatgttggtggatcagacagactcatagcatttgacattctgaatggatttgcttcaggatccggaagaaactgtccctttgggaagagcagtaatttttgcatctagcctccatggaaagcaaatctcccaaggaaattttcatgcctggaagcacatccacttgaggcatacaaattttctatagaactgaaaatattaacattacattctactagagatagaactctgctttcatgcattcatttattctcatatatatatatgagaatatatatatatgtggctgggcgcagtggctcgcgcctgtaatccaagcactttgggaggccgaggcaggcggatcacgaggtcaggagatcgagaccatcctggctaacacagtgaaaccccgtctctactaaaaatccaaaaaaaagttagccgggcgtggtggcgggcacctgtagtcccagctactctggaggctgaggcaggagaatggcgtgaacttgggaggcggagcttgcagtgagccgagatagcgccactgcactccagtctgggcgacagagcgagactccatctcaaaaaaaaaatatatatatatatagatatatatagatatacagatatatagatatatatagatatatagatatatatagatatatagatatatatagatatatagatatatatagatatatagatatatatagatatatagatatatatagatatatagatatatatagatatatagatatatagatatatatagatatatagatatatatagatatatagatatatatagatatatagatatatagatatatatagatatatagatgtatagatatatatagatatatagatatatatagatatatagatatatagatatatatagatatatagatatatatagatatatatatagatatatagatatatagatatatagatatatagatatatagatatatagatgatatatagatatatatagatatatagatatatagatatatagatatatagatatatatagatatatagatatatagatatatagatatatatagatatatagatatatagagatatagagatatatagatagatatatagagatatagatatatagatatatagagatatagatatatagatatatagatatatatagatatatagatatatatagatatatagatatatagatatatatagatatatagatatatataggctgggtgcggtggctcatgcctgtaatctcagcactttaggaggctgaggcaagtggatctcttgagtcttagagtttcagaccagcctgggcaacatagggagaccccatctctacaaaaattaaaaaaaaaaaaaaaagcacggcatggtggtgcatgttagtcccagctactcgggtggctgatgtagaaggattgcctgagcccgggaagtcaaggctacagtgagccacaatcacaccactgcaacctgggtgacagagcaagatccggtcttaaaatatatatatatatatatatatatatatatatatatatatacatatatatatttatggactgcctactatgtctgaggccatttataagcatccagaagctgctgctgaagaatctggagaagctcctgagagtagaatatggcccaagctgttttttggtcacagatactactcggtaaacatagccccatggctatgacaagaacaaaggatgcttgatatgttaagtagttcagggcttgggttctgaatatagggttccattttagctccttagcttttaattgctaattctgcattctctttcagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaaggtgcgttggttggaggccctgcttttggttgactgagattctcacctagtctttctaaactttctttaggcatcagaaacataacctttcatataattgtaatgataatatttctaataataatgaatttcattctctcttctcttgaaagactgaaaaggcagttgcttggaagaaatttactacccagaaatatgcttgtgtctaccacacctctcatgtatccctgagtgttgaacttacctatgcttttctaaatagtagagaatttaggctatcatgatgataaggaagaatagtagcagctttcatttatatcactattaaacccatcaaagtacaatcacatccattgcccttttaagacaggacgagaggcaggtgagttatagtggaaggagaccaggttctgatccaagcctaagatgttgagtgatcttggaaatgtgccatatccattctgagcctcatcagccttatctgtacaattgaaagtttagaaaaattatctctaagctcccttctaacactataatcctataattatattattatttattttttaaagataagaaaattgaagtacaaaaatcaaaggacttgcccagattcattcaactaatcaatcataaaaccaaggcctataacccaagtcacttccagcccatcgttttttctatgccagtagaaaatattgactgataaaaaagacaagttaattatttaaatggtagtttttaaaacatgagctaaataaaaatatagtccctaatattggggttgacagaatataggatgggtaatcaagcattctatctctgtcttgccacaggtttcctgtgtgatctataacaagtcacttcacccctctgagcttcagtttccttctttgcagaatgagagggttagagtagattttttggggggcccttacagctccaacattcgaagagtcgatgatttagtcaatcccaggcacatgaatttatcatttcttatgcttctgcaaagcatttttataaacacagatgaaaattcaaacattttaaaaagtaggtagagagctaaattatatacttcttcaacttagtccctcatgactagtaggcaaacatgccctgaatcaatgtgtatttattgagcattttcctgcaggccagtggtactcaaacttgtctgaacattagaaccccttggcgagcttctacatatacctgtgtcccatccccagagactataatttaattgatttgaggtgtggcctgggctgtggcatttttaaaagatccccaggtgaacattgtgtgcagaaaagtttgagaactactgctgtaggcccagggtcatttatggtcttgctactcaaagtgtggtttatggactggcaacagctaggagctggttaaaaatgttgactctcaggcccccactcaagacctactgcatcataatctgcattttaacaagaacctcaggtgattctaatgcacattacagcttgagaagcactgatttatgacacaaaatcttcctcaatgtaacaacccccatcttccagagtacacagggggcagcgtgtggacaggaaggacaggagctatttgataaggtgtagagaactggggcattgaaatttatgagaaaatgtatttattacgaatacagagagaacacattctttttatttttttttttattttttgtttttttgagacagagtctagctctgtcgcccaggctggagtgcagtggcatgatctcggctcactgcaaccttgcaacctccacctcccggttcaagttattctcccgcctcagcctcccgagtagctgggactataggcacgcaccaccacacccagctattcaaactcctgagctcaagtgacccactcgcctcagcctcccaaagtgctgggattacaagcgtgagccactgtatccggccaatggagagagcacattctaaggatgatatggacatccgggccacccagcaacaatgacctattatgacttccaagtctgtggtctcactggatcctcaaaccttttagtatcacatagtggtagtttcatgaacacaattttctcttctgtcaggggtctaacacttaatagtttaaaaagtaatgcaacaagataatttcagacaaaaactaatatttacacaaattacccatgataacataaaccctctcattgtataatattccaatttgaatctcaggccttcagaccaagtcttatttcattgtgtgcttaaaattttattgatgcagatgattcaattaaaaaattaaataatcaaaaagctgtgagaacaagacaaacaacagtcattgcttttaaaacaattgtcctctcaggttggtaatgtttattaaaacatttggtggccgggtgcagtgactcacacctgtaataccagcattttgggtggccaaggcaggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctcaaaaaaaaaaaaaaaaaaaaaattggctaaaaaattccacttctaggaatcctaagaaagtaaccacagacatgcacaaagatatacaaataagaatttttgctgcaatgctgtttacaatactgaaaaattggaaataatctgaaagttcacgaatatgggaatgattaaacaaattatggtgtatctgtaccgtggaatattaatatagccattaaaactcattatagaccaagattgaatggcagagaaagatgtttgcaatgtatttgttaagtaaaaatagcaagctaaagaacaatatgtatattatgatccaactttttgtgttaaaaaagaaagcgttgaccaggtgcggtggcccatgcttgtaatcccagcactttgggagtccgaggcggacagattgcttgagcccaggagttcaagaccagcctggacaacatggcaaaaccatgtctctaccaaaaatacaaaaattagccaggtgtggtggcatgtgcccatagtcccaactactcctacttgggaggctgaggtgggaggatgggttgagcccgggaggtggaggttgcagtgagccaagatcgcgccattgcactctggcctgggcaacagccagaccctgtctcaaaaaaagaaagaaagaaagtgtttatatatgctaagacaaaaaaaagaaacaaaaagactggaggagcatacggcaaaatgttaacagtgaccattttcttgtgactgaattatgggtaactcttattttcttatttatttatttgtattttccaaattttctatagtaaatatgtgttacttttgtatttagaaaacataataaaatttatcatgtaaaaaactgccctccagtatcccagttggcagtatattgaagtctgaatgattaaaccgatttttctggaagagctgcttttcccactttcccactctgctcaagtttgtggagatagacgattgattgagcaacatggaagaagagaatttctgtctcattctgtgtatctgcctctcagtgagccagacatgggtgtctgcatgttgaatcactccttagtcacattgcctgagagtcaatagccacatagccaagggcacctgctccaggtactctgcaactgcagagcatcaggaggcatgcacttgctcatgcattcaatctggaaatttgttttaagtacctactgtgtgcaagacacggttacatgcactgaggacagagatgtgaacaagacaaaggctacttgccagcatgctctttacattctagcagaaaagaaagacagtgaacccaaatcaataaggtaattttagattgtgatgagtgctgtgaagaaaaaccaaacaggatcaagagagagtgaatggggcaggaagcacttttaaaggagtagtcagggaaggcttctctaaagatatttgaatagagtcctgaatgacgtgaaggggtgagaaatgggatgatcatgacattactggcctcttaaaaaatgacacatgacacagaagaaaaggaacaaggcagtgaggagagaagtagatggaaggaagaaagaatggtaaattcagttatgttgaaaagggaaaagagataaataaaattcactgataatccagccaaaagtttcattgtaacaagtgattgcagcctcctacaataacaaactaggaccaatattaaagatgtgagtttcatctctctcttccctttgctctggtagaggctgaccttgctttgcatatcaatggccacctacagggttgggtaagatgtccacttcctgaagattccccaactcacttctcacactgtcgtgccaaactcctattaacctcagtagggaaggcaccagatttaagaggccgaagaaaagatccagagccagcaaacaagacatggggttttattaggggctgacatacaggggagagagtccagtggaggtgggctggacaggagaaccaccttacatatagaaacagtccagtggcagcaggttgggcaggaaaactgcaaccacttgcaaacatcatgcagtttatatagcattttcactgaacactctccccttaacgacctggcaaccttcatctaacccaaaactcaaggcctctatcccctgtgcagccccagggatgagcctggggttcagatggtcctcacagacaaggaaataatctcccagttggccacgcctggattcccaagctcagaacacacattcagatacgtctgccatacagggtcattctaagggtacacttaagttattgctatcatgagcatttactgtacatacaaccacaataccatcccaataccttgaatttccataattacatactccttttaggttatggcattaaaagtccctattaagacttaaaagttgtcccagctggaataatacttctccttcattaccacttctgcaaggaattctggaaggctcaggatgggaacattctcttgggctgtggaaatggccagaaatgacatcaagcacattgtcttccccaaaagaaaatgagagtaggtgaactatagtgatcagaaagcaccttgaagtgcagagtgtgaaaaacggcggatgttgctaagtaggtagttctaaagacaaactttgcttttcttagcattttcaagtaccagccagagttaagtcaataatgagttttgttgtttgtagatcccttcggtcaagtaaattaagctcttgtagggaaggaggtagtggtgcaagatgactcttcaggctactggaagaacttttagcatattacaggtactgccagtgccatcatggatttcatgtcagctatagctgtagccaatattaagctggtgagcaaagtttgagaaatgaatttggctgtcattctaaaggtgataattgaatacacagaagtctctgtacactcagtgacctcttccctctctccaacccatttaaaaagtgctagcacgtggcccttaattacctatcaccaaaaagactggcccaccaagtaaataaatagctaaaaagaaggacaaaaggaggaaaacaaaaagcttgattccacaataatccacaaattgagtaattcagtctggaatcaagagaagactatggttttgtccttacaatgccaaatggtggtgggggtgggaaagctaatcaggttaccaagagacatacaatagcaatttgattacaacttctagtccaaatgtgtctgattggctaacagtgagtctccctaattagagtcacagatccaaagcactcaacactcagtggtttcatcctcaacaattcagatattcttacagatggcttctgttgttctgatttgagtgtatgctttaagtacgcagttcaagagagtactgattacaaggccagcaagcaaacttaactcactgataaccaacaagaagaaactttttaaaacaggggactgaggaaagaggagggagggtggagtgaaatgtagagcttgtgcctttatgcctgcgagctgaaattcaacagtttagtttacacattaaatgatccatcgctgagggacttgaccaattttttgtgtctcccaaccattcatttggcatagcatacatatggctaatctgacatctagattttggcactggtgctgatccggtattattgttccccttacaaacaaatcaaagagcattcagaaatgtcaagccaatttggatggatcctttgggcaagtatatgcacataaatgagtgtcatgaatgttttctaagtataccaaaatgatgtcaggggatgttaaccaaggccctttttcagcccattccctgggcctctcctggcaacactgagctggacagagcatgatcctgaccctgtatggaaattcctatgttctcttaagtgcctaggagatttgtacctggctacatttttcctcatgaaagtccacttctcagtgacagtagtaggggtctagtgttccgaagaactatggattctgtcaacacatggacttcaatcaaagttacgtgctcctttgtgatttgtggcttaatctgtggcttgttgcagtggcagcctaagctgggctaatgaagtatgggtggaatttctgtctctcgaagaatgttcttgttaattgtccacttttgataagtgtgagatgttatgaacaatgagatacataaatgcagaagttcacttctagctttagaaaaccatgacaaaattctacttgcttcctgattccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggtgagcaagacaacattaatttctcatctttgtaagggggcacagaaaaggatgagaggactcactttaattttgcttcaacctgttccctcatttggattaaaagttctttttgattgcttagaaactgacatatctaacactattgtcattatggcctttcaaatttaacgatggcctgtgctaaagatcaagtactgacccttgggtttccaaagctgcctatttcacaccaccaaaagctggagaagcggttctcaaccctggctgcccatcagaatcatcagggagagttttggtttcctttaaataccaaatatctgggccctacccccagagattctgattagttggtctggagtggggcatgggcatcagtgtttgttcataatgcttctcaggtgattgtaatatgtagccaggattacaaactgtcaaactgtagtctgtcattctttccagaataaagctcaacaaccatgaaaacccattcattcagggcaaagctaagtccctaatatcacgatgtgtcttctggggtaaaacaaatttaaaacatcatccctgccctcaagaaggttatagtcttactggagaaaccccagtcacaatgttcaattccttttctgattactcacagtgactaccacagcaagccacattctgttcattgtgatcctacagctcttctaactttttgtaggctcaagactagtgcttatttagtgtggtcaaggttcctcacaatccaagtggataagtgagatttcagctggaaaatatacacatctttttgctattggctctcacataaggctcaagagtactcgaacttctgtatgcatcaccattacacagggagctggttttaaatgcagatacctggccccatcccagagataggaattcagtagaccttgggtagagtccaaacatttgagtgtttaacaaatagccagatgattctaatgcaggtggcacttggaccatgctttgaaaaagactgctcagtatttatgaggctttttttctctccctttagacaacagcctttatctaaagaatgcatttctccctaaaaaaaagatgcttgaacatgtatatattcactcatgcttatttttggtctatgccttggagtgttgatttgccatctttaactccctagctcatccataacaggacacctaggactaggcactggtttgttgcgtttccccagcagtgggcccactattcgtcatcccacatctttcgcctctcagaggtgtgcagatgaatttcaacttgctaatgtagcgtctaaatatcctcttgttcacagttctgggttatcaaggtctatgcttggtggacacagaaaaagaggcttaatctacttcgcccatttaagtgggctggtaatatgttgctccttcagtataaggcagttgtcagttgtctacctgttattgtgataaaagctattcaggcaaggttgagactgtggagagcactctattttaactctccccatttatgaataaggaaggctaaaggatctgtgaatatttcccaaaggaaaatatgcttttcagtgagttcaagaacaagggtggcttctccatttacaaaaccaacctgcctgcaatcccactgcaggctctcagtgcttagccaggagggcagcccagcggtttggcatggacacagtctatccaggttgggggcaagtgcagaatttctaatactgcctatggctgcagaagctccagtaagcacttatgctagattccatgtggctttccctaggagagagtcccatggtcagcagcactatctcccttatctccatccactggagaagccgaggggaagccagtaagccaaggaaacaaatggagtcaattataacccttgagccatccaagttcctggttaagcacattacacagcccaactcgatactcttaagccctagtaatgaaatgatatgctgagcctgagcagaaaaaaaggagttgatggttccagattgagtgcctgaccatttgctccactttttgcttggccctaggcattctccagcacttccatattgagaagatctccaagaggatgtttgaggagcttcctcacttcaagctggtgaccagaacaaccctgagtaagtagtacttctcttgactgctccctgaaaaacacattcagttttcaatttagcatagccacagctaaagtccctccgcaatctcagtgaacattagcactgctcagtatcaacactaaaggatgttccatctctcttctgggtgacttagcagtgaatggggtgtctgaatgtaatctgaagagcttggacatggtgaatacaaacccagatgtagtctgagcataggatacctcaggtcaaggcttcctgaatgtctttaatgaaactgctaagcacagagtctcaagagggttggagaaagctcataagattccaggtctggtatatttatggagacttcacatctggaagggtgtatcctctggtggtgggtatgagaggcaaagagaaattaaaggcatatcaattcctgtgttatatgaaagcacttttactcctggggaactgcccctgggtggtcatgtttccttaaaagcattcaggcactcaaaaacacttgcagctctcccactttccacactagatggagcctagggactaagatacttctaggcattggggcgggtgttgagcacttctaatgggataaaaggcacacagtttctatccacagggaattataatggatgagacagaacatgaaaatgacttcagtatgaattagtatagttctgaggagttaaatatcaaagtgctcaggggaatctgcaaagaacaatgagatgagagccaggtgggcttagtcggggaaggcttcggggaggaggtgtgttttgaaagagaagggtatgactgggcaatgggtcaggaaatcagtccaggaaaagagtgcagcctaagagaagactcagacaggagcaaacaggaaatgtgggtaggggagaggaatgatcacaaaggccacagaaggtgcactaaaagattagaagatttggaggtagaaagtagtcatagggcctgaaaaaaagccagtaaaatgttcaaatgtaaggcaagtagcatctgtagttgctgcaaatagcatagagatatcaacatggtgctttggaaagatgtctttcggctatcagatgcatatattacattaagcacacactttgacgaagccagattatgaagtgcccaatttatcatgctaggacattggacttgatctccaggccagagaatgccagtggaggtttttaagcaagtgaatggtgcattcagatctgctttatttatttttttatttttttagaaagaggtcctcgctgtgtggagtgaaaggtggacccttattaagagaagtgggatagtctgaattaggaactaattatactatattaaatcaatgagacgggaggagacgtcactgtgagaaacatttctgaggttaaatcaacaagatcagcatcaaagagagaaacgagtttggaatgggtccgatattaataactcgactgggtgaatagtaataccattcaccaacagggaaactgtgaagaataagcaggtattggtgaaaaagagtttcacttggaacatgtttaaattaatatgcttaagagccatctgagcagagttagggtccaataggcagctagaaaaagagccaaggcagtcagttgcttgtctttggcaggactcatagaaaataacaggacagtatgagaattcaaatggaaaagttgggagtccttacatgtgagtaagaaaggaggcagagtgtaagatcctaggatcaattatgggacttctgaagttacatgttttagttcatactgtgaacaaggctttgttctaggttccaggggacttaaaagatgatttagatatactctgtgcccatggcaggatttggggtatataatggagtagaaggtatgtgcctcaaactgtgtgtagctgaaagaagttggtatgatcctacagggtcacctaggagcaaagaagaacaaacccaactcttttatataatgtgcctagcagagcccagcacattatagggcttcagtaatagctggttccttgcccaaatcctcttcttgtttttttgtttttccttctatcttcccattgagtcatagagaatggggaaaagggagaaatccaagggagaaaggagcagagaaatcaggcccatagggaaggtgggtcattattctcttgtggctaaggaaaagaaaaagaggttcaagacaggtttgggcttaagaggagttggcttaacttggactaggagttctccaggttgcagtaccatgagcacaggaataaaaagaagacaaaacacagtatccagggtgggcagagacaacaggggatggaagggctacagccaagtttactctgcgtggaaagggattccatggggtatatgagaatggatgaggaaccatgggaagggatttagggtgctaagggggtataaggacagcatgtggacgtaggagaaagcaacgtcgagaagtttttaacaaaagatagcaggaatagaggaaagagtgatatataatcaaatagtaatcaagtaacccaaaccaatatttggggaccctaagggtaagcaaagccccagtaatacagtaggtgccgttttccaaagtgcctttttgacctggtgccaagtaagctgcctaaatagctaacaagcagatattgaagcattttgtaaatgctaaatatactgtaaaaattccaagaataacacttaggttttgctcttgaggaggggcagttctatattattcttgggattcttacaaatgctatgtgttgaaatgaaaacttcatttcccattttccatatctgctactagaaaagtgttttggggccattttttgaaaccaagtgatatttgtattccaaattccctggtaggtccatgagtaagtgggtaagcatggggtatattggttctattcctaatttgctctgctttcctcttacacactcccggccactttgcgtttgtttgccttttaggccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaatttt

SEQ ID NO: 3631 - DNA, 120520 bp, human
gacggagaaggccagtgcccaggttagtgagcagtgcccggcgcccgcttccctcacctccttttccagcctttgcacaggtgggttgccttctcttggccggagccgtccctggaagtttccccagggtgccccaaattcccctgccaccccaacctgttctgtgctccagcagttagcaacctggatggaggtggggcccaaggcttctgaccaaagcaagttgggggtctctgaattcgaactcacagctcgtccctccccactcggcctgcatttctttatgctctggcgctttgagaggtcacttaggtactccaccctgagctacccaagggactctgcagtccccttaatcactgcctgtattcctgagcctgttttctcattttgctgatgaatacatggtaaagttaatgtagcagggtagatgggcgaaaggctccctatcctatcctctggccatctgcctcattttttgtccctgactacgggggtcagaatttgagacactaggctctggaagcaacgtggtatattgccagaacatagggcccggaaagcctgctttccagtccctcccagccctgccactaaagttatttgagttctctgggtccccccagtgcccattttgaaggtggagttgtgtggaatgaaatgaaatgatagaaaggtgttttgcaagccaaatgcgaggcattgtttgtcagtcataagcagcaatgaaagcatttcctccaacaagagataccctgggttaaaactgccattttcagtggcaacacaccaccagttaactgaacttttcttgctgggtggtagagtggggagaggatttcagctgatggacaagggcctgggactccagtgtctttcttattgtttgtcggaaagaaaattgctaccctaggggctgtcccacagatgatagtcaatgtgagattacaaggtcagtcaagcctctcaggaggattaaagagacactgtggggcgtgaagaactggctgacatgtgttcatcccttagccttcctgtggggatgtctctttgcttctgttctacccaggagacctgttctgaaagtgggctcctgacacttgatggcccagattgccttgcagtcacagctgggcaaggagcagttggtccctttgcttaacgcagatgaacaatgtgaatgcttgtttcatggaagcaccttaataaatacctttcttttggtacttgatacatttctctttctcttgtaaaacacaggaactctcccatcccacctccactacctgtgttagttgcagggttttgtttttttgttgttgttgttgctttcttgttgggtcctggatcccctgaagcatgtcaatggctacatgtctaagtaacctgtaaaagagccagtgcaagttcaatggcacaacagcctgtgtgaagcagacagagagttaatgcagaaataactccagttaactgggtcaaagtataatttgaaaaattaaggacagtttggctctttgcaagaataagagtcggctaagttcgctgagcaatgcttgctagtgtttactgctgcagtcccaacacatgttttgaaccacccccttccctaaaagaaaaagctgaagagataaagagaaattgaacagtgaggagatctggggagggaactcttcttggttcatatttctgcacagaatacaaaggcaggacttcaggatcttgtaaatcaaaagtgaatatttataaagcgattcattttctgatgttctccatcacagcctgggaggccacacagatgacaggaacgccaaaggagattaattgctctctagttaccaacttttttatttgctcataatattagttgggacctaagaaaggcaaaaaaatctatgagctgttttcttgccaacttgagttatgaagcaatgctacagttcaccgaatcgcccaaccattatacaagaaaagcagccctgttgattctcgcatggggagaccctaaaaccatggtttcagaaacacccgttgaaatccatatatgaatgtgataaattggatttcagtggttaaaaatctttctcttttggaggcttggggaataaacttattagaataggctcaggaagaacctcactgaggtgggtagctgtgttaaattgttaatgaaaatgatttgtttcgaataaacgtggtagccctcaagggacagtaacattctgagtgattgtaagtgggccacaaactcacagaggggaccaagacatcagaactcaggtctttagatgggtaggaacatgtcctgagagaatttggttctttaaggagcagggaggaggtaaagaaggaaggcagacggtgctgcaaatcttgtttgatagcacagattactctatcatcagttcttccttggttatgcattcataattgaaacagtggattttgaatgacccaggcaacttcatagcatttaagtaggagctgtagcatctacttcagagcccaaagatattcaactctccaaaatgatcgttttgcattccttcaagttctttatgtgcaatatttaggttggactttctggaaagatcaatgagttcatttcccattcagattgaatctggtgtttttagaacatttcaatattttcagatcacccattggaggaattttgcaaactctaacatctgtggaaatgatccgtgactagatgtgagctacagcaaactttctgtgttccaaggttcaaaaggtttaagatttctaccccttatactgggaatgccaatctcatgttttgaagaactgtagttgttttaatggtcttttgcatggtggtgcaaggtgaacaaattatctatttaatttgcccaatttcccctaaaaatggcccatttaaaatttccattttacaatggacttcttgggggaggaatatgttggaaccattttaagcagtaaaacttttcaggtgtttaattgcatccatttgctaattacatctatcttttgcaatattagttgccaaaccaaagatccttgtagatctcatagaggacacaggagaaactgatcaatttgtacttcattccaaaaggattaaaagtagtcttgaagctaagattagttaactttcatttcagaaattgcttggtctcatgcttgttacttttaccttgtttgctaaaataaccgtttttgcaagctaaagtttcccttttctcccaaaaaaatctcttgagaaatcaactttaattcccttagaaaggaagatttcaaaatttattttcattttcctataacttgcctgtaaggacttagcctcagctttggataggaatgcaccctcattcacttgaattttcacccacaagccttgcaagacaggagaggcaagtcctttatcttgtgcaggcagacaatacttacacttatgtaaattctaggacattttttttttattctagcaggttagaagcctgagcatcagtgacctctatcatttccagaagatctgtgttaagtcttttttctgctttcttcccaacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacgtaagtgtcttgcatttggaaaataatacactttttataatttctttgaaaatgtggctataatctgtagcaattatgatttagcccaaatgtggccgtgccattattctaagagaagaaagtgaatgttactggtttatgcatgaattgataaaagaatgagagctttgaatcaggccaactaaatttggggctgtttttctgattatcatgtagtctttgtctcatagaacatatgacacattagcttattttctcttccctgttctaaactatacaaatctcattacattttacgtaactctagaaatatctgacagatgagctggaattttcccaaatttcagactcttcagcaaaggctttcagtttatgaaaaataatgacacagaaaagaaaaaaaaagaaaaagaaaagcaggctctgcctattcccttatgccgaaaaacgaggaaggacgaaaccttcctatgaactgggctcagatgaaaaatgttttgaggaaattgagattccagggaccgttagcaaattggatgccatttattgaaaagaacatccccgcaaagccagggaatatttctagaaagtcagcgatccgtgtaatgggctaacacattggagaaagcagagagtggcaggaagtgggggcgggggggataattaaccctccttgctgccacgtttaggagatttatgagtaacggtcgacatatccgttcttgctgcctttgcacaatgtgggtcttaccttctttgggccacttgcagccatctctgaggtagatgcttgctctaaatttgaaggaaaagcctaagctctagttcccctttttgacagcatcaaaaaaagcacaaaatggaattggtccaagaggggcattctctgcttcactgaacttattcatgagaaggagctgtgaaaatattcttggtaggaactgaagcagcatctgaagcccttcacttaaacctttatctcttttatcacataagttaaatagatcaggcagaaggcttgctgacaaggagaacagtgccaagcctattccatccttaagtgtgtttctgtcccactacaattttcatagtaagtgtagtcttcttcctgggagaaacagtgtttaatagtgtttttgattatgcttttgagcatgagcggtgtatggtgatatctagtatgattgggacacaaaaggaagtttagtggggcatgatctcagcaaggaagcttggatcagcctctactcttgtatccctcaaattgcttccttcttcttccacttgaatatagttcatctcagaatcctcctcttccagaagccttccttgatttaagtggatgtgacagaagcatccatgcattctcagctcagctcacaattagctgggcttagggatgaaatattactcaataagtacaatgtacattatttgggtgatggttacacttaaagtccacactttatgcgatatatccatgtaacaaaactgcacctgtaccccttaaatttatacaaaaaaatcttcctgtcttagagagaaacttcccttatagcctgttaatgatgacctcatggggaaagcttgtaactctcagaagaccatctcttatggaaagcctttcatatttatgaagaattgaatattgtccatgaaacttagacaaagaaagatgtgacttaaaaaaattacaaacccaaatctactactttctaatatttccttgtgctgatgaatttgtcccaagcccttttgatattcaattggtgccaaagtgattatgtaacagatggcctagggcaccagatctggtccagtgtttcaggcttattgtcagatgatgacgctaaggtcatggtccttcccttagtgagccactgagcatcattatgtgtgtccatgcccaagctaactgttctgaagacatgcaaaatcatctctgctaaagggaaaacctcaaagcatatgtcctatatatgctgtcttgatatatgcatgcacatacacaaacacacacaatatgcatgcacagagatttatattgcagctctaacagtgagaagtcagaagcagtggaaatgtcagttcatagataaatagttacaaaaatgatccaggtaatgcaatataatgctactattaaaaacactgtttattgaaaatttggtggccctgggaaatgcttgttaacttatttttaagtttcttaaattataaaattaatatatatgcttattatacaaaacaacatgaaagcatctgagcttcatatggaacatgtgtccctaaactctcattccactctcctgggataaccattattagtggtttgctgtgtgatcttccaaactactttctttgttttataaaattatatatacatgcctgtatgatattttattttacaaaaataggatattatatacacttttctgtgatttgcttttgctcaataatgtgtgtaggacatccttccatgtcaatacattgcaatgtaatagtgccatattctttctaatgcttgcatggtttgcagttgcataagtttgcattggtttatttaaccagtctatatttgtagatattgaggttgtttccggtttttgctattaaaagtaagacatttatgaacatctttaggcacttattcaagtatttgtgagaaatagtcgaagtgcatgttcagttttaatcttcataagtactgtcaaattgcccttcatataagttgtattaatttatgctcccaccatctatgtatgaaagtccatttctaattccttcaccaagattataatcaatctttgtattttggggccattttaataggagaaataatctgtaagttttgcttggtatttttctctttctgcagcatcttttcgattatgtactagttcaattttatttcttcagtgaattgtctatttttagtttggttgcttgtgatatttatttgttaaaaacttacttattaaccttttatattttaaatattatttttgatatgccacttgttttaatctttaagttgtatttttcccatatagaagttttaaaattttacgtagtcagatctgtcattcattttctgtatggcttctggatttcttattcctaggaaggtctttctcaccctatatttttatattttcttctactgctgccataattttatgttttacccatagttctctattccatctgaaatttatattcctgtatggtatgcaatggggaactaattttttttaaatctccggatggtaggtttatgaatgttatttttgctcacttttatgcttctgtctattccaaaatttccacaattggcaagtttcacttttaaaacaggagaaaagctctttttaaagtaaaagtacatcttatttcccatatttttactgtgcaactctagagacaagttggtatgtgagtagatgaagaaacagaggggttttctaaaattaaaaaggaaagcaactggaaaaacttcagaaaatgggtaagagtaggcctgggtcataaacccttcacgtctctccttgtctgacaccattttaccaaaagaaggcaaagttttttatcttgcaggggctggttagaatataagcttttaggtcaaggaatgtgttttgtagcctgtttgctctcctatttggggcatcacaggggaatgacgggggatgccattatggtcaaagatgctcactcaattgattcagaaatctgaagaggtgtggaaaaaacgctttgtttgtggaaagctcatcacaaggaatggtgaagatgggtgctgccacttgctggtagctaattagccatagttacaatttctcttataagagagaagacaggctcaggaaacccgaaaatactgatagtgcattgcaatggatgaatgagccatttgttgcttacataaaagtttgttactgtttagcatcagcaaggtttgagttctttagctgggaaaaggtccttgtgtataactccattatgctctgttgttaaagttgtagtcaatgaggccaggaaactcttttgaagttcaaaggagcgtaacattcacagcataatattcatgcaaatatgggataaatgggctgaagagtttgcccatttggcagatctaacttaggtaatgaactattgatcaaagtgaggttgaagaattgaattgttaagaatattcaattatgtatttctaatagaccagcctgtgccaagtctggcaaaggttctggagagagaaattgttcatgtatttcatgcagtccactcctgctttacaaggtagttaactggatcttcaaggagctagattgtcacttatttttctcctcaagagaaaagcttccaatattcagatttggctaaaagtgggcctctggacttctcaggaaaggcaagccaccaaaagattgaagggaaggaagaagatacttagaaagtttgaaacatgtgaagcccacttagaacttctctattgtgagagccagccaggaaggcatgggttttcctcctccagattctcccttggtcatttgaggtgattattgagcaagcaaatgcgtggacctgttcacatcttagaagtttaattaagtggaattagacgaaaggaatacctaaaattagatagcttaatgcttttcaaagtatattcttaattgttttttattttggtgagggggcagtaggttttgtcatggaggctctgtagttagcctagatccaatccccagctccttgacttacttatgtaccttgggaatgttacctaacctctccagctttcgttttcttatcagtacagtgggggaaataatagcataatgagcgtgagcattgtcatttgaagaagaaacgagattgtgtacaccaagtgctttgcatagtggctggcacatagtaagtttttcataagtagttgctattagagcaactctcttacaagccaaagatattatccccttaattttaaggtgagaaacttgaaactcaatgaaatcaagtgactttgtacaaggacaagcagcaagtcccagccagagctagaaccaaaacccaggtctccgaattaagtgttctgttcactatacccatctgcctcttggaattctttgaggaagtcagttcattgtcttgaatagaagcccagtcctttatacatggcagccacttaacacataagagatgatccaagtaaatgaataaaaattttctaacccaaattcctaagagggatagtatactatttgggagttaaaagactgagacaaggactaaaaatttttcaggaacctacatttgctaagccaaaggaaagtagtgaggaaggttaaaagtatgtgcgtctatgtctatgcttcttatatttccctgacttctcagtaggattggaatgtcttcatagtttaatggaaagaggactgtgcttaaagtcaagagacctggtttccggtcagtcttcccttgtttgccgtgtggtattggttgaatcattcgtgttctatgaagtaaagattcactacttacaaattgaaaagaattcttgccttctggactgaaaactaaaggagaatagtataggggctggggaggtggaacaagggaaacgaaggccctggttttgtgtacttggagcaaaccacatggatatttaatattgtcacaaggtaattgcaaagaatattttatccatttaagatttatagcctgtctgcttctagaaaggttagatacacattagagatgaaagaataggggcaagataatgtttttaaagatgaaataaaatagagatcatctgaagaaaatagaaggaatagatgtttttaacatttggtttagtagattatagcatttataatgtaaatctggcttatgcctcccaaaaggatgaaaagagaaactttgggtttgttgtcaagagaaaatttacagtttcatctacagagattattcccacctctaacccactcaagcagtattgatcctgggatgtttgaataaggcacattctgggtaaccttggtttcatagaaaaaagaattgtctggcatttctttactgatgctttgtaaaggaagaaggcaaatattaaattataattcaataaaggactttctataagcagtaaggaaatgcattccaggtactttccctttgaatgatctaaattggagaatagaacatggaaatgttaaatagatgtttaatatgtctactagactggattgtcaactatcagatgccctaagcaagctttctattaacatgatttgtttctgattttaaaaatagatgctcattgttaaacattcaaaaggtacataaaagtatagggaaaacaaaaatgaacagtaatcacaacgtgtatggataaccatagttaattgatatatatatatacttgtagtctttttttctaagctcagttatacaaacatattagtttacaaaactgaagcactttttaaacagtatggatcagggtttgtttatttatttatataaacttaggggagacaagtgcggttttgttacaaggatattctgcatagtggcgaagtctgagcttttagtgtagccatcacccgaattgtgtacattgtatccaataggtaattcctcattccccatacttcttctaccctcccacctttccacatctcctgtgtctgtttttccaaaatgtatgtccatatatacacattatttagcttccacttgtaagtgagaacatgcagtatttggctttttgtttttgagttgtttcacttaagatcaattcacaattggagtctctaaaatgcacttgtagtaaagacaacatcccatgttgtctgtaagtgaaagctgggcggtttagacacgagttgcaggatatgcaaatttgattctattgtgagaagttcaagagctcaacttttattctctaccaaagggaacaaaagtattcctgatcaaacagaaagcctcccttcacagagatttgcaccgctaaagtgctgataggaagaacagtttggttttttgaacaggcatttttatttttgcccaaagttctatgccatatgacatggaagagatgatattagcctgaaaaaatattcaggtcaggtttcatcagcttagcagcctttctgtaaaaggatctcctcatggcctcatagtagacactaatgagaatatcatcaactcccagttatttatgctaatgaaagatagaagggcacaataaattgaaatttcatggaaaatctccagttctcatcttaatggtgtcaccttgcttgactgccaaacttctttgaattatggacccttttcttttcgatgggtttgcccacctgctaataggaaagtaaaataaccacaaaacaagtagtgagagggccatgctgtgggaggcccaggcaggtgaatcacgaggtcaggagttggagaccagcctggccaacatggtgaaaccccatccctactaaaaatacaaaaaatttaggtgggcgtagtggcgggtgcctgtaatctcagctactcgggaggctgaggcaggagaatcacttgaacccaggaggcggaggttgcagtgagccgagattgtgccactgcactccagcctgggtgacagagcaagactccatctcaaacaaaaaacactcagtatataattttgggcaggtgatccagcaagtaggaaaaagctaattaacttctgaatgaaggaaaaagctgcatacacaggacggagaatgttgcttcttcatgactttctttttttctctggcgtctgcaggctggaaatgaagtcttaaagtcctgagaaaacatgaaacagagtcttcaactctagaaacccaattgtcagtgaaataagaaacgttttccccttaactactacatcttgcccttcctacattctgcttcaagtttgataaatgacagaagagacgtacttatgcctttattttttcttcactcttctagtagccttttaaagaaaaaaataattaaaaaggaatttgtttacttgatgtgtccactcatataatgaatagcagagattcatctttttttccactgaccatgtgttataatagaataaatattattgtaatactgacatgacaatgtgtctacagtaatagcgcttatcaaaaacagttcttgggaatgttttcttgattttggactggtgatgaagttactgacctttgcctaatcctgggagctagtcagtaatgattggcaaaacattgatggcatagtgacacgtatctgttgttgtttactttttgtcatcattgttcctattaacaggggcccctaaagtagcagagatagccacctctaatgagggcaagctgatacatttgaaaaatagctgtgatgttgcaggttgaaggtccatctcacaagttagttggaattcctttgggaccaaattctactctcagacaccattagttagcagtaagtcatgcatctgatttgtgctttttgtccaagatgatatactgggattttatgtgttattgattatactgcataactcattaaattctctccttggtaatgtcaacaatttttaaaatttcaaacttataagcatatactgaaattggctttatcatagtttctcaaatttggtgattgtccaatgtgttcatggtgaaattagtataattgtgctaaccactcaatattggacaaccatgctcaaacacgtcttaaaaattatggtgttccagcacttttggaggtgaggtgggtggatcacctgaggttgggcacagtggcaggtgcctgtaaccccagctactcgggatgctgaggcaggagaatcccttgaacccaggaggcagaggttgcagtgagtcaagattgtgccattgcactccagcctggacaacaagagcaaatctccatctcaaaagaaaaaaaaattataatgtttacttttttgatatgctataaaaatatcagtgtcagtaattgcagaaacattgtttaatagcactaatggcgtgaccattcagctccttgtctgccttcagttcctaaatttgctccttccaggagttgtaggtttctgtctgggtcataattagccaaatcccatgttgctgagataataagaccaatacacttgatgaaataccattatgttttcattttagatcaggtttctatcagcagttagtgtttgagtaagatatttgcatcctcaagaagcatagtttggaagacactggtacgtgggataaatgccacgtgaacaaatgaggaaagtgctgttaggtttaaagagaatgaaaaataacttttagctggggtaatcttgtcttcccatcaagatttcaaagcccttaaaagcatgagcactattttatacattatgtgttgtcactgatgtaaatacaaaaatgcaaaatagtctctgccagctgcactattttatatagtctttgttgagtattacttgacttcactacaaacaacattgatttttaaaaggtgattaaagttgtgttaaaaaggtatagtggaaaggtaatttgagaaaaggttagtaaagaatatgtggaagctctttactttccaagttctaaaaacagtgacctgcaccttaccaactacgtagcaggagaggcagaattctgtaaaggttatagtctttggttctaaagctacaagatataggtttgaattctatttccataccttgattagtcatgtcaacttgggcaagttaccaaacctctctgtgccattgattcctcagtggtaaaatggggccaataatgagacctaccttgtagggttgttgtaagaatttagtgaattcagatatgtacaacccttagagcagatcctgcctcataggaaatgctcaacaaatataacttgttgtttttgttattgttatcaccgttctcatctggctctatatttttcttgcagttggttccctggctgctttttacacttatcatctacctcctagcctttgagctaaattcggggcagaaaattcagatggctcagctttcaaactttgtctaataatactccttagaggctgaatttgggggaaaatgtaatctattggctgaaatcagttagttgggttatctgtggttttcaagaataatggtgaactcacatatactgaagcgatccatttaatagtgtcagtgaaataatctatcttaaatattttttagagaatagatagcaacttgcctgaaagttatatattaagaataccttcctcatcacatcaatatatactgtccttttggaaacagactttcctgcaagtcagaatcttaaacagtttggaagagagttttagaaatgtgcaaatgaacttgaaacccacatttgtatagcttgttttatttcagtgcttgagtagtcttttcggtggtctttatcttttattatcccctttcttctttatcaagtaagaaaagggtaggtcattcaaccatgcagaacatatagctgataggaaaacatattcagtttcatattttaaataggtaaatattatgtcaacctctgattgagctaatctaagcaagaaaaataattcagaatcaaacacataatatacagttatagcttactctgcaatgtggatttaaacctacaaagtaacttttagcttacctccattcaagttttagtggccccagactcatataagtatgaatatttatgctaacctagtaatgccatttgaaggagccaccttgtaggatttgcttccacatgtatactcagattctttctgaaatgttgaaataagttgtatatgtgaaatgcaaatcacttaagtgtttgtcagtgagactatacatttattgtacagaaacagtaactctcatcccaccgaaatggtagagaaagatgccttatttagatgttagtcttgggaaattcataatcatctctcatcagttaaatatactgggattattaaaatatttaaaatatttcttaccatgtccttgaatgttgtggagcagaagtttaatttgtatctataccaaaaaaaaatgtattgctaagatttggctgaaaaacactaacattctgccttaaaagtatgttctgttttctttcaattaataaatattttgagcacctacttttagctcacaaatagagattaatataacaatgttgacgatgatagtatcataaaaggggaaataaaaattgttactaaaatgaatatatattcaaccttgccgataagaaaaagaaagaaatattggttccattttcccttacttaaccaagttgccaaaactttaaacagtccattgctgggcattctcactcactgctaatgggaaagtaaattactgtggcttttctggaaggttgtctggtaatgtaaatcaagaatttgaaagtactcaaaacatttgacccaagaaatctacttctaagattttgcattaagaaaatacctaatgttgcaaacagaactttatatgtaaggatctttgtcataatttatttaatggaaagaaatggaaacaacctaatatcccaagataggggattggttaataaattatggttcagctgtgtattggtgtagaactatgtaattagtcatgaggtatgggtaaactatttaatggcacaggaatgttctgatatgttaatttataatgtagtttataaaatgtatataatatatgctgttaattttgtaataaaaccttaatacacataacccatggaaaaaaaagatcagaaagagcttccagtttccagtctgataaatagtgatcttggaggttgtcattcctgttgtcaaaagaaaaaaaactgaatgaactgaaaatcaacaatagatgcagtaagatgggaaatggaaataaaaggtatacatattgggaaggaaaaaacagtattacctttgttcatagatgacatgtttttctgcatagaaaatcccaagggatcaacaacaatgacaaacacactcctgttactaataagtgattattgcaaggttgaagtatacaaagttaatataaaagtcaattgcttttctgtctaccagcaattaacaagtggaatttgaaataaaaaatacaatattatttatataagcagtcattaaaatgaaacaggtgtaaattcaacaaaatatgtacagtatctatatgatgaaagctataaaattctgatgaaagaaataaaaaactaagtagaatggagagatactccatgtttgtgtttaggaaaactcgatattgtcaagatatcagtttttcccaacttgatgaatagatgcaatacaatatcagtaaaatcccagcaagttattttgtggatgtcaacaaactgactctaaagtgtatatggtaaggcaaaacccagaacagccaacacaatattaaaggagaacaaactcactacccaacttcaagacttactattaagctatggtaatcaaagttatgagatattggcaaagtaatagaaaaatagatcaagggaatgtaatagagagcccagaaatagacccaaataaacatcatcaactgatctttaacaaagtaattcaatggagaaaaaatagtcttttgaataaatgggtgctggaacaactgggcatccatatccaaaatgtaaataaatctagacatagatttcacacccttcaccaacatttactcaaaatggaacacagacatgagtgtcaaatgcaaagctaaagaacccttagaggataatataagagaaaaatttaggtaaccttggatttggcaatgacttgcttttttaacttttagtttaggttcagggatacatgtgcaggtttgttaatacaggcaaatgtgtgtcacggggggttggtgtacagataattttgtccccaaatactaagcatagtactcaataggtattttatctgatcctctctctcctcccaccttcatgcctcgagtaggccctagtgtctgttgttatcctctttttgcccattggttctcattatttagctctcacttataagtcagaacatgcagtatttggttttgtgttcctgcattagtttgctaaggataatggccttcagctccatccatgttcttgcaaaggacatgacctcattcttttttatagccgcatagtattccatggtgtatatgtgcacattttatttatccagtctactgttgatggacatttagattgattctgtcttttgtattgtgaatagtgctgcagtgaacatatgcacacatgtgtctttatggtagagtgatttatattcctttgggtgtatacccaataatgggattgtttggtcaaatggaagttctgtttttaggtctttgaggaatcaccacactgctttccacaatggttgaactattttacatcctctccagcagtgtataaccttcccttttctccataacttgccagcatctgttattttttgactttttagtaatagccattctgatgggtgtgagatgatatctaatggtgagtttgatttgcatttctctaatgatcagtgatactgagcacattttcatgtgcttgttgactacatgcgtgtcttttgaaaagtgtctattcatgtcctttatctgctttttaatgaggttatttgttttttgcttataagtttgtttaagttccttacagattcttgatattagaccttcgtcagatgcatagtttgcaaatattttctcccattctgtaggctatctgtttactctgtggatgctttcttttgctgtgcagaagctctttagtttgattagattccacttgctaatttttatttttgttgcagttgcttctggcatctttgtaatgaaatctttgccagttcctttttctagaatggcatttcctaggttatcttccagggtttttatagttttaggttttacatttaagtctttaacccatcttgagttgactttttgtacatggtttaaggaaggggtctagtttcagtcttctgcatatggcgagccagttatcctaacactacgtattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctctttgatactataatagtggatacatgtcattatatatttgtccaaacccacagaatgtgcaataccaagagtgaaccttaatgtgaattttggactttgagtgataatgatgtgtcagtgtagattcatcagtggaaacaattgtacctctctggcaggggatattgataactggggacactatgcatgtgtggcagtggtaacagggggtatatgggaaatctctgtaccttcctcccaattttactgtaaacataagactgctctaaaaaattaagtattaatttaacatataaaaatacataaatactttaaagtatttatataatactttccctccccccacagtttatgggtacatcaaatttctcttcagcaactgcaagcaaagaaagaaaggagtgaaatatttaagttgttgaaagaaaaaggctaccaatctggaattctgtatttagagaatttatttttcaaaaataaatgataagtaaagactttctcagacaaaaagtgagagaatttgtcaccagtagaccttccttgcaggaacttttaacaaaaattcttcataaaaagggctaccaatctggaattctgtattcagagaatttatctttcaaaaataaatgataaataaagactttctcagacaaaaattgagggaatttgtcaccagtagaccttccttgcaggaactattaacaaaaattcttcataaagaagaaaaatgacataggtcagaaacttggatctacataaagaaaggaagaacattagcaaaataataagtgaagtaaaatatttttctttttcttaattgacataataaaggacagtttgttcaaaataaaaatagcagtgatatcttacatgtctgtagcttatgggaaagtggaatgagtaacaggtgtaataaggaatggaagggagggattgggaaaattctgttagaacatatctgttctacacatgcagtggtatagtgttatctaaaagtaaaagtggacttggattaatgtaaatgtatattgtaaactctagggcagccactaaaaactttcttaaacgaagtataattgatatgctcagagaagagagaaaatggaataatataaaatgttcagttaaaaccagagaagacagaaaaagaaaggaagacaaaaaaaaaagtaacaaaaaaactagggcaatgaatagaaagtcattgcaaatacggtcaatattaaactagcaaatcaatagtcactttaaatgtgaatggtctatataaaccaattaaaagacagagactgtcaggggattaaaaatccccaaaatccaactatgtgttatctataagaaaccactttattttaaaaaatatttctaataagttctattgtgtacatttaaggtatacaacatgatgttatgagatacatataaaaattgtaactgtactgaaacaaattagtatatttattcatcttacatggttatccattttcccccacaagagcagttataatcatattaattgaacaatttgtcccttcaagtcaaattcctcagttgtgatgggtcagattcctcaattgtgaccaaccattgcaggtgaaattcaaattttatttttttagtggttttatttttgagaaaaattttatttcacctctcccaatggatagacatttatttcaagatacactgcatcctcttattgtcaacacttcaaacctaccagctactgacatcttgaaacagcataatttgttatccatgactcctgaaagttcctcatgtcaccaacccttatatgatacaaatgtaaagatggctattcgtggaaatgtgttcaccacattgccaagtgtcttgggtctccttttgaaaagaatgttttttcacaaaagtcaacatttccctgaaaatgcagctccatcttctattggtatggtctgtggaagtcacagagactgaaatttcggtccatattatggttgataactacaatttctgttgcaaagtatgcaagcattactttgaactgcatctgatgcaacttggtggtctaggccattacttgcaaattgccaaggcctattttgggaacaatgctttcaattcccttttattgcatgtatcagaacaatatcctgttaactaatatgatggttcattttactgcatatatgagaagaatgtcctgttaaccaatatattttgacttttggttttagtatgttttagtacaaatatccagggacaaattcttcagttgaatacatccaagagacaatttgttcaattgatctgctataatctaatcatttagcaaaaattctgactacaatacactatcattagctatggttctcatgctgcatattagatctttagacttgttcatcctatatatctgctgcattgtattttttgacctgtatctcccatttccacacccctacaccaatcatagtcaccactgttttattctgtatctctgtgaagttgacctttaaaaaaaaaaagataccacatataagtgggatcatgtgatatttttctttgtgtgtgtggcttatttcacttattgtaatgcataccaaagaatattttcagctatacaaaaggaagagatcctgtcattgccataagatggattgacttggaggacattatgctaaatgaaagaaacctagtttaaatataaagacacagatgggttaaaagtaaaggaatggaacaatatatactgtgctagctctaatcaagagaaagctggagttgttatattaatttcagacaaagaagactttaggacaaggaaaattatccgggaaaaatggggggcattacatattaataaaggggtatattctccaagaaaacataacagtccttaatgtgtttgcacttaacaaagcatcaaaatatgtgaggcaaaaactgatagaaatgcaaggagaaatacaaactattagagctggaggcttctatacccctttattagtaatttatagatccatcaggcagaaaatcagtaaggacatagttcaatttaatcatcagtcaactggatttaactgatgtctgtagaatactccatccaacaacatgagaatatacattcttctcaagatcacatggaacattcgccaaaatagaccatattctgggtcataaaacataccttaggaaacacaaaataatagaaatcatactatacttttttttttttttttttttttgaggcagtctcactgtcgcccagggtggagtgcagtggcgcgatctcggctcactgcaagctccacctcctgggttcacaccattctcctgcctcagcctccctagtagctgggactacaggcgcctgccaccacgcccagctaattttttgtgtttttagtagagacgggatttcaccgtgttagccaggatggtctagatctccttaactcgtgattcgcccgcctcggcctcccaaagtgctgggattacaggcgtgagccaccgtgcccggccctacaatatatacttctacaccatactggaattaaactagaaatcagtaacagaaagctgtacaattccaaactatttagagattaaaaaccacacttctaaatcgcacatgggtcaaagaagaagtctcaagagaaattttaaaatattttgagctaaaagaaaatggaaataccacttatcaaaatttgcaggctgcagcaaatgcagtgcttagaaggaaatatatagcaaggaattaatatattaaaagtggaaagatttaaactgaataatacagactaccaccctgggaagctagaaaaagaagagtaaatcaaatccaaactaatcaatagaaaataaattttaatggctacaaaaatacagttagatagaatgaataagatgtagtatttggtagcaaaatagagtgcttttatggattgtgacattggtcatttctaaactttttgcctaaaccagaatcacaaagatattctcctgtttgttcttttagaagttttaaaaaattaggttttaaagtctataacccatcttgagtttatttttatatatagtatgtgatatggattaaggttcattttagtttatgttttgtatattactatccaaatatttaggcagcatttgttgaaagtactatcccttttccattgaattccctttgcacctttgttgaaaatcaattgaccacatatgtgggtagattttgaatctattttattctgttgatctatttgtctaacatttcgccaacaccacattgtcttgaaaacgtcagtctgttgttgttctttttgcttttgagacagagtcttgctctatcgctcaggctggagtgcagtggcacaatcttggctcactgcaacctccgcctctcaggttcaaacgattctcgtgcctcagcctcctgagtagctatgattacaggcgtgtgccgccatgcctggctaatttttgtatttttagtagaaacagggtttcaccaggttggccaggctagtctcgaactccttgcctcaagcgatttgcctgcctcagcctcccaacgtgctgggattacaggcatgagccaccacacccggccaaaaagtgtaattttatattaagtctctgacatgtttcttttgcaaaattgttttggctattctactttctttgcctttccatataaatttttcattagattaccaatttttataaaagatcatgctggtaattcgatttagattgtatggaatctataaatcatattggagagaactgatatcttaacaattttgtatctttcaatccataaataaagtgtatctctccattttttaggccttcattgattttttcatcagcgttttttagctttctaagcgaagatcttacacatattttgttagatttatacttcagtattttcaagttttgggagagctattgaaaatagtacactttcaatattcaatttctaattgttcattataaaatatataaatatgatttataaattctctatagtaactttttaatatattcttatagattttctatgtagaaaattatgtctatttgtgaatagaaagttttatttttttactttccagcatataggccttttatttgttcttcttacccaatttcactgactaatatctccaggagtagtgaagcagacatccttgtataattcctgatcttaggggtaaagcagtctcttgccattaagtgtaatattagctataggttttttgtagatgccctttatcaggttgaggaagtactcattctagtttgcagagactgtctgtcatgaatggatgtagaattttgtcaaatgatttttctgcatctgtggcaatgattacatgattttccttctttggtttgttgatatggtgaattacattgattggattttgaatgttgaactagccttgaatttccaggataagccccacttgctcataaaagtattatctttctacatattgttagatttagtttgttaaaattttgttgagaatttttgcatctatgttcttaagggatatttgtctgtagtttctgttcttgtaatatctttatctggttttggtatcagtgtaaagcttgcattaaatattcagttgggaagtattccctcctcttcagttttctggaagggtttggtagaatgtttgatagaattcaccggtggagccatctgattctggaattttctttgtaagaaagttttcaactacaatttaaattcctttaaaatatataggactattcaggttagatatcttttttttttttttttgagacagagtcttgctctgttacccaggctggagtgcaatggtgccatctcagctcactgcaacctctacctcccatgttcaagtgattctcctgcctcagcctcccgagtatgggattataggcactcaccaccatgcctggctaatttttgtatttttaatagagacagggttttaccatgtaggccaggctggtcttgaactcctgacctcaggtgatccacccacttcggcctcccaaagtgctgggagtacaggtgtgagccaccacgcccagtctcaggttaattatctctttttgattgagctttggtaatgtgtgtctttcaaagaattaatccattttatgttgtttcaagaattaatcattctatgttgttaaactaactggcatacagttattcacattgttccctttttacccttacccttttaatgtctgtagtcaatgcaatgaaaccctcttttttgtctctagtcttagtagtttttgtcttctctctttttatctataggggtttatcaattttattgatcttcctaaagatccagttttgatctcattggtttttccttattgactttctgtcttcaatttcattgatttctgctctttattattctattttttttcttattttgtcctactttttctagtttaagatattgatttgagacttttctccttttccaatatagatatttagtgatacgaatttccttctaagtgcttttttagctgaatccctaaatgatgtgctgtgttttcatttagtacaaaatactttctaatttcctattgatttcttcttcaacccacagactatttatatgctaccagcttcttaaaagtggttatcttcctgtactgggattatgtataatgtttataaaataacactctatattttatagcactttataatttacaaagtgcttcatttaatcctctaacatccacttgagaaacataatatttcacagatgttgaaaaggttatcagggtttgagtgacttactcaatgtcacacagagtaggttaggactcaaacctagattttctgtctcccagtttattattctgaagaaattgtaaagaaaggtttgaaaaataaattggaattcaccttgtgggtatttggaaagattcatagaggttctttgaagcaatcattgatatgaggcatctctctcagtttagttttaatttagatttctgattactagtgaggttgaacatcttttaatatttattctctggtatcgtttggctatgtctccacccaaatccatcttgaattgtaactcccacaattaccacatgtcgtgggagaaacccggcgggaggtcagttatgggggcgggtctttcttgctctgttctaatgatagtgaatgagtcttacaagatctgatggttttaaaaaagggagtttccctgcacaagctctcttctcttgaatgctgccatgtgagatgtgcctttcaccttccaccatgattgtgagacctccccagccacatagaactataagtccaataaacctctttcttttgtaaattgcccagttgcaggtatgactttatcagcagcatgaaaatggactaatacgttgtctgttccaatttcttcttttctgacttgcctatttctgtacttagattgtttttctattggattggttggtcctaattgatttgcatgattaaaatattccaatactaatattttgtttactatttgttcacaatatcttctcttagcttcatgcttatctgtctttattacttcaattttgatcgtcaggaaaatctgcactggactgaagaaaatttgtgtgtttattataagaggagtattgctttattttgagctagtatgatgaaaagtgggagatagaagaggatgggattagaagataaaccacttgatttggaaattcaatttaccaatcatttgtcagttgcttatgcttgcatattgcctataattgcttattgcccacagtgtactaggccatgtgatgaatagagagtaaagaataaatgttacctactttcagggactctgatggagaaatatatcatgtacaataaggcagttaacatggtatgtgctcaagtgaactgtggtataagataagctgtggctaccaaaatttctgttccagcaaaggagagtgagtggtttgagttagttgggagttgtattagtcagggttctctagagggacagaactaataggatatatgtatacatgaaagggagtttattaaggagaactgactcacacgatcacaaggtgaagtcctgtaataggccgtttgcaagttgaggagcaaagaagccattagtggctcagtctgagccccaaaacctcaaaagtagggaagccaacagtgcagccttcagtatgtgactgaaggcccgagagcccctggcaaaccactggtataagtccaagtgtccaaaagccaaagaacttggagtctgatgttcgagggcaggaagcatccagcatggaagaaatatgaaggccagaagactcagcaagtcagcttcttccaccttcttctacctgctttttctggccttgctggcagcaaattggatggtgcccatccaaattgtgggtaggtcttcctctcccagtctactgactcaaatgttaatctcctctggccacatccaaaaacacccagagacacccagatacacccagataggatacacccagaaggatgctttgcatccttcaatccaatcaagttgacacttaatattaaccatcacaggagttgtttaagcaagaattctgtaagttgaatgggagcagggactttgtataaaaattttagttcttttcgtctgcaacacttagcatattgcctgacagtgctcaaatatttgttaaatgattgagtgatgttaacatgtgtaggcaaagccaatcatagagacctaacacaatgcatcatctatcattcctataccaccaacagctctgagaatgttctgatacatccacatttcagacattagcttgcatttccaaagaaagggaacacaaccttttcaagaaaaagaacacatgatatgctccctttatcattgtaacggagtagtagttaaaattttgtattgctgactatggccttatagtatagtttgaaatcaggtagcgtgatgcttccagatttgttctttttgcttagtcctgctttggctatgcaggctcttttttggttccatatgaattttagaattgttttttctaactctgtgaagaatgactgtggtattttgatggggattgtattgaatttgctgattgcttttgtcagtatggtcattttcacaatattaattctacctgtctatgaacatggggtgtgtttccatgtgtttgtgtcatctatgatgtctctcagcagtgtttttagttttccttgtaaaggtctttctactcctttgttagatgtattcctaagtattttattttattttattttattttattttattttattttattttattttattgcatcctttgtaaaaggggttgagttcttgatttgattctccacttgattgcttttggtgtatagaagagctactgatttgtgtacattaatcttgtatccagaaactttgctgaattcttttatcagttttaggagctttctggaagactccttatggttttcaaggtaaacgatcatattgtcagcaaactgggacagtttgacttcctctttactgatctggatggcctttatttctttctcttgtctgattgctctggctaggacttccattactttgttgaagaggagtggtgagagtgggcatccttgtcttgctccagttctcagagggaatgctttcaacttttccccattcagtattatgttagctgtgagtttgtcatagatggcttttattacattaaggtatgtcctttgtatgccgattttgctgagggttttaatcataaagggatactggattttatcgagtgctttttctgcatctattgagatgatcatgtgatttttgtttttaattctgtttatgtggtgtaccacatttattgacttacatatgttaaaccatccttgcatccctggtatgaaacctacttgatcgtggtggattgtctttttgataggttgttggattcagttagatagtattttgttaatgattttagcatctatgttcatcaaagatattggtctgtagtttccttttttggttgtggcctttcctggttttggtgttagggtgatgctggcttcatagaatgaattaaggagggttccttcttgctctgtcttatggagtagtgtcaaaaggattggtaccaattcttctttgaatgtctggcagaattctgctgtgaatccacctggtcctggacttttttttgttggtaatttttaaattaccatttcaatctctctgcttgttattggtttgttcagggtatctaattcttcttgatttaagctaggagggttgtatttttccaggaatttatccatctcttctaggtttcctagtttatgtgtgtaaaggtgttcatagtagtcttgaatgatctttcgtatttcagtatttgaagatactcctgttttgtttctcagtgaggttatttgaattttctctcttttcttggttaatcttgctaatggtctatcgattttatttatcttttcaaagaaccagctttttgtttcacttatcttttgtgtcttttttttgtttcaatttcatttagttctactctgatcttggttatttcctttcttctgctgggtttgggtttggtttgttcttgtttctctagttccttgaggtgtgaccttagattgtctatttgtgctctttcagacttttcgatgtaggtgtttagggttatgcactttcctcttagcactgccttagccttatcccagagattttgataaggttctgtcattattatcattcagtttgaagaatttttaaatttctatcttgattttgtttttcacccaatgctcattcgggagcaggttatttaatttccatttatttgtgtggttttgaaggttccttttggagttgatttccagttttattccactgtggtctgagagagtgcttgatacaatttcgattttcttaaatttattgaggcttgttttatgacctatcatatggtctattttgcagaaagttccatgctctgttgaatagaatgtgtattctgtggttgttggatgaaatattctatatatatcttgtaagtccatttgttccaaggtatagtttaaatccattgtttctttgttgactttgtgtcttgatgatctgtctagtgctgtcagtggaatattgaagtcccctactattactgtgttgctgtctatttcatttcttaggtctgttagtaattgttttataaatttgggatcatggtactggtataaaaataggcatatagaccaatggaacagaatagagaacccagaaataaacccaaatacttacagccaactgatcttcagcaaagcaaacaaaaacataaatgtgggggtccttttcaacaaatagtgctgggataactggcaagccacatgtaagagaatgaaactggatcctcgtctctcaccttatacaaaaatcaactcaagatggattaaggacttaaacctaagacctgaaactataaaaactctagaagataacattggaaaaacccttctagacatttactggggaaacatgccaccaatatttcaacgtaggttctttctattttccataaatgtcaaccggctaagaaataaagagaaagagtacaaagagaggaattttacagctgggccgctgggggtgaaatcacatatcggtaggatggtgatgcccacctgagccacaaaaccagcaagttttattaaggatttcaaaaggggagggggtgcaagaacagggagtaggtcacaagatcacatgcttcaaaggacaaaaaagagaacaaagatcacatgcttctgaggaaacaggacaagggcaaaatcagaaactcctgataagggtccaacaaagatcacaactcaaagggcaaaagcagaattactgataagggtctatgttcagcggtgcacttattgtcttgataaacatcttaaacaacagaaaacagggttcgagagcagagaaccagtgtgacctcaaatttcccagagcggggtttttccccaccctagtaagcctgagggtactgcaggagaccagggtgcatttcagtccttatctcaaccacataagacagacactcccagagcagccatttatagacctccccccaggaatgcattcctttcccagagtaatccttgctaggaaaataatttagagatatcttccctacttgcatgtccatttataggctctctgcaagaagaaaaatatggctctttttgcctgaccctacaggcagtcagacattatggtcgtcttcccttgttccctaaaattgctgttattctgttctttttcaagatgcactgatttcatattgttcaaacccacatgttttacagtcaatttgtacagttaacacaattatcatagtggcactgaggtgatgtacatccttagcttacgaagataacaggattaagagatcaaagtaagacaagtgtaagaaattatgaaagtattgtttgggaactggttaatgtccatgaaatcttcacaatttatgttcctctgccacggctccagccagtccctctgttcggggtccctgacttcccgcaacagacattggcttagacaaggatttcatgaccaaaaacccaaaagcaaatgcaataaaaacaaagataaatagctgtgacctaattaaactaaagagcttttgcatggcaaaaggaacagtcaacagagtaaacaaacaacccacagagtgggagaaaatcttcacaatctatacatctgacaaaggactaatatccagaatttacaatgaacaaatcagtaagaaaaaaaaatcctatcaaaaagtgggccaaggacatgaatagacaattctcaaaagaagatatacaaatgcccaacaaacatatgaaaaaatgatcaacatcactaaagatcagggaaatgcaaatcaaaaccagaatgcaataccaccttactccttcaagaatgaccataatcaaatgcaataccaccatactccttcaagaatgaccataatcaaaaaacgaaaaaacagtagatgttggtgtggatgcagggaatgtaaactagtacatccgctatggaaaacagtgtggagattccttaaataattaaaagtagaactaccatttgatccagaaatcccagtgttgggtatctatgcagaggaaaagaagtcattattcgaaaaagatacttgcacacgcatgtttatagcagcacaatgcacaattgcataattgtagaaccaacccaaatgcccatcaatcaatgagtggataaagaaacatatagataaatagatagatagatagagagacagagacagagagtcagtatgtgtgtgtatatatatatatatatatatgtttctattgattatatatatgtgtgtatatatatatgtgtgtgtgtatatatatgaatactactcagccacaaaaaggaatgaattaacagcatttgcaatgacctagatgagattggagactattattctaagtgaagtaactcagaaatggaaaccgaacatcgtatgatctcactgatatgtgggagctaagctatgaggatgtaaaggcataagaatgatacagtggactttgggcacttggggggaagagtgggagggggacaagagataaaagacaacaaatatggtgcagtgtatactgctagggtgatggatgcaccagggtctcacaaatcaccactaaagaacttactcatgtaaccaaataccacctgtaccccaataacttatggaaaaataaaattaaatttaaaaagattttgtacatcattgtcagacaaacctgggtttgagttccatctcagcttcttactggttatatgactcttgattttccttatctataaaatgagactaataataatatctaccttatgggtcattgtggtgaggatccagtgagcaaagtatgtataacactaatcccctaataggaattctataaatacttgctatgccacttctcttgatgtataataaaatggatggaacttgtgattgcttttgaattttgtgacttggttgatgtttcctaacaggcatattctccatctccttcttcacagattcagagacatattgcatgtttcaagacaagaagtacagagtgggtgagagatggcatccttacctggaaccttatgggttggtttactgcgtgaactgcatctgctcagaggtacaatctctcatgacatgtgatttcccagtttgctcctcagcatgccgagaggctttcagtgcccaaatggccagggaccatggatgataaaatccttaaagaaagtaaagaagcagaccgatcgcactgtctcacgcctataatcccagcactttgtgaggctgaggcatgtggatcacttcagcccgggagttctagaccagcatgggtaacatggcaaaaccccatctctacaaaaagtacaaaaattagctgggcatggtggcacatgcctgttgtctcagctagttgggaggctgaggtgggaggatcacttgagctggggacttctaggctgaagtgaaccgagattataccactgcactccagcatggttgacagaacaagaccctatctcataaaataaaagaagaaagtaagaagacgattgcaagaaaaataaacattttctgtcttctgtcctctcttgctttttggcttgattttcatgggttctctgaatatttactatggacagatatttatgatctcttagcctaatgatatagggcatggttagagaaggcagaagagcctgatagtgggagtggaggcaaaagctcaatagaatgtttagattgtaagacaaagtagtttttgaaaattattttaaggctgacctttagggagaatattaggacaaattataaactggttcattgggagagtggattctatgttgtctcagccaataactgtaattaagactgagtttgtgaaacgttggcctgtacctcttaaggattagagctcccttggcttagccttggctcttgtccagtcatttagaaaggattttggttggcataaatgccatctttgcaatagataaagcaggttgttccatcttcttcccatggtcttgacccaggagcacagctgtggtccatctttctcaacaaacctctgccattatatgttaggctagagtttcttgtttgcactatagatatttgtttgggggctgtcctgcgcattgtgggatgttaagcagtatccctggcctctacccattagacaacaagagcaccaaccccaatcctaataaccaaaaatgtctccagacatggccaagttgcctggggagcaaaaatcacccctggtagagaagtggtgcactaggctaattggaaagggaggccttgtactaggcattgagaattctgaacttacacaaagaattttcaagaccagcttcttacctgagaccttttgtaaggactgcacctcttccctcatgcccagctagagcaggaacaatcacttgcaagcctgatccatttaccatttgaacataattttgggctgtcagaattttgagcatgtggaaacataattatcaggtaacatcaggcagtattaagaggctatgaggttctagaataaagacagaccaagtttccagccctgcctctgccacttatgagccactggacaagttacctgacctctgtgatattcattcatcttcctctttttataaatgggataatgatattaccatttcatatggttctgataaggattaaatttacaaatccatttaaatcatttaaaacaatacttagtcttggtaaacattcaagaaatgttaacagctgttattgtcatcattgttgtccttatcattgtggttatcatcatcatcgttattattattaatctattagctctagaacagaattcagtatatagcattaatgaggattcactttagacctcagctgggaggtgtggtttctgatgtgcttcagtgatctcaattcaagattataccacctgcctctgaggagtgtgatacctgaggagcttctgtggtgttgccaaatgcaacactccaaaaaaaattattctagaaagtacacaagaaaaggaaaaggttgggataaggcaattccaatttggataaaagaagcccgcctctttaaatggttagggcatgtattaaatagatcatttggggattgattaactgcctgggatggcctgattttgtcggattcttgacgcgacacatttcgacacgttggagatggacagctaaccattgggagctgaggctttgatgtctgcaacgcagtcaaaatgttaaaatgatcccaatgccaacagctcaagcacaaggcattttctatttctatatcctcttcactactttcttcccccacaacagcctgacaaatacaagtagcccttgctgcaaatgatttatggatggaaaatgtaaatgaaaaatttatttccagactatgtctttgttctagaaatggttgtgagctgtcagagcgaggggtcttgtaattgtaaatcaggcagggacccagtcgccccacccaggcatactacctaatcagctaaattccaaactctagctcgtcctcagaagaattttggctaaaaaggaaatgagaagaatcacttggcccactgggccaaggcagatttatatggaatccaggatccacctgctagggatgcctccttgcccagggctgggtagcagctcaggggacccattgctcattgtgtctttcatgttattggacaggtgattatgaaatcagagtaggttcttggaaaagacatgcagctagagctggggaatggtagaaatgccatggagccaggccagaagaagcctcccacaattaatgggaagctttgaaaattggaggagtggtgatctcagccttagaaaaatatgccaataaactatcaaccaacccagcagaggtgctggtgatgagaaaaggaaagaaaatgttgaatgcattcagcttcttgggaatgcattattcactgcctgggtgagtccctgcatgactgtttcccaaactggcttgatcccagcgacctttgaaagacatttattttttctcattgccttctctttttcagaatgggaatgtgctttgcagccgagtcagatgtccaaatgttcattgcctttctcctgtgcatattcctcatctgtgctgccctcgctgcccaggtaaagcaatttgtctctttctttcctagctgtggttctccatttccctcttcacccaactcaactcatctccataattccccagaagggaaacttccagacagataacaataggaacctttaggcagtccaaactggcctctaaatactttttatagcccaaatggggtacattctaggctctaataagttattgggtacccagtaacagatttttattgggcttttaatcatttgaaggtgggtgtcaatcggagatggaaattgtggcccagagattttctgctataagcagcctcttcctgccatgggcagcaggcaccaggagagttgcagcatggcggcatgtgtcttatacaattagtgctggaattgcatccgagcatagcttctaaattatgagggggccattcataaatcaaaggagctgacccagtgaggtttatgacagtataaagctgcctgcctgctgaatagtcacctcctccagactgcagttattatgtacacattgttaagtgtaattctaaggggcagccaggcagagaatttttcacacaactgttaggacatctactttcacgatttgcagctacggtatttgtctgaggcaggggctccctcaatgacactttgttcatgtctgactggggcccgattcccaccccaaaagcgtgtggagtgattcagagaatgcctgtgggcccagtggcaatcctagaaaaagctacttgacactcttgggctttgtgaagtagaagccttatcatcctgtaagttgattccatttccctttagggtagaaattcttgaactagggttcctggatgggcttttgagggtcagagaaccctttaaaattgcttgcagtttttggtgtaactatgtatatttgtaaattcctttagagaacatccgcagctttattgtcagtcccaaaggggtgtacaggaagaaccactaccccagctaaggtatagacggtgctttttaagtggtgaggaacttccagaacttataagagagaaaccaaatgtatccaggcaaaaatgttaggaataaggctgggaatggggttcaatgaaaacccagtcaactgaaatgttccaagagtggagaatttttttttaatggagaagaaacacccaaactctttttgtcactacctttataaaatatattttcctgcatcagtaaatacaccctaatgaacacaggtgattcatttccagatggcagaatatcatgccatatcacaggtttttaaattctgagtgttggtgctgatagtatatgctttgagatgtcagagattgacttggcatatgaccaacctaaaagttgttgggttttttttggaataagtccctaagccaggcttactgtttctgtatgtgtttatttgcttcttcttcctaaactggattgcaagaatgtggtatgggtgggggtgggggcgctctggtaaatgggaacaatgtttctgataaagttgccactctggagagcttctttgttttttttttttttgtttttttgttttttgttttttgtttttgttttttggttaacctgccaggtagcctgtcagacagccttataaaagctttttattcctcagaagtctccaaaagtggtctaatgtcataggaacttatctaaacttctgtgtaaagattgttcttccctgggaagaaggttgaggcatgacccagacccagagcatggggcaaaacaacatagaatagaatatggctgcacctaccccagctgcctaacaggaagcaagtattgagaaaaagggaaagtataagctagcagttattttgagagaaaaataaagtgttaaaagaactgagctcaaaaattccagaggtgaaagcgttgaaagaaataaacaccattatggttaagacttaaaaagctcattttatggtatggaggatagaaataaactattccttttcttttccttcttgctcttgcagctcacttctccatgagttcatttttcttcttgttaactataacctttaacagctctttctgtgggtagtagttctaaaattccttagtccttatatacaaaaaagtgtatttattttacaaccattcttgaatgataatttggctgggtatgaaattataggtgcatgttcatctcccctcagcactttgaagatattactaaatggtttgttggctttatgtttgtttatttgtttgtggttaagaattctgctatttgtagttcttttgcgggttcttcgttttttttttcttctagcttttaaaactttcttcttttcattgatgcacacaatgagatgtgtaagtttgattattctcttcagcctgctcagcacatgattttttcagccaaaggagtcaaatttctcttcaatttttagtcagttttttttttgaaaattatctcttcaccttcttattttttctcattctcaaaattgtctttggtgtatattattgcatctcatttaatttatcctttatgtctcctaatgtctcctttatttttccctcctgatattctccctaaaatgatatattacttcaactctgttctccaattcatgaattctttccatgcatactatttaggccatgtgttgggttttgtttgtttctttgtttattttcaataaccttgtttcccctcaggttttcaagttatttaaaaagacatctacatgatgctaatttataacctgttattgttttggggaatcttattctcttttttacttctttaaagtatttaaaagtttatttgaagtccatttcagattgttcaaatatctaaatatttttagatgtgaattgtcacctttgttgggtttcttgacagcttttcttagttctgaattttccttggttttctactttttctttcaaagctcattatccatgggtgttttgggtttgttttgtttgtttgtttttgtttttgttttttcttacatgagcccttctttgtgggatggttgttgcaggctttatagttcactttgctctaaaccaggtcatatattaatgactcggtttgggctgcctcatgcctgaatggtctatttctacctctgttttcttgtgcactactagtctctgataatgatcatggactgatctacaactgcctcatctacaactgcctaacttggacaatcagtgttttttagggaacactgagtggggagagctatgtcagcccctgtttacatgcgagtagtgtgaccctagtccccaacttcacatgggaagccacttgcaagctgtagtttctcctcagccatttggatccaaactatccatattcagtcccagctgctgatggaccatatggctttggctcccatttattgctgtactttccttctatattttattccacgaagagtttttttgtgtttctgaatataattttgcagttttcacgttttatttatttatttttctagttccacatttcatctctctttgttttgaaaataacagggagatttctcatgtgttctctttgccatattgaaccagaatgcaaccagctattctttctttctactgaagataaaacaagagtaaatagctttaaatcatagcagagaggagtggagcttgacaaaaggaagaactttgaacaccgtggctgttaaatcctagaataaatgactaaggataattttagtctctttacttaatatttctagaaataaaaaggtacccacccatctgagatagagttggcacagtcctgctttgagacagggcaatggatgtgatgactcctctgtgttccttccaccccagtgattattaggcatgaggaaactcatgccttcagggccacagaaatgtttggtcaaagaaaagggctctggttttccatcttaacccaatggaaggcactgtgatgaaaatgtcctcatttaagaagaaaatatttaaagccaagatgatgaataagctccgtataaaaagacgacaaataagcaaactgtataccccagatactggctttacatactgtcctatagcagtattgatttagagaagcttttgcctaggtggtaacagactcagtggaagtgtcctacctatcatgcttagagcttagtttccattgaaggagacagaggagccatctcatttcatttgtttatgtatttcccatggctcttgctttctaaactcgttacccctaaaatttccaaggagcccacctgtatttgaaattgtctcctacagctcctgctaaaccgtggaaatcagagtatgcaggcagctcttccagaaataccagagagaaatctatactgattcccacaaagagcaaataaattttttttcatcagcacttgtccaagtcttggcagaggtcaagtcttagtcacataccacagtgctctactgggcccaaagaggctacatggaggctggaacattcttaatggaaaagtcaagactgcataggactcatgaacgtcattaaattcatcctggtctctaagcaagactctgtggagtccctgataattaagagattttagtgatttgaaggaattaaattccctatcttctcttttgggggaatgaagtggtaatgctggaagggaaagtaaaacaacatgacttattttcataatatgtgtatgtatatatttcataatatatatattttattttatatatatgcacagagagagaattttatcacaaaaagaagaattttatagtgatcaggagtctaaatcatgatattatctaagagggctttttaaaatggtcattccactgagaatttgctattcagaattaataaatttgggttttcctggaggtattccagcattcctgggttattaaagagctcttataaaattgccaaaataactgatttgatctggttaacagagacctaatccacagtgtttccttttggctaggtgtgaaaaagtttggcactatgaatggttttaataggaatagtgacagtgtggtttgccaagagagacaccccagtcttagatattcaaggtaggttagggaaaagaccttaccagtgttgcactatagtatgtgttcccataaggagaatgtgggaagccctgtgtcatttctctttcaacaatagttgggttgtgagtgagctagcaaacacaggcatttctgccacaatacaatatgcacatatctgaaaatcctcacattctacaaaattgtacactgaaaaatcacagggcttaaggaaaaagtagcattagagaaaaccactcaaaacttaggcaactttgtaaccagaatattaacaaagcaactatactaatgaaatactaacacagtttaaaaaggcatcttacatttctaataaaatattacagtaaatatagacttctagacttcaccttttaaaatggtaacattagcttgaaggaacagtgtttaaggaaggattgaagctgctaagttatagagacaacagtaaattgcacaaagatcacggagaatcatgtaataagcacttacaagacagagcatgtggcccaactgaggcaagaggaagaatgtagggcaaatggcttcctgatttcagttgagttagtgtacttggcttttagctgctgtcacttggtagtgcaaaatattaatttgctgggtaatcatgtatgaactaatgcaatttctattttataccaacttcattcccttatttagcactcacatatgaaccacttgtgttacacaaatccacactatagcacagactgtgtaagatgaggtgggtacatggcatttgactgtagacaagtttagagtaagagttgaaaatcacttgtttactctgaatctgcttttttttgtctttaatcactgacctatctgcccttgtgttccccttttctcccatcccatgtatttatattaaaaaggagtctagagtctaggtctatgactatgtctgtctatatctgtgacttccacagttacagtaatcaagtagacaggccttttgtgtttcctccagtttttttctagggaaggttcaaaagagagatttatttatttattattgtggtaaaagatgcataacataaaatgtatcattttagtgtataattcagtggcattaagaacatttacaatattgtacaagtggtaagaacatttaccactaatctagtttctgaaatttttcaccaccccaaaaggaaacctattacacagtcactctccattccccttttcccctagcccctggtaaccatgaatctacttctctatggatttgcctattctggacatttcacataagtggaatcatacaatttgtggccttttgcatctagtttcattcacttagcatagtgttttcaaggttcacccatgttgtagcatgtatcagtatgacatttctttttagggctgaataatcttccattattatgcatagaccactttcgttatccattcatctgttggtagtcatttgggttgtttccaccttttggccattgtgaataacgctgctacggacatttatatacaagtttttgtgtggcatatgttttcaattattttgtatatacctaggagtggaaattctgggtcttatggtaattttatttttaatttattgaggaatctctcttaaattttaaggttgccccatcttcttttagttcatttctttgagtacctactgccagccatcctcatggttgctgctgatttgctgcttttgccaccatccatatctgatctccattgctctcttctctcttctattctcttctgaattctatattcgtttgtctcttggattttatcaaaacagatcaattcctttttaacagtaacagccaattagcatattgttttccctagtaaggtgactacaatagctgtagtgtgcaagatgatcaaccaggagccactcctttgcctgcaaaagattggtatatatattacacataataattacatatatatatatatgggtccagagttatccaaaagcctgaggattctgaaatgttggtgtctgaatagcagatattttgctttattattattattactattttaggttacagaggggctgccaaaggagatgttcacttttgatcactagaccctccatgtccatactgactgttctcttagacccctttaaccatcttccatgccttatttccactatttttctcatactgttggtccttggacacttgacacagtacaaggggttaaaaccttcttcaagaaagtagcatttgctgggtgcactggctcacgcctgtaatcccagcactttgggaggccgaggcaggcagatcacgaagtcaagagattgagaccatcctggtcaacatggtgaaactctgtctctatttaaaatacaaaaaaattagctgggtgtggtggtgcatgcctgtagtcccagctactcagaaggctgaggcaggaggatcgcttgaacccaggaggtggaggttgcagtgagacaagatcgtgcctacccttcccagcctctagtaaccactattctactttctgtttctatgagatcaacttttttagcttccacatatgagtgagaacacacggtgtttatcttactgttcctgacttattttgcttaacttagtattttcaagtctcattcatgttgctgtgaatgacaggatttctttattttttatggctgaataatactccattgtgtatatataccacattttctttatccattcttccgttgatggaaacttacgttgattccatatcttgctgttgtgtgtggtcctgcgataaacatagggatgtagctatccctttaatacactgatttccctttttttggatatatacccagtagtaggattgctggatcatatagtagttttatttgtagcttttttaagaagcctccatactgttttccatagtagctgtactgatttacattcccaccaacagcatatgagttcccttttctccacatcctcactagaatctattacattttgtctttttgaacataaccattctaactgggctgagatgatacctcattgtggctttgatttgtatttttctgatgattagtgatgttgagcatttttatatacttgttgtctatttatatgacagagccttgatacattagtacccattatgaatctaccagagaggtatatgggatgtaacattgtctaaatttattcagccataatacccattttttggaggcactttgcagaattagggttctttgttatgtgcttcaagaagtgttgtattttgccattcaatttctaggagcaatgtatgttatagcaataagctattggtatatacagtatcttagtttggagaagtttgttagggtagtaggcaattttagcacaagaccctaaactagtactactcaaattttaacatgcttaaggatcaccttgggagatttgataaaatgcagactcccagaccctacaccaaaaatcctgaatcatttaggctgcagtgggtgtcatgcatttcacacaagcatcccagttaattctgatgcagtcggattgaggactgcactacagtaatagggcccaggggagattttgagaaaggaggtcaagagaactgcccacagaaagccgttctgggtaagatcttgcagcagtgggatctccagagggctgtgggcaacatgacaacattgtttcgctgataatggagcacatagacactctggaaacacattttccttgtgtgacatttccccaggactaaccctgcagtaacatgtgcacaatgtgccatctggcctgcccctctgctttcccagagctcccacccaaaggctgcctcttctgccatcttccacattcagagtccttggctgtcatgtccagaaagcaagaccctccgtggggagcttccccctctaccccgcccattgttcatgacttgttgttggcgagaaatgaatggcatttctcggaattagcccaggaatttctgctgataaacaaatgaaactctcaaagggaaaagcaatcaacatagtttgaaataaaatcagtgttttcagcttagtctgtttttaacttagtttgaaataagagtcacatctagggtattttaaggaaaggattagcaaaatgtcctgtagtgggcttttcatctgagttgccagactgacccttgaaccagggcctgttttcttcttgagtaagcagaagaggcaattattaccttgatttcctgtgacctgtgattctgagacctgtccagccatcggatcagctttgcccaagcccacccccacttccctgccaagttgcctgacacctgaaattgtcattacagcttaatcttttaaatttaggccttgtcctgataaattcaccaatctttgaaggtagtaaattaactcttattaatcatttttactttcgtctgaacacaggatttagaaagcagattttgattgtagaaagaggagacaggtgttgcggggggaagatcccgaggccactaagctcagctgggcacctgaagagttacaaagggagaggggcctgttgaaggaagggcctaaggagtcaagctttacctaccccaaagtcctgcagaacaccagtagtatttaggataagttctttatttgtagcagaggacacagtggtttctagaatgagttgccagctctcaagtttttcactttagtgttgttaatttaaaaccaatatgttctcaaagtaaccagatatccttgctatctgttgcctagagccaaagagttttacttcagggttttggacttaaaatgactgtaacccaaaaggtttgccagattatttgcagccactaagataagcaattgtctttattagaatgatttttgtctgatttttgtgtttagaattttataccatcagctattccctaaaagtgattttaggaactggcagacttagggtgtcagttattgaaatctgttccaaaatccgcctcctcacaggactccatttttggccatcaaagtagtctattttataaatgtcttgatgtgttgtcttttgtctttgccacatatactctaagacacagagactgggaagtggttcagcaaatatatgtatggctacttacaaagtgttttctagagttatgctcccagaattggagataggctaagaaatatatgtactgtatctctcagtaaagggctaaatcaaagctgtctgcaggagggggaggaagagggctgcttggattttagtttaattgagaagacagagaaatacgtcaaacttgggagttgaggttattttttggaacatgaagataatgtaagtgtccccacaagctctttttcttttcttcaataaattcatcctgttttgatttcttcacattcacaagattgtgccctcagggatctaaggccaaatcagagtccacactcactatcataccttttatataatatattcttttattattttaatagagaaatggatattgagaaggagaggacaaggaaatgtggcatgctttcttccttgttttctttctttgtttcccttctttccttccctcattccttcctttttattttcattctcttttttgtttaatttgtgattattttcttgtgctaaaaatccataacataaaatttaccattttaaccatttttatgtgtacagttcagtaacattaagtgcattcacactgttgcacaaccatctccaccatccatctccagaacattttcatctccccaaactgaatctctatacccattaaacactaactcctcactttctacttcctgtctctatgaatttgactactctcagtacctcatatgaatggcattatgccgtatttatccttttgtgatgggctttttttgcttagcataatgtctttaaggttcatccaggatgtagtgtgtctctttttcaaatggggaagagagagaagaaatttgagaagaggctggtggtagaaatgaggaagtgaagtcaggagacaaccaaagagtcttagaggaatctagcaaatgttgcttttcagaacacattttttctggaagactccagagaccacactgtctttgaaaatgacaggcctgacaagcagtaactagtattactgcctgtgtgaaatgctaggttttgaaagacgtgttccttattaatgttccccagggaacttcagagagtgtcatctattaggagctgattactggcaagttttgtcatctgcttttggagaaatccataggaatagaacagtacccctgtttctctttatctggagaagtacttttccaaaagggcctcttctgcgattgctttctgagggaaattgtgtctggagccattcaacatagctttattagaaagattattaaaggattagagtatgaaacctatgaggtgatgttgaaggaaaactgtaattactgaaactggtgaaagaaagacaggggccttcaccaagtttcagaaacataaatgggtcttagaggaggctgatcagctttctccttccacttccaaagggggagaaagagtagaagtgagcttcagtataaaaaacttaggcacaaaaaagtagttccaggcatagataagggaagctgaagtcattttacagtcaatatattatattaatagctcaggctcaatgctgagtaaacacaagacacacataaatgcacaaacgcatacaatatgattccattaatatcaagttcaaaatagggaaaagtaaactatattgattatggatgtgcataaatgtgataaaactacaatggaaagtgaagaaatgattatcacaatagtcagcatggtggtgagttgacctccattggggggtggtgcttctggggtgttggcaatgcactctttcttgatccacgtggtagtcacatgggtgtttgctttgaaagcatcagtacaactctacatttatgttgtacgtatgtaagttatatttcccagtataatataaagtgggattacattttcatttgttcttgatggttctgattggaggcaaaagtaccagaagaccttgcaagattacaaccaagcataggattctgtatgtgcatatggcaatttgggggactgttatatttgtctacttgtttgcattgttttggtcttcttgatgtttggttttgtgtgtgtgtgtgtgtgtgtgtgtgttttgttttgatttttttttttttggtttttggtttttgggtctttttgtcacaaagaatagcagtaccaaaacctagagaaaggtgtgctccttgtcctctaagtgggctcttggaattagtaagtaggcatttgaggcattgatttctaagctgtagagtgcacagtgtattggcatctggatgaagccatctggctccaggattttatcactgaccagagggccagagggcatgtttggcttccaggaagtcaggctggtcaggaacccctttgggaaggaagaagggctttggacctgtggagtatgcctgccttccctcaaagtgaggttttattgtgttatcatggggggaggaaggcagggggggccaataaagagatggggcctcgctctgctgtccttccagttcactgtgggacattcacagagctgattaacctctttgtacctattttctcagcttgtaaaatgagatgataattcctgccttctcttaaagtttgcattgacagtgaacaagaaagttgatatgggaaattgctttgaaaagtataaggaggtatatataatcaaggcagtgatcagcaatgaaaagaaggtatttaaatcctgggtccccagatttcatctgggcatatctcaatatgggcaaagcctgaaaccatagcattttggtacgtgttcctctagatcccaatgatagcagcctcataaccaggcattgaccatgtgtctccagcctcagggaaaagatgaggggagtctaaaggaaacaagtgacaggtttaatgactgtcaggcaaaaggcattaaattaatggcatcacctctgccttgcctttctatttccttctgattagattttcagaggtgcctgtgtgagtatgccgcacaataatgctgatgttctcaaagctgagtgagctcttaacagaaacataaggtagtgctgagaatgcactcagagacaaggtaaaaatctctagactgccttgagaaattgaaggggatttttctgggggagggctagaactgatacctcctccctcctaaatcataaaaagagagagcaagattcaccattatgtgttgattaggctgccttactcctgtttggttcctaccttctgctaatccgtggtcttgctagaggctgtcatctggcgcctcttgcaggagcacagtgtgtccgtactgcagggggcctctcagaccactgggatcagggaaatgagccattgctgtagtgttacttccaaaccagggaggatcagcacacacacacaccctttctgcccccaccaacttctccagggctttagaaatgtctgggaactgttttgttcgtcacagtaatgggaggatgtcattggcatttagtgggcagcaacaagagatgcaaaatgttccacaataagtaggaacacaacgcatggaagaagtgtcccacacaaaattccagtggtggctctattgagaaatactggacagcagccttagtcagagaagcctagtgaagggcgtctcttcctaaccagaagttggtggtatgagtccacacattcattaattcactcactcactcatattaatttcacaaacatttacagagtataagctttgagacatagcccatgtatggtgctgaggtttcagagttcctgcctcgacgagttcacaatctagtggaggagacacgcataacaagattattaaaatgtaatgtgatgagtactctggtagaagtgtggacaagggctgtgcaggcagagaggggagaagataggcactctccaagagccaggaatcaggcacagtcccagaggggagtggacatttgagctgggttctgacagatgaatggcactttgccagatgtagaagagggaggtggggagggcacgtgcagaggcatgtgtgggatccgtgactgcagttgagtatggtctgtgtaggagggaggaggctggaaatgtcagattgatggaggcccagtctcaaaggaccttgtacatcctgtgggtagacattattttgcagagccagcccactgcaaaagtagggaggaggtgcagtttgtctttagtgttcttggatgtctttttgcatcccctttcctctcttgcagtccctcatatcctcatctctctcccagccacttacaaaggcagctgatgagactccttccagcagaaaggtcaatgcttagcttaactgtaagaattcactaaggatagatttctggatgtcaaagggagagtctttgggcagagaacctggaagaactgagcactatggagatagggcagaggagctttgttcagtttacacacacttgatgtaagtgtaagtgtatgtaagcgtgtgggtgagcatgtatgttggagtgggtgacattgtgtggtatgtatgtgtgtgtgtgtgtgtgtgtgtgtgtgtgtgtgaatgagagagagggagaaatgggacaatgatagttcctatctcaaaggactgttgtgaggattaactgaattaaggtatctaaaggagttagcatagtgccctgcccatagtataccctcaataaatgcaaggtattgttggtattattttagaatgcagggccagaattcagtctggagaagggggaacatgcttactaccaagatggagatgaagattttacactaaggcttagtggctacgtctggctagtttcaaatatgtgcctaggacacattctatcactgggataatataatttttcagcatgttggcttatcagaatgtacatgttcccaagtggagccatagcattacactgtatatatttgggtactttctccatctctactcatggaacacatggcaggtagaaagctgttgttttacaaatgacgtggacctgtcttgaggcccagatcagctgatctgtcctcatgtatagcaacataaaatagaagaaccacagcactagggccagagccagggagatgcattagaaaggaattaacttgggaggatctgaattagggaacaaaagtactagccagagaaggaaggaagaagcaaaaagggggaaaaaaatcactaaaaggacaggatacataagatcatccagctgcccccaaactgaacttacaatgttttctgtgttctctttggaagaggagttggcttgtccagaattcaatggaaacttgttgattgacactgaattgggcacaagttcaatgtgagtgcgcctgcagctatttatttgattttttaaaaatgcaccctttgcagtaagactgtttagtttctactggcgccctggggcagtgagtttagattgttaaaatagcagccattaacactctctgtgttatgacactgtccttcctaccccactttagaggaatcaggcatgaggttgtttgacaaaagtttaattctcctctccccaccaaaagaaactgagattcctcctctgagtcagaggcacgtttgcccagccctaaccctgaaaacctccaagtctgcctacccgcctcaccaccatccccacaaacacacacacgtgactctcatgtacatctggaacacacacactttcacatacactctcacaggctcacacccacacccatcccacaagctagaggaaccctagggagcccttgtgcttgtcttgctgttcttttgttttgctttcctgtatttgctttgttttgatttgaaatcagtctttgggattacattggataattttttcatgttattaatagtgctgtgcagggagcatgtaaggacttcctcctcagtcctggccatgcttgcttccccaaatacaatgctgactctcattgatcaatcaaactgatctttgtcagactttgcatacaatacctcatgggcaaatagctcagggagctctaaaagatgcctgaattctgggattatctagattattcatgagtctgcttaaaaggaaattttttaaggcaggactggatagctatggctttcccaaaggccctggggaaaaatcaaaggagcagagacaatgtggaaagtgtggaactgctcagctcccagagcaaggcaataatctgaccaaacactaagcccccacccaaagtcagcattggtcaggctgaacagccatcatgagcacaagcctaggaggcatggaagggaagttctgtgttctctggacatctgtgatacatgttgtctataccagcactgtccaatagaactttttgcaatgatggaaacattctatatctgcactttccaatgtggcagccattagtataggtggctgttgaacatttgaaatgtgactggtgtgagactgagaagctgcattttaaattggatttaatgttaatcggtttaaatatgaatagacatatgtgactagtggttactgtggtgtatggcacagctttatcccattcgctggatacttctgtgcggcagtgaatttaattttgtacctcctctctgttcagtgtcttgcaactacatcataaactttttgagggcaggaatcatatattgtacaactacagaaagttataccttgaaaagatattttttttcagctgcctctccccatatttgacaaatagggagactgcgaaagactctgtaactttcttgaagtgacagcactcattagtaacattacctgagcctggaacccaggtctccttgcctcccggactgtgcttctaccacatctcccttgcagacaagttttcgaaagaggaagagttttcttcctctccactttcttcactgtttatatctgagattcagcccctgatacttggaaataatttggatctcaagtctacatttatctcctcatctgccaaggcacaaaataggctctggacaaatgtctgtggggtgaaaattctctgaggtctttctgttgtctgttatcttctatatttttaaagaaaatctttttctgcctcagtgtgtttgagacaaccattacttatgctgtttcagcccagggagatggggcctctgtagatgtggccctggcctgtgcaggtgctcaggtatacattagagaagcctgtgcaacagcctggcaggctgataaaaaagctgtagcagtttgggacctgggcccctctgtcttctaaattctctagacttgatggtagacaaggatgccatcagacatagcgccctcccttcaccacattttcatagtaacctagaactaaagatgcttcagggaggagtctagggccatatcttactggttactttagaaagtaagagaaaatacccagtagaaactaacctcagaatcacctgctaaaagaaagaataattcaacttgtaggtccaagtaaagtatcctttcatctctcttctcctttctctgttttccaccccaggcctttgccctcaacccagagccaacctatggtaacacagcaatagctgaattgaagcaaaacctgttaacagtcaccaaaggctgagtttcggccaagcagatagctcctccaggcagcccttcaaaagccaggcagaggcaagggggtaaatagcctgtggcctatctgcagtagaatggccagatggtttgctggtgccaccaaatgaaggagtgatctggtactaagatagaaggcttccagggaccctcccagccctaaaaatcttaagcccaagtgtagtcatcagatgccaaggacactggagaaagtctttggagcatgtagaacaccaagccaattggagtgcctgctaggacagcacaggattcctagaattccggccacaccatatacacccccacccccagagggcagccagtggccacagcagaggccttacccagcaggctgagaccctcatcagaccctccaagagcctacttccttacttagggcctgcctgcttgcactgtgctgagttcagggaggtggacaaactgtacctcccactttagcctaagaatctgacttgccatggactctccaggcagtgaatcattttgagcaagcacttaagcaactttccactgagtcattctgaggactgtcaggtttgctaatcctgatatatactgtgtataccctttgttcagatcctatacccatcctgatattggaggagaggggttataaacaacagaactttaaggatgtgctcattagaagtcatttgtattagggttccctttgccctactgactctaacagggcctgaagcactaagagaaatcctgctggtaccaacttttgatttgtgtatgcttttggttacatagctatcaagagtatgtactctttacctggagtggcagtgcacattggatttcttttccagaccctccatggatctgttttcctttggcttcttctagactaggggccagcatttctttttttctgtaaagggccaaatagtatatatgctagcattagcaggccttgaagtctctgctgtagcaactcttgcattgtaatgtgaaagcagtcataggcagtatgtaaataaatgggcatgaatatgttccaataaaactttatttacaaaaacaagttgcaggtcatatctggcctataacccctgttctagacacaataggctaagtcaaattagtagctgagacttagtttcagctgctagagtgcttaagcatatcacattggggaaaaaatcactcttatcctccattcttttggggaagagaggtagaaattgcaggaatattttcatctttcccattttgaatatcaaagcccattcctcatcaaatattacatactccatagtaatcagaattggctaaagtatgatgcagtagcaacctacaaagttcaggacttaaaacaacaaagatttatttcttactcatactacctctttgtcttaggttggtgcctgtcattatcaccaacagactctggctgacagtgccgcaccatcgggaatttagttccagcactatgggaagggaatataacacactgtggtctggctgtttaagacttttggccaggagtgatacagattacttctgctcatctggcattggccagagcaagtcacactaccatgacttgacttctacaggacagggaaatgcaatactaccatgtgcctggaaggaggagaatttgaatattgatggaaagccctaatgacaatcacacactctaagaactccttttcagtttcttcttcatgtcattccttgcctacctttaggttatctggcctagttgtatcttttgtccaaccctacctggccttcctcagacatgctggtcattgacattgatacatgggggagggacaacttagggactaaagcattgggacagtaattattccctaaaatgctgtgtagaccagcatgaacatgaagtcaggcctcagagccaggtcttacatgccgttggatccaagggttgattgccattgggcagcaagcctgagaaaaattggacctcccataactctggttttgatttcactttagtttacttttaatgagaatttgaatcagagaggaagttctaagcatattgactttaggcagtgccttcccttagtgctatggagagcagttatcaagagggaagaggaatatggaatgtgaaaggtagaaagtataggtgatattaatgcagtattatgggctaaagtgaaacatatggcccatgattttagaagaaggaatatatctgcaaagacaaaataattagttgggataagcccattgctctaacaatccccaaatcttagtgactaaagacaatgaatgtgggagtggaggggcctatggagagggagggcttttgctccatgcagtcattcagggacccaggcccctttcactctagtggtctttctttcctctagagtctcacagttcatcactggagcctctggtatgtggtccttagtttagggaaaagaaagcaaggagagttttgcaggacgttttataggtcagtcttctaaggcatgtttatcatttcttcccacattcaattgactggaactcattcacatggctccacctaactgcaggcgagactatggaatgtagtgtagctgggtgccaggagtggaggatggagatgggtttaatgagcacacaacattgtgtattccgctgcatacttgtcttgagcaagggtgattttttgtaggaagggttcagtctgactgagtcttaactgaagtcttcatcaacatactctcaatattgaaatgttttccccttacagagcactgtcggccttggttgaacagaagactagtcctgactgcagaggccttagataaatgcaattttgccagtccttacattttacttcataattcacatggcctctggacagatatgtaagagcacttgcattctcattggtacaggtttgggatatgtatcctggggcaggaacgtgaaatagatgacattcaatggtatcgtgagcaatgatcctaggaaattcattctgaatcctaaactgggcgtaaaccattcttaaaaagtaaaaggaaaccattaaaattggaactacataactaatctttgttccatttttggcctggctaccagggcattcagagtcctttaacacactcacatagaatacatagaataattatgttaatcctattcattgtttttttttttttttgaaggagtctcactctgtcacccaggctggagtgtagtggcgcagtgtcggctcactacaagctccacctcccgggttcacgccattctcctgcctcagcctcccacgtagctgggactacaggcgcccgccaccacgccgagctaattttttgtatttttaggagagatggggtttcaccgtgttagccaggatggtctcgatctcttgaccttgtgatccacccgcctcagcctcccaaagtgctgggattacaggtgtggtatttcttatagctacttctcggttcaggtgttttctattttcaattacttcatgatatatgttgtttgttgagaacaggagaaaaaaataaggcatggcttcttcttgttttatttaggctcggtttgaagactggcatttgtgaaaaagatttttctgtgtctatcgtgacttcctgagcagttggttttatatggtgtagttttggagatgaacttcagctgaaagaaaggctcaactctaagtttgatgtgagccaaaggagtgcatcacctcttcaaggacagctagatctttgctgtctaatctaaagctgttcaccagaatggagaaagcacttttatgttccttttctccctagctatatttcaaacatttagggattagatgatttgtatctattattttttctagtccagagcttcgcaaacactttggggccagataattctttgtcatatcgtctatcctgtgcattgtgggatgtttagcagcttctctgacctctacccactagatgccagagtacccttctcaactcgtgacaaccaaaaatgtctccagacattgccaaatgtcccctggggaaaagttggccccagttgagaactactgtagttgtaaatttttttttaattgggggtagataccctcactttcccagaatcctgttctgtatttgacatttcttgcagagatgggagttggaaacaaaggttatggatgtcagggagctcagttctaagattgcctgcatttatacctccctggggtgtggactcaggccatatggaacaaatatgacatatgtttgtccagtacgggcagtaaaaaggcttctcaatactcattaacctttgagaagctgacttgtttctacagcattattgaaggttctgaataagatgaactcttagaatctgaatcactgggaatcttcctgaagtgcagatgatgtttcagtaggtctggagtgtgggtgtgagattctgcatttctaactagctctcaggtggtattaatgctgctggttcccataccacactttgagtagagggttggtggtctctggagaagaggagctggctaactagacactatttttaggttctgcagaaggaattgttctttccaagattattccattggcccagtaagtagtgaagtaatctgcagttcttaaacattccctccttctcctctcaagaaggtacaacccacagtgatagtctccctgctctctctttcattctctgcagccatttaaggctaatatgaggtaagctagtcaagtacttccttttgattagctaccttatattttttggaccttctgtgtgtccgtgtgtaagagagagagtagtttcctttccagaggaaatagtggggataacttcggaaaagccattacagtgtcagaaataggtggctattttatcctagctggagtttcagataatggaaaatccatctctagaacaatgtagtatagctccacttctgggatcacttctggttggccacttcctagcctttgtttcctcatctataattgtagataatagcaataatcaccttagagggtggacatagggagaaaagaactaatgaatatcaacctgaagccctgagcacagaaccagctcagtgtaagcatgagccagtaaatattagttcctaatcttattggtgtggttattgtcattattggaactgggatcctcagactctttttgcctctaaattgtttgcatatattgtactcctatcagtgacatctttcatcatgtgcagtgattctcaatcagggatgaggtggtatgtggagtttgaaaccactcccaccagacaccatggtctccttgttcctcttttgagggttattggtctaagcaatgactgaatctcatattgtttttccagccttggtaagtccaaagatgataatataccttatttatttgtttgatctctgacccctatcatcacttttcactctaatcactttaatatgagcatctggctgccaaaagaagcccagtttcaaactggaaatttttattaatatttgacatatttttacttttcacacctttctttcctaaggaattgtcaccatcccatggcaatcaatggtggagttctttagaatccagatttcctaacaccttccctttcctttctgtgtattgtgtagtcttaactaaataactctccccacatcaggaattttggtctgggttcttaaagaatttcctaggagaagcaaaatgatactttgtcttttcctctagtagttccatgacatggcagatgagctgcctccttggtcgtcaggaagaggtagactggattttcctaacagcgttcccactgctccagcagcctggagccttgtgtgccaccactttccttgcaccctctgccagtggcctccagggaccactttctgaagccagctgctaacagttttccaaacaaaataatatgtgcattgggggataacttttctcaattaatcttcaagtaccaaatgcctcttttcttcctttatgcctaatgtgatagcaatgggctctttcagtcacctcctgacatatcctgtccccgagctcattatctcttttccagtcatctcagaatagtttttcaaaaatgtaaatctcatcaaatcatttcactacttaaataacttccctggcttctcatcatatacaggaaaaataccaccccctggacttgacttctttgtgtctccaggtgcctgatgtcattgggctgttgttgcaagtggttctggttattagcactatacagtatttcacaggggagcattttctcttgatttatagggcttgctaatgaaagaaaagatactggagatgctatcagccatctaggagtaacgtgttaggtcttagctgaaggttgagtgtgactgaagttgggagtgcggttctggattcagcagataatagtgtccatgagatggcgaatatccagatcctcaaaatatctaggttttgatgtggtgcagggcagtgctttccaaggagtgtttctggggcattcatagttgttacctaggtgaaaaaaagagtctggtggataagtaaagtcagagaaaatgctgagttatcattaaacaggtttctttactatgggacttgtgagatccttttaacatattgaaagggacactgaatgttgaatgtggatcttttcccaactttatttaagcacagaattttgttttcacagagcatcttgtggactagtagtgctctgcagagcagacttgggaaatgctggtgtaggcaatacaaaggaatgcttgactgaactccccactgtctcatccagatgcctcacattgtttctgtaaatgctgcttgagggtaatgactaatttgtccatttcaaagggtcattgaccttcaaaaaaaaatctagttctcaaaggattagaactaaccaagtaatagtagaactcattcttaatttattcagggagaagaggaaggcagtgagtgacaacattaccacataacctgttattaacaatgaggcatcgtgaagaatcattgatttaacattacacctcctggtaattagaggtttttaaaacccatagtacagtagcaaaggaataatacaaatctatcagattcaccatggaagggattctttttgttgggctacataatccaagttcacatgaagatttgaggttgaggaattagcctctgaaaacagagggatttgtgttttatcttccgcaattattagactggattttagtgggcttctctagccctcacgttttgctgctctaggtaaaatgaagagacctaaatttgaatctttgctttggcactaaatagcagtgtccccttggcatctctgggcctcatttccacctgtcaaaagagaaggccatttccagtttcctcttggagatagaaccctaggaggcttatgtaatgagattggaatggtccatgagctgaataatggagctgatgataaagctgttcagtaaagtggaagaagaaattttgacaggaaagaacatagaggttgcctctgaagactggattatgagaaacttccacaagtaagtactctcagcacacagaaagctgaaaacaagtgtgcataaccttagagccacagaatctggacagagttgtttgcagagatctcatactgctgaagtgaaatcctcagcccccctgctttgtatggcaatagagagggtacttcttttgggtcatgaaatcctgagaatctgattgaacccacagacccttttcccagaagaaatcgattctgtaactcacttctgaatcacttttgaaaatcatacttatttctctccagctatctgcccttaaatgaagaatcaccttgcctctagatatgcatatttatatgttaatgaaattaataccagactcttaaaattagcatgtatcactatttgaatatttgttccttcttgccatgctctgttccttttttttttttttttttttttttttgagacagagttttgctcttgttgcccaggctgtgcgatctacagcacaggctgtgcactgcagcagtgcaatctcggctcaatgcaacctccgcctcctgggctcaaccaatgatcctgccttagcctcctgactagctgggattacaggcacctgccactacaccaggctaatttttatatttttagtagagacagggtttcaccatgttggccaggctggtctcgaactcctgacctcaggtgatccacccacctcagcctcccaaagtgctgggattacagtcatgagccactgcgcccagccagcatgctgtgttctaatgctagagccagcaggagatagagaagtagaaggcatagaccctgtctcctttgcacttattgatcacttaaaaagcggcacactttatattaggtgctagatggtaggatgcaaacaggcagaccatgagagttgctgcagaaaatcagagtgtgtttgatgggccctgggggctggatatgagtaagcaaagagtagtctgtgggggcagttggggctagcatgagtcagggcagaattggccaatcagaggtagagcattctttagccaagtggcacatcctcaggggatacatctttgacatgaacttcatgaccctggctgggccatgctgtggtgtgggtccgtacatggaactccagtctttggggtgtgcttactcacaagcagttgactgacactgcaagactagagttgctacctataaggcagcacatcacaagctgaagggacttttctaacttctatgggatgtagtaactctggacactggaccatcaaagcagacaaaattatacatctctttttgccttcaggtagaatgcatttggtaagcagggagataatcataatcagttgactttgttgtatgttgcttctttactccctgaatctttttgaaaaacataatcatttttgttctttataatatatccctgtgaaagagaagcaggtgaaatgattacctctgacacacacatacacatatccacacagaaagttctttagaaactgaagcctagagatgcaaagtgatagcagttccatcacacagcaaacaaatagtacaacttagctaagaatacatgggccctccccctgccccccaaaaaacccccaaatctatgccatttgcaagcactctttgcttcacagagacatggccctttcttgcacactctctcctcaagccatccttcctagccatctgtctgacaagacggcatattcaggcagggtcagctactgactgacagcagctgaaacactgacggaagtgggatgaaaaacagcctgcagatggggtccggatgaggagggggagagctgggattagactaggatgtgagctttcagcgccctcttccactctcttctcgccagctggagcagcagatgactgtttcctctcactcggcaccttcttggttgggacagagtgttgtgtctgtctgtttagctgcagagtgatctgttgaatctgctacaagaatttcctggcctgggacctcactgggggttgggccaagggtagaagtagggaggccactagtcttgttgaaggtgtggtcccacagagtctcctggaagctttcaagcaggaaaatcttccccccatcaccccctcctttagctgagctgtctggctgacccactccatctcccaaagtggatacaccacggctggggacactaggcaaaattatgacttgagattgactccctctacccatttgtgattctccctttctttttaatttacctttctcttcttcaactgcctatcacctacaaaacaccttcatttttttcaggcccgctccgctctgatacccagtctttgtgtttgtattgtataacgtttggaggttattttttttttttggtaacgctttattgaggtatacatacctcatactgaggtttacatactgtaaaattcacccttttatgttgtaaagttggttttagtatatttacaagatgttgcatccatcaccactatctaactccagaatattttcgtcatctctaaaagaatcccatacctactagtagtcactcccattctccccttcccccagctcctggcatccagtgttcttctttctctctctatggatttgcctattttggacatttaatgtaaatggaattatacagtatgtggtgttttgtcactggccttttttttcacttagcagaatttttcaagtttcatccattatagcaataatattacattttatggatataccatattttgttcatccattcatctactgatggacatttgcattgtttccatcttttaactattatgaataatgctgctataaactttcatatacacatatctgtttcagttccttctttcaatttttttgtgtatatacctgggagtggaattggtggcttatattggtaactctatgctcaactttttgagagactgctagattatcttccaaagcagctgtactattattatttttttttacattctcaccagcactgtataagggttccaatttctccacctacttgctaacccttgttattattgtcttttttattatagccatcctagtggatgtgaaatggtatctcattgtaggattccccccaatagcgcctttctctttactggggaatagttccagtcttgtgtattcatcactgtgaagatattaaacctctgggaaagatagggcccttctctaactaatgattgaatctgggggcatatcaggcattctggcagggtggagaggaagagagtttagggacatggtgaacttgccacctttggaagctctaccatcgcagaagcaatctgctctattgattgctttcccttcccacaaagagaccatcaagtgcagaagtaatcaagtgaagttttcttgaaaaggcaagacaagagctgggcaacgaagggtgggaggccaaaggatgtatgaagggggaaatggagaggcttcctaaactaaaaaatattaaatcctttctgaaaagcaccttcagtagtgacctaaaacaaagatgaaagtcaaaccaatcaacaattacttttgtttagcaattctggaaaacatgttgcaggagaggacactggaaatgatggttaaaatacggtgggagccatggcagttcaagcctgtaatcctagcacctcaggaggctgaggcaagaagatcagttgatcccaggactttgaggctgcagtgagccatgatcacaccactgcactccagcctgggcaacagagtgagaccccaactctaaaaataataataataaaataaaatacaatgggagtgttggccaaggagttcactttttctctctattccatgccctttaggactactcataatcacaaatacatttgtgacccttctgagcgtaaatccacctgtctggggtgctcaataagtccaaagtagagtctatgtgcttggtaaatggctctggctagaaagcaactgcttggctaaatcacacctgacggtcttcccactgagatgggaaaatggggcagatagtgtttgcccaggagctggggcataaaaggattcttagtggatgtgatggctcagaagtgaatctctagttaccacttgggatctgacagtttttgagaagttctacagggctgtgaaagactgcacaggggtaaaaacaaaccttgtcattacattacaggtgttgagaatttctaaaatttacagtatataatactgattgaaaagtaaatgtcactgctactttggagttcagcataagccttatacagaggcagggtctgccagtgtggtaagaggatggccactgtaagggttaagtagccccacatctctttccctaccagcctgctttctgccctccagaaaccctatcatttatagctagtagtaaaagaacaacaattgcatttattgggcattaatatgttcctggtactatgctgaacagattatgtcttaccttgtttgatcatcccaacaacctatggggtaggtaccattatcatcccaattttatagatggagaaactgagactcagagatgctaagaatttgctcagctaataagcaataattagcaatggagctttaatttgaatccaaatgggacactctgaagtaaggcttctcctctccctaggacaggtcttggaagctgcatttttagcaagttccctcattcaggtcttaagttctagaaagtttcacactctttacccggtgctctacagcctcattatgaataaaacatcaaaggcctatgttacaatataattatctagaaaaggaccctgttttaaaacattatctaccattttcatttcagtatgaattacttaacgggattagtattaaggcctgccagcatgacctcaatgtgatgggccacaggagagttaagttcttatgggggaggagagtttggggaaaatctagaaatcgttggactctacccgaggaaagcagatctagttaagtcatcacatcaagaggcccaggggaaaaagaagtgatggcagttgaagtgctgaaaaaaaaaaagaaatctaaaggtaggcatcattgattcaactgatgggcccatttgaagcagtacctctgatctcagggagcatcccaaggaaaatgtcgtctgaatccacatagcctcagaatatgagcattgttactttttggaggtggggggaggctgcagacacccactcttctttgtttttgtttttgttttgagatagagatttgctcttgttgcccaggctggagtgcagtggcgcaagctcagctcactgcaacttccacctcccaggttcaagcgattctcctgcctcagcctccagagtagctgggataacaggctcccgccaccacgcctggctaattttttgtagaaacggggtttcaccatgttgactaggctggacttggactcctgacctcaggtgatccactgccgtcgcctcccaaagtgctgggattagaggtgtgagccactgtgcccagcccactgtttttgatacattcatcctgcaagatgtgttgcatcctggatgtatgctcttactttgcctgactgagatgcagctagctcccagctgctcctccctccattacagcagtgctctggtagaaggccatgggtgatttcccactagcaaccttatttgtctatgttccttccatttgggccaaggactaaaagccagctcagatttacacaattactttaacattgtttaagaaagcaatgtaacaacctccactttgcccagatggacgggctcaatgatgtcggtggagagaacccattattggaataagactgggaacacaaagtcatagctaggatctctcccactagtaggaatacagccgggcttctgatgaccagctttgtaggattgattttctatggttggaatggacccaaaatgttcacctagtctagtctacggccttcaagtagaagttttttcaaacgtagtcttcaaatttaatgaggaatacatttatatcattcaagaatatgaatgcatatgtatatgtacatgtatatatgattatatatctaggtatacatataaaagaatgcaatagaatatcttattcaccccgtcccacactcacccaattcttatcttctccctacaacatgtagttcccccccataacttttagtggttatatatctttccagatttttatgaaaatgtaagcaaatatgaatatatatatatattttaaaaatattttttcatttacataaaaggtagtctattgtgcacatcattttaccccttgttttcatcatttaataatatatctttctgtattagtgcacagagaacttattcttttatagaactacataatattttgttataataatgagccatcatttatttaaccagatttctatcaatggacatagaagttgtttccatattcagccattacaaacaatgctgcaatgaataatttttatatgtttcacacatgtgcaagtatatctgtagaatgaattcttaaaaataggattgttgggtcaaatatatatgtatttttaaatgaacagatattgctaaattgcccttcatcatgttttaatcaagtcttcacagacttaccaagagagtgttttattcaaacttttggatttttctaaatctgctaagaaaaatggtatttcattgcagttttaatttatatttctctaatgaatgaggttgattttttcatgtctaagggccacttgtagttccatttctgtcaactgtctatttatatcctttttccatttttaccattgggttatgaatctgtttcttgtcaatttatagaagctctttatatattagggacaaataggattttaatccccaaacagcaaatatgtgaagagattctattccagtgttttacagtgtcttatggcagcaaactctttcttcaaatgaaatttaaaaaagctaataaaaacacatttcactaacaaagtaagaggtattctgttgaagtagaaatggggaagggattttttttttcacatccctcaagtacctctgaagaatcctaaagcagcacagaacctagtttgaaaataatttccctacatgcctagttggcctgtggttccagtttctaataactctttcagcaaggaatcttttttagtatctaacctgaatccttattgatgcagttgatactcctccccacttaacattggcaatttgtgattatttgacctctcttccattatgaacctttatgtgttatttaaatacattatcatttaacacctttttgtgccttcccctccaatgaaagcaggattttacttgaagtcaggggaatgtcctatttatctttgtagctttaaggtaacataatgccaggtattgtcaatgtatagtcaaggatctattagtgccaggtatagtcaaagacctccacaagtgcttgttgaatgaataagaaaacaagagagaaatagtgttttgactcatgtctccatagcacctaccatacacatcagtgcaaagcaaatgcctttcagttagttatcatctatggaaattgggaaaattccttcatattcttcaactttactgctttcctctctgtgacctctttctagagcaagatcatctaccatttattgtgaatgttatgtaccagatacctttgggctttttaaaattaattatcgctgaacctcacagccacgtaaagtagaaggcatactcaagccttcctaagatcacagaaccaagacatgccaaagctggtgtcttagtctgtttgaactggtataacaaaacaccacaaactgagtagcttataaacaacagaaatttatttctcacagttctggaaggtggaaatccaagatcaaggtaccatcagatttgttctctggtgagggcttggcttctggttcagtgatgataccttctccctgtgagcctatatagtagaaggggcgaacaagctcccacaggcctcttctattaaaagcactaatctcattcatgaggatgttgcccttataacttaatcacctcccaaaggccccatctcctaaaagccatcaccttgggggttacgatttcaacatatgaatttcagaggcacacaaatattcagatcatagcagctgggaccccagagaccaatgtttgcagaccccagagaccaggctcagttatcttctcttgcatcactgtgagatacgcacatagaaacagcatcctattctaggggtttctttcaaggcctttttgtcattctctcttcccatatatttctgagacttggggtaaagccctttagatgatgtagttttactttgttggatgtgtatgtctctctgtgtgtcatgggcaattaaagggactataacctcttctttctagtctttaccttcatttccatgtcccttctccagccacctcccaatagcctgcaaatgttctaggactctatcagtagaatgacagagaaccaaagaaatgctagcatcaggctcagccatcagaagaaaagtaggaaccaaagtaatggcagcaatggcaaaagaaaagatggcttggcgtcaaggagattagcaactgatctctgaaagctctggggaggtttgtatttataacactgggagcagatttgtctcctgacatacaagctgcttttctgactatccaagaactgtcctactatggaaatgatcattttatagggtggggagagtggggaagagagcagtcagcatgaggacttggttccagagtgtgggaagaagggtaacaccaggagaggagggaaggcgtacaaaaagaagtgaagtggaaccacaggcttcttggtaaaatttgccagttgctctgaaggacaaaaaaaaaaaggcctgtggcagttattcagactgaggtgttagttagtgacaaggtgtaagtgtaccctctcatataattcttgggattacaaaatctgattgcaaaaggtagccatttaacctagaggaatggacttccaatagtggcattttaagcatcagtgtgagaaaaggtggtaagagacatttgggataagggggtattttctgagcatcccggaaatcatagttctgcttacatatgagatcatccctcacttggggagaagaaacctcctctttcccaacacatctgtggtcacatgacttagtgcttgtctgctcaccctacaatggttttttctccagtcctcctcttagtgctaggtgggaatttgactggaaacagaagagatgggggaggttagaagccacgcagcctggtcattcctattgtagcattccctgaggggccctgtagccagctttgctttgaactgattttctgctagttttcagtcaggaacactgaatgtgttccaaggatatttgtttactagcccagccaccttggaaaatctgggagaggagaaggtaaaatatgaggtggtttttcttccttctgcagttaggaagcatgctgtgttggccctctaaagatgcaaggggagatttgagtccatatcgcattcctagaaatattgaagcttaaagaggtaaagtgccttgtacaagattgtggggagtcagtaccattgagttgggattgtgactcagtgatcctgctctgaagctttaacacccattctgtgaagagcacaaatttgaaagcaggaaagctatatttctgagttggctctcttgttaaacagctgtgtgacatgggacaaatcttttggagtactagtagcctcattttcagtaattcgccccccacccccgagatacacaccattaagggtgttgcaagaatgaaataagaatgagatgttaagaattttattgcataaaactagccttaagcatgaccataattggtttctttttctttgattctactgtgtcttcctctctttctctttctccctatctcctgttgagtagaataatagactccagtgccaggttactcagaagactattgcaaggaagattctcaagatcattcttccactggaaaatctcaccctgcagttgccttgccattgattccttggtagaaggcccggttcaaaaatcaagccacattcttttgaggcaaaataattccaaacttcttttttgttgttgttgtttgtttggtattccaaacatctgccagctcccataagagccgtgacaaatattattttgtaggtcactgtagatttccttcaccacaaaatgctgagatttggaataattagagcccagggggcaaatgggcctgcttctgtcctttctctgatgggtttcactcatgtctgccagctgcagctgtctgattgtatacgcttgtgggcaggggcagggcctcttagcccagacagagttaattagtatgagttaaactctttctaggagctaaggctgtctttataaggcaaaagtaaggaactttctttatatcctctaaagggtcattaataagtagttaacaccctgagagtgaattactcagaaattgatgttagatcgacttatatagcaaagtatagaattgagttagttacccaaatcgctgaagccaaaagaagtgcattgtctgttttctgggtattttaggccacaacattagggacagcatagccttcatgttctagtggtttgggttttggtttttaattaaatggtcccttccttattataggtttgaagtgattggcactttttttgatagtggttatgagggaaggttctagaatcagtcagacatcaagttatatcttagtgctgccacttgcaagttgtgtcaccttgggcaagtcaatctcttaagccttagtttcttcatctgcaaaatgggcataatcatgtctacatcagaacattattagtaagagccaatgagattatgtatgtaaaagcactcattcctgcctggcacatagctagggcttgataaatggtatctattcgtgtattattattattattatggatgttattattgttagccttatcattttcactacatactgagaataatttcattctttttgcttgtttgtttgtttgtctgtttgtttgttttttgagatggagtctcgctctgtcgcccaggctggagtgcagtggcgtgatcacggctcactgcaagctctgtctcccgagttcacgccattctcctgcctcagcctcccgattagctgggactgcaggcactcgccaccatgcctggctaattttttgtattttttagtagagacggggtttcactgtgttagccaggatggtctcaatctcctgacctcgtgatccgcccgcctcggcctcccaaagtgctgggattacaggcatgagccaccgcgcctggcccattctgtttttttttaaacagttgtattgaggtataacttacccaccacaaaatagactcatattcattacagttttgactgatggaaaagaaaggatggttcaactctctaagcctctccctaatgaaacacacagctcccctgatttctctccttccactgtcttatggcaggcactttccaagctctggttgtatcttttgttggtttcaattccttttttcaccactcactagctttgtgacttcaaataattcacataacctcagcaatcctatttccctcaaatgaaaatgaaggtaagaatttaccctacttgattcacagggttgttatgaagctccattgtaataatatatgtgaaatctctttgtaaatggtctgctgggttactataattcacaaatatgagtttcaataatattcaaatgtcatattgtgtgcttcagacattagatgccttgagagatccagattgtggctggagttatttagagaatgcttcgtggaggaaaggcggcataagctgaaccttcaagatcagataggacctcaatgggtggaaaagagtcagggagtgggcagtctcggtggagggattaaaaaaaagcaaaaccacagaggctggaacaaacagataagcacaaaagtgatttaaaatgtaggcggtggccgggcgccatggctcacgcctgtaatcccagcactttgggaagatggggcaggcggatcaattgaggtcaggagtttgagagcagcctggtcaacatggtgaaaccccatctctacttaaaaaaaaaaaatagccaggcgtggtggcaggcgcctgtagtcccagctacttgggaggctgaggcacgagaattgcttgaacccaggaggcagaggttgcagtgagcagagctcgcaccatgcactccagcctgggcaacagagtgagactcagtctctaaataaataaatgtgggagggaataaagttaccagggcagtataatagatgggtccccttctgaagcaactgggggaaaagattaaatgagatagcatggactccttcctttcaggaaagataatatcttattcatctaggaatattagctccatctaggcagggaccttgtccatgttctctgatccctctctaacacatattacaattcctggcacatagtaggtgctcagtaaatggtcaacaaataaaagaatggatggatggatggatggacggatggatggatggatggatggatagatcataatgtcagctgctgtacttgtctggctgttttaacattattcaaaatcattggtcactggagcggggactgtcttaaaactccctctatgtagtacagccccgtctgctgttgggatttatgaaattcttgtcaatgatgccaatactcagtgtggtttttctccaccctgttctagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggtaagaccctacatcttaacattcctgctaggccctactcaaatacaagagcttcctctgtacttgtactttcatttgtgcctgcactgtaaggtgtttgaataaaacatgacttgcattaaatcataagcctccttgacaatccaaactccctgatcttcacccaccctgaacaactctgttgaagggctcaggcccaatcatatcccagtcttaaagctgtaggactgcttaaatgggcaaaggtgagctgtttgtgttgatcggcgctccttttcataataattataccaccaaagcctccatctgaaggactcacaattatttgaagctttgggaatgctatgggtggaaaagtcactttgactatctagggccactcactccaattaacaagaaaatgagttgtctgttagttcccatatctgaagtattttactaaccagttaattcctagtgccctgcaatgagaaaactctctataaatgcttggtcatgatgactaccaggacattacttgtcagaagaactgcatttactttacaaacaacgtatactaattacatcttatctaatatgcagtccggagaatataatcaatagaactagaaaatggagtaaaatgagtgtttaaactgaagcaggaaggaatgaagttagatgtagtaacaacttttctgcctgcaagtggcattaagcactggattgtcaagggaagctatagaatctcttccctttaggacttttagtaagaatatagtatctcagtagtttaggagaattttcgtgtggccttgctttcttaatggccttccaggaatcattctagccccaaaagaatgtgcttctaagaactaagaacaaggtttaaggaataacatttgaaagatagaaatttaggaaatcaggattattgcaaagacagatgtaaccagcaagtaaattttatcctctcccttgccttgtgctagactgagctgtggccatcagatcatcttgtatagttttgtattaccccagagagcttgttcctttggtttggaagggagagtctagtgaatattacaaatggaagctatgaaataaatcttcattcctttaaacccccaatccagctgggggaccaagggtaccatgaacagagaagaaagaaacaagactataattcatggttcagaggctcatggcatccctgacagactactttgtaccaccttagaccatgatgctcgactaggattgctaacttttctgtggcttagtctctggcatggaggaattgtaggagaaaaaaaataatgcgtaataaaatgtaggaagtaccgagaactgacgatgggagagctggggggaaggacatgccgtgttttgagtccctgctctatttcaggtattaagtgaagcctttacacttatcctagatgcttctaatcttaattctgtttctccttggcaggagggaaacgtgtattgtggtctcaagacttgccccaaattaacctgtgccttcccagtctctgttccagattcctgctgccgggtatgcagaggtaggtgtgttatatcccaagacccctgggtgctgctatcctgtgtagtagaatttagaaaggaggaaaatacctgtctaatgtcctagggaaaggtaatttttatggtagccttagtttttaaaggtggtttaattaacaaagggaaaaataaataaagcattgattttaaaggccacagcctttaaaaaaaaaaaaaaaactacaggatggagtgctgtgcttcaggggaggatgggaaagagtcatcaaatgtgaaagtgaatatatttatttctccatccttaatcccttctagcttggcccttaaattattgtatcataaaacacagactattttcattcatagccttagaaggaagaatggaccttgcaaggaattgatgtggccattttgaagactgtgcagggcaaatttaggtatactttttaaaccccataataagatggtgacaaactcaataaaagcaaaacagaaagcattttctcaaattatattcaaaattgaattgtcttctcacattagtctttttttctttaggttttattttttttataatggcaccagttttttcgctaggttcctgggatcaagtgtaatcccctttaatttctcctttgttacctcttctcagattaccaaatctttcagcagttatctgtatctctcccttttcccactttcccactggcaatatccttattttgtcctttttccttctatccagtcaacatattttttgaccatctactgtatgctcagcattgtgctagaattggggtatttatattgataaatacagtagatatatagggtggtgctagaccatatggcatctttatgtgagttacaaaaaggattcccttacataagatactttattgccatttttcagaaaatcccagggaaagcacctttgtagctgtggcatccttttgcagcacacaacctacacaacaatatatatagcatacatagcagccaagatatgttctttgctcttatggaactcaccagaaaagacaaataataagcaaacgtggaaatacagataatgcaagtactatgcagaaaataaacataggactgagattaaaaataagtagtttatttaggttgagttgtcaggaaggcctctctgagaaggtgacatttaagctgagacctgaaagataaaaagaagtcacccatgcaaagatcccaaagaagaacattctaagtagagagaaaagaaagttcaaaggccccaggcagggaagagcttaaagcattcaaagagcctaaggaccagtgtagctgaaatgtagtgattgtggttgaaactgacatgggatgaggctgaagaggtaactaggaattagaccatgcaggattctgaaggccatgggaaggattttggatttccatttttaatacattgggaagctattggaaggttgtgagaaagagtatgaagtgatccaattaacatattaaaagatctcactggctattatttccagactagactggagggaggcaataatgcaagtggagagactagcaagatggttagggtagtactctttccagtgtgagaaaaagggtgcttggactgagaacacagtagtggttcagagtggagcctttggagccaaactgccttggttctaatcccagccttgctactttgtagttgaatgaccttattcaacctttctaccaatctttaaagtgaggataatgttagctcctaccttcaagatgtttgtgagatttcaatgagataatataagagaaggacctggcacagtgtcttgtatatactgaggacccaataattaaaagtggacaaatttgaaatacatttggagccgtggttctcaactatgggtgcatattggaattaccttggtagatttataccagatcagaaggaggaggatgtgattccaatatgcagctaaggttgtgaaccactgagttagaggaaaaaaattataggatttgctggtgggggatgtgtaggtgacttctatacattactgccattttaatcttccaaaaagcaatccatcaccgtgttacacccctgttcaaaaatttttatgccaacatgtatttggacttactatatgtcagtcccagttctaactaagcattttacagatatgaactcacttaatctcatgacaaccctatgtgaggagtactattgttctccctgttttatggatgaggaaactgaggcagagagcggttaagaatcttatccaaggtcaggtagctagtgagttgaggagctaagatttgaatcctggcagcctggctccatatttcaggctctaaccacagtgttctgccactgaaagggatgactccctgtcgccactcaaatacatgtcaacccccgactctgatagtgaaggcctttcatggtctaacctcaagttacctttataggtcaatattcttccattcatgcacctcagggcccactgcattgttcctgtgctctcttacctttttacctttgctcagtcctcttcctgtcagtgtttctcacactttagtgtgcttcagaattgctcagagaacttgttgaagttcagattcctggatcacacctgcagagattctgatttagtggccttggagtgggacccaggaatctgcatttaagcagaccccatcgttcattctgatgcagaatggtggtctgtggactgtcactttgagaaaccattcctgagaccatgtagataacctggaaccaaggatttgttttaaaaaatctgagtttagtgcacttaaattgagcacattaaaattctgaaacctgagtgaaccagtggaaaagcaaccaatttcagttcctgattggttaaagcatctaagtccgaccatatggcaaccaatttgagatgaatgagtggtggccatttcatgataaggaactgggatgaaaaggagacaaaagggctgtctaagtaacaactgcacatgtacaggttggatggagaaaatgtttcctctttctggaaaattctttttctccatccctgcctgtggaagtcctgctagtccttcaagacctagcacaaatgcagcttcctcagattctattgcaggccgtcctcaggtcgcattttgataagtagtagttggaaggcctttcttttctgccttcccacttccatccctaatttctccacccataaatcctgcttatccttcaaaatccagcctaattgccacttcttccatgaaatgtttttaaatcctgcaaactagaagtaaacctgtctctactctaggactcctcagcacttaacctgtgcttcttctggagcatttatcaccttgtcaacttctgttttttattatttgtgcccatgtattatcatccctattaatgcataagctcttcaagacagatactctttttcatttatctttatttctcccactgtgccaggcagagtaggtgctctttaaatgaatgcacactagattggaatgattactagaaatttagtcaggatttgaattaggtgctaccaaaaaagaatatggttgttgtgcatttttccccctgaattactgattgactgtggtagatggtgttgactatacattgattcctcgtcaataggaaattacttggtctcattcctgatctccaagttgttttcttcccctataccactttaggaaactacagttaacattgctttttggaaggactgagcttgtttggactaccagtgtatgctcatcccttttaatatgctatttgcatcagccctcataagtcaatatggatttagttacagcctaatttgatttatgctttggtaaggccctggatctttccatacatgtttctcacaatgtgtgtgtgtatatgtctgtactacagtgtagctgttacatttcagtcaagaaagatggatattttgttcctcacctcctttcttgtcttggccccaacttaatttcagtgtggctcaaaagaaagtccatactgagcagaggtgtacatgtggttgctaatataaccagttggtcactataatccagctgttaggctgatattattccctttggggaaaaggatatgtgaaatctaaactggaaaacaattgataatagaaaggaaaggcaacagtgaaaagacatgtcactgcaacctaggggcaatacggtataatgcaaaggacagaggctctgaagccagaaggtcatagatttgacattgcagggctaccacctacgagtgctgttatcttggacaaactatttaaccactcaaaaccttggttttctcaggtgtaaaaatggagattatgcttactacgtatgaaatgggttgtgtagattaactgagatggcgtagagtgctaggagatggcctaatacagagttattggtttataagtaacaattactatattttatatagtaattactatatttattacccccgagttaagtatcattgcaccttctcctctatctttgatagttttgcctttttaaaatgtaatctccatagacagaactttagttctagttcttcttgtggtaacagatcctggaactagctattttatgtactgttctatcgttacaatttaaatttcttttcttttttatgtcctcagaagcaacagataaaagctagttattactggccatgtattgtccctttatatacttgataattcattaagttctttctttgcaacctctcatccagcctaaatgcacaattttctttcatcttcctttataaagactaaatcctacacttttgtaaaaattgttgttctttcattgcctccagtttctttgcatctttcagctgtatataatgtggttgaaactcctttgaagttctaacttttgaagcacctagttattttttcccatggaaatgacgtttttacaatactgtatcttatataagcgtattactcatacagcagggaacccagaaacctctcccctatgctggccaccctgactgcaggccaaatactgaagaagaaataatcttttgactgctgaacttgcaaaccttcatataaagggcattgaaatagcctctctgcactgtccccaaacactaatgtgtgtctttcttcctgggtcagacagcaatcctagacgcggattgaatctcagacctagccttcattggctagacgtgtctttgaggctgggacagtcaaggagagcgttggcagaatgtgtgtcattgctagcacttcagcaaacctcattaggactggaagcatagtgcaaacagccactggaaccttaagggaaattttatcagaagaaaaaatctcttcagatcctgtgttagtttgctaaggatgatagcctccaactccatctatcttcctgcaaaagacatgctctcattcatttttatggctgcatagtattccatggtgtatatataccacattttctttatccagtctgtcattgatgggcatttaggttgattctgtgtcttcagaattgtgaatactgctgcaatgaacatttgcgtgcatgtgtctttttttttccccaaatactgcatgttctcacttataagtgggagctaaatgatgagaacttacgaacacaaagaaggaagtaacagacactggggtcttcttgaggatggagggtgagaggagggagagaagcaggaaagaatctgtacaacaaaccctcatgacaggagtttacctatgtaacagactttcataggtatcctcaaacctaaaataaaagtttttttttttttaaatctcttcagagattatactactgccacattctgggaaggcaggcttcaaacccaaacccacacccagcttccctccaccattgatcatttccacttcctgtcccctgctcatcttgccaaaacaacagggaaggctatgtacttggactctagacaagggaaaggtatttggggtaggtattaactgtattgaaagccaagtatgcatttagtaaatggtgtctaaatgtagcacgtacaatgtgccagacaatgttctaagcacttatgtgtggaatagctcatttgatcctggcaaaaatagtagcaactatttatatccccattctacagatgcggaagctaaggcagaaaagttgagtgatttgtccaaggacaaatggtagtaagtggcagagctagaattttaacctggtcagtctggcttcagagtttcaagctcttaacttctatactacctgttgggacccattcataggagtatgacaaggatatctcctagtacaggggagtaaaggggaagacgggacatgcatggcacattgttgtgtgcagatactcctaagagagtatcttaccacactgcccatgttttcccatcaaggccttaacttacccttctctcactctaggcttaaagtgtcttgagtgtaaatgtctactttctttcattcagcaaacattgttaagcaatcactaagagcctggcactgcaccagtgctagagatacaatggtgaacaaaaatggacatggaacctgccttcatggagttttagtagggaagatagacaccacgtcatgatataagtaattataaaattgcaactgtgccacatgccacaaaggaaagttgttataaaagccaataattgagaggggttgacctagtcagggaggtgaaggaagacttctgagactgtctctccagcctcaactcgcaccacatccctccttgttctctgcactccagggtgaggaaagattggctcaaaaattagggagataactggtggcagtcatacactcctgggatccccaacttctgatcccaccatgaatccagtccctccccaggctgtaggggtctataatgttctttctacattatacatgctacataataccctaatctaggaattttcttttactcttctttcttttggctgtttcctgtttttcagagacagggtctcactctgtcatccaggctgtagtgcactggcacaattatagctcactgcagcctcaaactacaagctacccttctgtctcagcctcctgagtagctgggactacaggcgtgcaccaccgtgcccaaccaatttttttttttttttagagacatggtctcgctatgttgcccaggttggtctcaaactcctggtcacaaatgattctcctgcctcggcctcccaaagtgctgggattacagacatgagcccagcctaggaattttctttttgagaaactacttgatcatgctaccatttcttaccatattatccaatctgaatttttcagcttgtttttaaagaccctctgtgaaacagtctgatccttccttaacctactttccagcctcatttctctgacaccaacacacacatctcctttaggctggctggctgatctctttgttctgttacatgctatgtttcttcctaccttccctcctgttatgtgcttcacttaaactgttatttttcacaagcttggaatagcccccgctcctcttctacctattcgcatcctactcatctttcaagggtccagttgaagttgcacctcttctaatagttttgcccaatcactctagttctcattgatcttctttgaccaccttcaggacttaatctggttcaaaaataagcattcagaaatatattcttgcactgttattgctttgtgtcttcctgtttcccctggcataacataatattaatcatatatcatgctgactggtttatttaatacaaaaagagccacagtcacaaaaagctcttgacagcattccaagtacagatgcagtagggaggcaggagaaatggtggaacttacaatttgctcaacccaagcccgttcatccaacatatctcaaatgagcccagggagaaaatggaagtcactttttatgaaattttgatatttctgctaactccttcaaggtaaatgaaactggaagcaattgtttaaaagtatattagtcagtgttcaagataagtgccattttacctaagacacttgatttctctttccgaaagagcagcaaaattgcacctcagatcccatctcagctagaatccgggatcttcagggaagtggtatgtgagatacttcattgattttaaacatcataaaaattgaccagtttttcaaagttttcaaaatcaaagaaaactgaagaaaataacagcaaatccaaatatagattctcacaaattagtctcaagttgtttatgttttggcccacattttctgcagaaacaccaccatctcctggtcatgatgataggaaagaaacattgttaatgagaaacactactttaaaaaatgaaaattcatcttgtataactgaaaccttatgcctgttgattagcagctccccacttccccctccaaggtgaacaagttctaaagatctgcagtacaacattgtgtgtgtatagttaaccatatagtattgtatacttaagtttgttaaaagggtaaatctcgttaagtgtccttaccacaataaaataaaaaaaattaaaattaactcagtaatttttgagtttatacattctcacctaaacttcaaaatacagtccgccctctatattcactggttgcacatccatggattcaaccaactgcagatagaaaataatttttaaaaacacgttaaaagtaacagtacaacaatctaaaaattacaaattttagaaaccaatatagtaaaatgactatttacatagcatttacattgtattaagttttataagtaatctagagattatttaaagtatatgggagtatgtgtgtaagttatatgcaaacactatgccattttttatcagggacttgagcatctgtggattttggcatctgtggggggtcgtggaaccaattccgcatagatactgagggacgactgtgtattgatatactctgatattttcatagctatagaagagtctcgctgtcattaataataccttttcaaaagtgaatcatttatgttcatgtgtatgggaccattttagagatttgccatcctcacctacctctcctcatctaaatcccaactggatctccttccatggaaatgttccagattgtttttgctttctctccatctcttgtgctcaaaattcatccccacgtacttgctgactgtcccaggaccccgtccctctaaggtcatcatgttccttcttggcatgtttcttacgtctagaatatttcttcttgaatagaaagtcattcagacagtggatgggacagcgttgactttcacattgagtttaacaaattaatagcactgattcctaatcggccatctgggttgtcctgtcagggtcagtaataccccattctgtttctgggattggaggacttttttgtgtgtatatgaatctgtttctataataaaaataaggaattcccagtgaagcatttcagagcaattatttcttcatgggtggttaaagccactctttcttcaaccttattctttctaactccttcaaggaattccatagctgcccagaaacaccattggatgtgcccattactcacattataatagtctttatgagcttagactccaacaatttatagaaatcaacctggtttgttgactgacagtgcaaacagaggtaaaagatacatgagaaggaagagcagtgtatacaactgactgcttttcattttcaggttgaccagacagtcagcatgggtaggtcattgagtttctcctctctgtcctgctttttattttcagttcatggatgtggtagcacagaactctactttatttggatacttggatttttttttttaagacagagtctctgttgcccaggctggagtgcagtggcatgacctcagctcactgcaacctctgcctcctgggttcaagtgatcctcccgcctcagcctcccaagtagctcagactacaggcgctcaccacatctggctaacttttgtatttttagtagagacggggtttcccgatgttgtctaggctggtctcaaactccttacctcagatgatctacccgcctcagcctcccaaagtgctgagattacaggcatgagtcaccgcgctcagtgggcacttggatttttaagacttcactttataactttgtaaattgtactcctaccaatgaagcagatatctttcctgtcaagcctcatttttagccaagagagaaaagagattttaattaagatgcaaactcttttttaaaaaattggaaatagaggactagcataattatgagaaattctaagccagtttagaaggtgtgagccgaagaaatctctctagccatttttaaaaatatctccaggaccctgtcttccaatgatttagagatgaaatgattccttttcaatgtgcaggcatgcagttatctttgctaggctttgtttgcttgtttgtttgtttgtttgtttgatccaagcccttttctttgttaaatacacagcacacttgtgggagtcccttaagccgggtattcccccatgtgtaagctacccttgaggagaaggaggaaaaagaagtggaggcaaagaatgggaagaaaggggattaggaatagcagctaacatttagctgacacagtgtgccaagcacaattctaaatgctttgcatatactaattcatttaatcttcacaaccctataaggtaggcattattgtctccattttagcaataaggaaactgaggcacagagaagttaattcatttgcccaaagtcacataagtaggaaggagcagagccagaatttgaatccaaactgtttggctccaatctgttctcttagccattatattatactgcctctcaacttggggaagcaaagcaaatttgggaactcttatttctgaggctaccgggaggaacagactgtgtgatgaccatctttccaggggccagatatggtaacaatccagcagatgcattgggactgctctgagaagcaaagattctgtttctcaccataaacttggatctgtttagccacatctccattgaaagagcagagtgtggatggtgggtaccatccagctcgtagtttctgtattcactctcttctgatttcctcctggaaacgcatgcattctcacaatgcactttttaaaaagtaagtatttatgatttttctggacaaataattttgtactcttcttcagatttggcttgctactgttggcaggaattccccccgttgtgtgtgttttggtatttctcaaggagctattttgttaaaaatactaagatcttatattgacagcccaaacaataaagtacttcatttgacaaagaagtattttttaagaaaataactgtctgatcctttttatggctgtatagtattccatggtgtatatgtgtcacattttctttatcccatctatcattgatgggcatttgggttggttccaagtcttgctattgtgaatggtgctgcaataaacataccggtgcatgtgtctttatagtagcatgatttataatcctttgggtatatactcagtaatgggattgctaggtcaaatggtatttctggttctagatccttgagaaatcaccgcactgtcttccacaatggttgaactaatttacactcccaccaagagtgtaaaagtgttccaatttctcatcctttccagcatctgttgtttcctgactttttaaggatcaccattctaactggcatgagatggtatctcattgtggttttgatttgcacttctctaatgaccagtgatgatgagctctttttcatatgtttgtgggccatataaatgtcttcttttgagaagtgtctgttcatatcctttgctcactttttgatggggttggtttttttttcttgtaaatttgtttaagttctttgtaggttctggatattagctctttgtcagatagatagattgcacaaattttctcccattctgtaggttgcctgtgcactctgatgatagtttcttttgctgtgaagaagctcgttagtttaattagatcccatttgtctagtttggcttttgttgccattgcttttggtgttttagtcatggagtctttgcccatgcctatgccctgaatggtgttgcctaggttttcttctagggtttttatggttttaggtcttacgtttaagcctttaatccatcttgagttaattcttgcatgaggtgtaaggaaggggtccagtttcatttttctgcatatggctagccaggttttcccaacaccatttattaaatagggaatcttttcctccattgcttgtttttctcaggtttgtcaaagatcagatggttacagataagtggcattatttctgaggcctctgttctgttccattggtctatatatctgttttggtaccagtaccatgctgttttggttactgtagccttgtagtatagtttgaagtcagatagtgtgatgcctccagctttgttccttttgcttaggattgtcctggctatatgggctcttttttggttccatttgaaatttaaagtagttttttctaattttgtgctttataaaacttgcagatttcttgtattgttgtatatcatcattggaagctcaaatgcctatcagtggagaatccttatactagtttccttttaaagcttctctcaaatttcagcacacttgctccctcccagcagaatttatagaattagatgtttggcagaggctccctaaagtcatctgcttctactcacttcttcatctctagcttcggtatggagcactggcattaaagtgctcccccatggaacccagctcatggtaaggagagacttcacaatgggtttattcctccctgctctcttccactttgccctgattctgctcatttcaacttctgcctcaaaaaatacagagaacatttcccctgtctcagggatttgtctcatgtccctttgccttatgattagagtgactatgtaatttactatctcaaccgaggcacattttgaaagcaagagctgcaatcttaataattatgcctgccagaaaaacaggcaataaaactgagttgtctgagataaatctgctctatggctaccctatttatgatgtatggttcaaaagtggccacatgctggcatagttttgctctctgaggcttatcttcatgggtatctcggaatctcattgtacacttagtccttttgagaggacagtttacctctctgacctgctcaagccaccagagattaatggaagccacaggagttataaacagtctgaatttcagcctagcttttggccatttttcaaatacttgttctccctttctcccactactagaaagccaacccattacagcttcatagggtaccactcagagagagtatgactgaggtttgaataaacaatacatgtggcttttagggttaaatgaatattgtttgacatacagtacactacacttgtttttatttcagttcaaaaaattggttaaaattatatcttgttgcttctcaaaattaattagaatccatctgaatccattagaatctctgttttttgttttgttttgttttttacaaaaagacttggctgaatgaaaaagcctccatctcattcagataatctttccagtgatcagacaaaaagagcaaagaaacaggttttttagggtattggtgcctactttttttcaaagtatgatatctaaggttgcaaatggacatacctattttcagctatccagacagactgtacccaggtctagagaaccacttatagccttataaaatgtcaacatctaagaagataattccagtttaattatgggttaaattaaatagaataattcaaatgttaaaacgtttagcagctacttaatagacttaatagaacattgaagtttagagaatgcaattttgatgactttgaaagctcagaggcaccagaaatgctaacagttcctagtatttatatatttaatgtatataatttataatgtacatagtatatcttatatataaatatagtgtatatatacatatatgtgtgtatttatatacaggttaaatatcccttgtccaaaatgcttgggactggaagtatttcagatttccgatgtttttggattttggaatatttgcattgtacttaccagttgagcatctctaatccaaaaaccccaaatccaaaaatgctccagtgagaatttcctttgagcatcatcagcactcaaaaacttctggagcattttagactaggaatactaaaacctgtatgatatatataacatacagttttagtatgatatagatgatatatatatatatatcatacagttttagtatgatatagatgatatatatatgtaatacaggtttagtattcccccattacttgtttttgtcaggtttgtcaaagatcagatggtatatatatgtgtctgtgtgtatatatatatgtgtgtgtgtatatatatatatgtgtatatatatgtgtgtatatatatatgtgtgtgtgtatatatatatatatatatatatagtctccattactttttaatgaagtgctgaaatttaggtatgcattcttgtctgcaaatgctcatcaaatacacatcacgacacactcatctgatttgtgttacagggtattagtattcttctcctatgcctgatagtgacttgcctccttgattttccatcttacctctctgctcatttgtaagaggcgctatgtgcttctataatgctttgagattctgactggactataagtatttaatgacactctttaattaaaatccttttaaaaactctagggtataaattaaataaactgaacttttcagaaggccagctaagtaaacattttatgtcaataccaatcattaaatctacattttaaaaggacatttgatgaagagaactagtctatcatttttcttttgcaacttgttttctcccttttgactacttaaattaggcttgaaaccacattatatagcttttacattttgttttgccatttgctggtaaatctttactggtttctattcgtctctctagtcccatattttatttggcccagacccactactgcccactgaaacaagggggacaagtaaatctaagctcatccctgctcaatcactgtccccagctctccagatttgcaacccaagagttgtcagatactgatttcccctttgccttccttccccatcatcaaatcttccttcagggtcttatcagtttcttttcatctgtaggagtctcattcaatccttcttgtgtgttattgcacagatgctcatggcctattacatattactatagcagcttcctgtatggcctcctgcattcgagttactccccaactagtctataccccattgccagaataggcttccacaaatatcagttttatcataggaacccctacagaaaaattggcaacataatcaaatgtgaattcttcagccttttacaaaattttatatttttttgaatttttactgtttactttttacaatttaattattttcttaaaattgtgtgggtacataataggcatatatatttatgaggtacatgatatgttttgatacaggcatgcaatatgaaatgaacacatcatggagaatagggtatcgatcccctcaagcatttatcttttaagttacaaatgatccaattacactctttaagttattttaaaatgtacaagtaagttattattgactatagtcaccctattgtgctatcaaatagtagcacattatttactacccctatttacctcaacaacacaccccactgtcattctccctccctccttcgctctccctctcctccctttctctctacaagttcaattaccagcgtaatttctcttgttttcatatctgaagtttctactcaagccacaccttgcttgctgtctccagtatgtgacttgctgtttacaaagctctggtcctttgccaatgtcactccctttggttgaggtactctctgcccttatcactgtcggtttatgctgtgcagtatctacttctaaaaatgtgacttaatggttctttcaggaagctttctacgattacatctgactgctcactcatcccattcagtgtctcctaagcatgtgtatttcatttgtatttgctttttttgtgtgtttttaggctgtttcctatattgatttcccatcacctccaacctgggtgtaaatatcctgagggcaagagcccagcctgattttctcctctttctgctgtagtatcaggctcttcacccaagaagtgttcaaagcatgttaactgactcttgggcataattttctagttataaacatagttgaaatcatctttgttttacagtagtcagtcagggtttccacagagttcagcttgcagtctacaatctttactcagacatggaataaaacaggcagaaaagagtatatatactattgaccaagcacttaattctgtatgttttactgcagttcaattcaatacatatattgagcacctgatgtgtacgcagcaatatgctaagtgctccagcctggttattcacaaactcctgcatccatcagaatcccctggaaggcttgtcaaaacccaggatcaccagcccccatcctgagtttctgacttagtaggtatgggttgggatctgaaatttggcatttctaacaagtttccaggtaatgctgatactgctagtccaggaagcacattttgagaagcagtggtctaggagatacagaggtggtctaagacataatctctcattccaaggaatttacagactctctagggagacaaggaaggcccagaaaacatttaacagtaataaatattgtacagtgttttagtatttattgattcgacaaatattgaataagtactatgtgcccagcactgccccagatgctggagttacatcagtaaacacaatagacaaaaatccctgctgtcatggggggattctaatatgggaaagcagacaataaacaaaataaataaaatataagaaatataagatagtaataactgctaaggagaaaaagcaaagagcaggcataaatatcagatgggggttggaactatagatagggtggtcagagaaggcctcccagttccatcatttgacaagtatttattgagcgactactatgtatcaggcactgttatagatgatggtgatatagtaacacaggtaatgaacccttttcttatggaatggacatacctatttgggagccaggtaacctagagttttggtgttaattctcacaaactcattattagactctgaatggctacttcccctctcagccatggtttcttcatctgttaaatggagcagttggacaaagttatgcttgacgtcctctatacttctaaaacttcaggatgcttagtcttttaggcaatcagaaatatgtaagagtgtttgaagaagactttgcagaggagagaaaacttaaatggttttcacaggcatgggggagctatggggtgtgggagatggaaggtaatttcagaagaagaataacatgagctacagcacggaagcaacaatgggagtccagtattcagtgaagagcaagtagctcaaagggttcccattgaagagtagctgagatcattgggtaggcagtagggggtgattgtagagagtcttggttgggaacccactgagggttttgatcagggaatgacacgattatacaatcaaagtggtgttttactgttttatgaagattaacctagcaaatagttaaatcctcaaaattcattatttttcatcagataatatttgaattatgaagatttacagtcatactctgttataagtcactgcctgattctaatattgctatcaaactaatttttaggtcgttttcaagcccttaaaagcctatgatactacctaatttcccctaacactactactacatgcttgaactggtaacatgttactctttttgtgtgtgtgtgtgacagggtctggctctgttgcccaggctggaatgcagtagcatcatctcggctcactgcaacctccacctgccaagctcaagcagttcttctacctcagcctcccaagtagctgggactacaggtgcacaccaccatgcccagctagttttcgtattttctgtagagacagggtctccctgtgttgcccaggctggtctcaaactcctgagctcaagtgatctgcctacttcggcctcccagagtgctgggattaaaggcatgacccactgcacccggcgtgttactcttatgaaggcttgagagagtaatcagaatagaaaattcttagtacttacacttttttgtgtttctggttatcttataaaatatatgttgaatattaggtttatcttcagccatatatataatttaaatagtactcatttcaagtgatgcaaacatctctaagacaaggctcttcccattcgcttgcttggtcagaggtaacacaagggcaatattcttggaaatgatcctcttgttttttaatcagttgaggtatatccacagctcttgtgtgtttgttgctctagaggctgaaagtagaatattcttcctataagcagttactttagaagataatgataaggagttctctgtccaaagagtgggtcatgtagacctagagaaaggtgtgtcataagaaattatgacagatcaaatcctcaaaactcattattttaatggtagtttaaacagaagtgaattatgacctgcaaaacacttaactgtcacgaagtaaaatgagcaaaagtgacagtgatggttaaattaggtggaaagtgattattttccttttattttccaaattctgcataatgttgctaggacatctatttagaaagtggcaactttcttcagagttgttttgaaaaatgaggcacacccagagaaatctttcacagccgctttttgaaggacagccacaaaagcaaaaacacttcaagaactttgggatcatagtaccaaaaatgttgctgggtcacaagggtgataactttcccttttatgaatgtatgattttctccttatttctttttaataaacaggagatggagaactgtcatgggaacattctgatggtgatatcttccggcaacctgccaacagagaagcagtaagtgtgaatagctcaaataattcaacactccacagcatcaggccaagctttcctctcctcgtggctactattctagcaaatccaaaaaaaaggcccgatttctaacaccatttttcttcccttttctcaaagtttttaatgtcatcaccaactggaaaccatttaagtacactgtaaaattggtaactggaggcaggaaatgtgcacaaagaaaccatagccccagccctttgtctaggtcagaagttggtactctttcaggatgacttgccaagtctttatgtgttctctaaggaagctaggtcactcctatcctcaacagtgaggaccttctgtagggttgtaggatacaaccatctttttggtgggatttggtaggtacttcagacatgtccacataaactctttcccaagccttaggctctcagtcatacagttggaaaagaggaaaggtagcagtctggattctcctctcttcagcctggtgatgtctcccttctgttctctgcactaatctcagaataagcctcacaagtaggcatctgtctatgtaagtaatagcatcttttgttcttttgtattttgaaggaatttataaaatagcattcctctctaaaaatatatgtctaagaagctttacactacaaatttcttaaaatctgaaaaggagatgttccgattcaaagaatctatcatacaaaatgcacagtggtgaccattgcacataaataggtgttcatcacatccttgtacaaaaaaagtatgcaaggacattcactgcgttgttgttttcataaaaacaaaacaaatggagacaacctaaatgtctactagggacttggtgtgtacatccaattaatgggacactgtgcagttgttaaaagaatacggtacatctaaatgtagtaaagtgaattgagctccaagatatgttaagtaacaaaacaaggtgcagaatgaaattgtacactatcacttctttatgtaaaaattgtatgtgcatgtatataaatgcatataaaccaatctggaaggtcacataccaacatgtcaggtgtgctaatcttaaaggagtagaagtgggcaggaggaaaggtagattttgactttttactttatattttctgtataatttgatgttttcctataagcatcaattagttttgtaataaaatatatttgattttctaaaaccctagaaaaatctcagcaaggattgaatatgaggcaggagtccagggaattacagggcaagcctgaggatattgagcatgtgaggaagatgttgataggggatgcagtagaatgactcatacaaacatcacagtgctgctgaggctgggcttcctggtcatcacatgggccacttctaacttgcatgctcccagcttgccaacacccaacccaaagcttcagcagtgagatggaaccatttctatttgtcttactctctatcagtattattttctgaacactgctgtttctgaatagttgcagaagaattggggaaaggggtttggagaacagtactctggacatctcaaaaaatcagcatcctgcaagagagggtaggcttccctgtttgctggttaatataaaccctgaggaaagattttctccacccaactctatctgctttatagtaagtgagattccttccagagcctgacaggagatgatgtcagtctcagttttctgtgttgtctgttcctctttttctcagcccctattttttattgtggtaggtagttgagagtggctgaattagtggctgtcaaccagatgtcattctaaaccaaatttagagtttagtcaccttaagctatgtgacttattccctgagaggcccccacactaagcactatggccaccttagcagtcttgctggtaatgccatgaattagcctttcttcttgacttcattttacactgccctcaattccagcccttatctttcagcttcattgacaggcctagtgataggcctggacttaatccagtacttcctgtagcaaaaaaggtcgggtacagaatgtgggcccttgaaatagttattgattttcaaaggagttcaagacctatctttagaaacaaacatttgtgcctggtagaccaaaatggccatatggtttcactttattataaataaatatttccctttgttctaaaagggatagatattgtgggatatgatttgaataataaatagcatctgtagtaatggaaaaatatatacctggcacatagtagtcacccaataaataaacattgaatgaatgggtgtgggaggtggcgtaaaatgtgtgtgatggtggagtggggagggggttcctcattaattttaatgcacaggaatttgtctcaaatcagagataaactcttcaaatttgttgtttgctcttgaccagcctaaaatgagaaaataggagaatcccttctgaatatcctttgcaggcccaacttcctcagggcaagaagaaaaggcagccctaacaacagatttcttatccaggagactgtccttttcgtaaactgttcctatttaccgggaaccagcaaaacctctgttcaacagaaatacagctgactggtttcttttgccaggtggtctgaaaaccatcggcttagcaagttttatgaagtgcacaggaagaggaaccagtggttcaaatatgactcctttgtaaaaacctgaaacagtttttgtttgatttctaagttgtaatttctcatgaattggtcctcgtgccattggtggggagtgtgtctgcgtgtgtgtgtgtgtgtgtgtgtgtgtgtgtgtgtgtgtgtgtgtgtgtgtgtgtgtgtgtgtgtggagtggtgtggtatgtggggaggaagaagtaggtgcagactagaaagccaaaacatgaaagcatgcataattttgttttggacaacagccaagccctgatttttgccccctgtagattacgttgaaatttaccattaaaaaaagtgaaagcgtttgggatagaaacgacatgaaacagataaaaatccatgtctcatttgtactgtcagaacaatggtttgggaaggaaattggcctaagtgtcttccagccagagatagtcctaggttggtagtgattaagatacaatgttttaatggctgtatggattagaatatattctgaagccgctttttaaattaaactttttttattttgagataactatagattcacttgcagttgtagcagaaaatacagagagatcccatattccctttgcccagtttccccaaatggtaacatcttgaaaatctatagtacagtatcacaaacatgagggccctttctggaccctgatgttttcttgtctacaccaataaaactcttatattttagactttagaacatgaaattcttgggggtcctctacaatagtggggatttttcaacactggaaaagaactgttttagagccacctctaaagcctgaaatatttttcagtctttcaagtaagtaaatcaaaaaataccaaaatactgagcaaaataaaagatcatagctatatggtcatttctaactggttttgacccgctctctcaagcaggctagttgcagctaatttttaagataagctccaatttcacttacaacttcagggcgttaataacctttttctcctttgctctgagttacaaggtcagaatggcccctcataagtctctttcatttgtttaggggaggaactctaaaagaaccattacccttaaatcaaaatcacacaccaccaccacccactccagcccccaaacagaaaatcctttatgtcagtgattcccaaccttggcttcaaaccagagtctcttggggagtatataaaatcctaatgcccaggccttcccccaaaccacttacataaggatacctcagagcgggacccaggtatgagtattttttacagctcaccgggtgattttagtgtatagccaaagtggagtatgtggtatatgtggttgtgaacattgtagctgaatgaacttttgtatctgaaagaacttctctttgcaccagcttttagtcaaatggttatagaccactgagtttgattggacattctttcttccactttctccttcttctccttctcttcctccttctattcatcttccccctactcctacactcctaccatctccaaaaactcaatcttcattatcaccatgagtaaactgcctctcctccttggcctcagtttctctgtctgtaaaacaaaagacttcaacaagattaggttctgggggactgactggtctacaatagggcctgtgatcaaaattcttgaggattttgttttttcatcatgatcattttcctaccattattatatgtcccaggtctgagacgttggtgctaaagaatggcttttcattttgtgttcaccatcatgagtcagagaacttctcgtacttgcagcttatcctgggtcaacaaccttccctctctaattctatcccagtccaactgcttctttttaggatcagtgggacaccaaccagccaaactgtcctctatgtgttcctttggcaaaactttgccaaacttcaaaaaggacagagcaacctataatggcctttgtggaatgtgagtgattatggcagaaaaggacatatgagccattgtgggaatgagaaatatttgaactgagaatcctatccatgtgcatgaaaacaaactgatgcaaatttttatttgtgtgaattttgatagcaatgcaccaacataggctcttcttagatagaataacattgtctttcaaaaggctaaaaaaggtcctcttacttcagctcctgtttactctccctttcccctaccagtggccccttcctgccaagagggcaataatacttcccaaagtgaaatttgcaacatgcctgtctgtggcccataactttaaacagtgttttatgggatatggtcaggggaccccataactatcttcccaaggttcctcactatttctgtcactgaatataaagaccttccttttcaattgcctgtgaaagagttttttaatgggttccccctccttcacccctaacaattgcctataaaatacaattaatcttacttggctttaagccttaaggttccattcttcattcatttcatcttcttgtacccccagcctactttagctcctgggagaggggtgggtagcacaatagtctggtcatcacgtgtgttgaacccttgctgaaagattacttgtatgacaagactctaagcttttcttaggtaccagagttttgttcactcaacaagtatttgatgaacaccttctagatgcctgacactaaaatctaggcactggagatatagcagtgaacaaaaagtccttgatttcgtagagcttacatgccaatactgtcatgtactatcaattcttctacctataaaatacctagggtatttgtactgcattgtatgatcttatgccattacctgtctttagagtctaagtacatcttatcaagactatactcgaatctcatcttttcctcctatccagttcaccctatgcatgatcaggattcaatgctttgaaacagttctgattacattatttctctaactttaaaaaaaaaaatccctcaaagccttctatgccctcacctctattgcttaccaaataaagtcttcaccccttagcctgtcatttaaagtcttccatgatctggcttcaacccacttttggaatgttattctgcaactgttcccttttatggactcgatgttctcttcttcaccttctcaacttgtaaacctctgcctggactattccacttaacttctgcctgtaaaaaagtctacccatccttcgtggcccaggtcacaagccctccccaactagaagctctctctttctccttctgatttgcacaggactgcttacttcttctgcagcctctattcacattctgccttgcgtgcagactactgtcttaactcttaaactgaaatgtgagagtcttggcagcaggaaggacgctttagcctttttggctcttttctccctgagaagtttgcctgtaaatctagtcctatcttttagaagaagagagataaaccttggcaagttgtcattaaaaaaaaattttaatgaaaaaaatgtcagctgcttgtacatgaccacatccctatttctattggtgtaggtaagcatgcagctgaaatcagagctcaccactataaatcaaaattattgaatgacttctagtatataacttaatctctgtgatctcattggtggcttttggactaaatttgttcttgttattttacagagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaaggtaaggggcatccttcttttgtatacttccacaacaaggcttcagcagccctggtctttgcagggctggagctgggaaaggaccctttctcccaggaatagcccatattcacttgtggctcacttagcatcaagtctgtgggtatagtcaggtgactccaggagactctttggacttccttaaatgcagccaaaagagcatagtccggtcccttttgtaaacagcctcttgtattttctcaattatccctggggattgtaggtcatttgggaaaatttcttgggtctttaacagaatgagtgattgtctgtgttttagtaggggacccaacattcaaaggtactcagtgccaaacatcactgaagctcttatctataccttagaaatagcaattctcacacctcaatgcaccccagattaccctggggctctcgttaaagatacatattcctagccccacactcagattctggttaaatgtgtagcatatgagactatccttagaaacgagtaatccaggtgcagtggctcatgcctcacagcactttgggaggtcgaggcaggaggatcactcgaggccaggggttcaaaccaggctgggcaacataataagactctacaaaaaaaaatttaatgaaaaaatattagccaagtatggtagtgagtgcctgtagtcctagctacttgggaggctaagacaggaggatcacttgagcccaggagttcagggttacagtgagctatgattgtgccattacactccatcctgggggacaaagtaagaccctatctctaaattaaaaattttaaaaaggaaaaagagtaatccagtgagaaatcccaaaaccacctggctgagcaccaggaagactgatcaggttaagactgacatgctgtccacttagttgatcaactggctacagcaggcacccatagacttccatagcttccaatgtcttcttacacagcattttctggcctccacccgccccctgcccccacccccacacacaccagtagcaggagtcagggaggagaaactcaatcaaacaattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaaaaattaaattgcttttgaaatttgcaggcttaaaaaaacattcgaaataaaaccattaatggaaaatggtgatgtagtagaagaattggaaatacttactatcgatctgtgtttgatttgtattttattatttttaagttccaaggatttctgataaaagcttatgaaatcaggaagaaaggtaaagatagcttgattttcaattctaaattgcctccaatagattccatttgctgtgaaagtatttcaaagccttttaaaagtgtagggaaatggattttgaaaatcctaaatcccataatttccacaaggtctctttaatttcagggcagaggctcatcccttgattttctccatgtcctacaaaaaccccagctggtttacatttattcatttgcccccactgatttggatgcaacagttctgttctgacctttctaatatagctcactgaggaatcacttgtccccacccccaactcccaagctggatgattcaaaatcatctcgataatttttggggtaaggagagggctatgtttccctgtccagaattaacttcaccccattccactgcagagtctcatccagtctagactattcctttagtccaaatgttcaggggagatggagcctagctatataacactgggaatcctgcctgccctgctcatcatggatcgttcttttccttacatctcttgctaataatgtggtcctctgatatatctacttggctccttgttagcatcaaataagagaaatgataggaatccaccattttgaacttgaatccagcctaaattttcttgaagcatactgtgtgtccacttgatcacattgtctagaagggaacgttactgtttggggagaaaaaaaaaaaaagaggtaagggcaggagagtgaacagcacatctggcctgtcttgtgtgatcctgtccacagccctgacctcacagttgaggtgtcagctctccattttgtctcattgtaacattgtgagccactccagtttaggttattggaaatctttacgtgggttgaccagttagagtgtccagtattctagcagctcttgcaaaggacaggaaaaggcagctaacattattcttatttcttaatgtgactcagtggacttgatgagaaagaactagcccagtgattcatccttctgaggccattgtcttgcagccaaatcagccaattcctagaaatgcatcaagtgggactatttctccccaacagcccagcctgaagtgatacaacccaccctagagatgttgttgattgggatgccaacaggtttccctgggtgtgatgaggtgatgggaataataagaaacacacccagtcctagtcatgacttgaaatctccacaatgtctcagcactctcaaaaagggagataactcatcctcggacttccccatctgcagccttgtgcagttatcttggagcctagctccatgccttatagtaggagccagatatatttggtgttgatttgcatagaaagatactcctgtggccccttccctttataggcccctcagcctgcatcctagatgcttgctccttttttgggtgggtctggggagggaacagggtctcactctgtcacccaggctggggtgtaatggcgccatcacggcttactgcagcctcgacttcccgggcccaagtgatcctcccacctcagcctcccaagtagctaggactacaggcatgcactaccacacctggcgactttcgtattattatttttgtagagactggggtctccctttgtttgccagctggtcttgaactcttgggctcaaaggatcttcctgcctcggcctcccaaagtgttgggattacaggcaggagccaccacacccagccagatgcttgctcttttaaggtccttcagaagacatggggccaatgacttaacttcccacttaacaaatgtcagactgccaaaggatatctgtgaagcaagcagtgatcagctgtagccaaatatctatagccagtatgaggtgggagactgaggaaattgcctgaaattagaggcataaaaggctatcccttcacaagttacccaggagggcttggtcctttccctctcaatcttgacttatcactttccttcctacaccaaacagtgccgaacaccattaagctccatacttatatatgttggtggatcagacagactcatagcatttgacattctgaatggatttgcttcaggatccggaagaaactgtccctttgggaagagcagtaatttttgcatctagcctccatggaaagcaaatctcccaaggaaattttcatgcctggaagcacatccacttgaggcatacaaattttctatagaactgaaaatattaacattacattctactagagatagaactctgctttcatgcattcatttattctcatatatatatatgagaatatatatatatgtggctgggcgcagtggctcgcgcctgtaatccaagcactttgggaggccgaggcaggcggatcacgaggtcaggagatcgagaccatcctggctaacacagtgaaaccccgtctctactaaaaatccaaaaaaaagttagccgggcgtggtggcgggcacctgtagtcccagctactctggaggctgaggcaggagaatggcgtgaacttgggaggcggagcttgcagtgagccgagatagcgccactgcactccagtctgggcgacagagcgagactccatctcaaaaaaaaaatatatatatatatagatatatatagatatacagatatatagatatatatagatatatagatatatatagatatatagatatatatagatatatagatatatatagatatatagatatatatagatatatagatatatatagatatatagatatatatagatatatagatatatagatatatatagatatatagatatatatagatatatagatatatatagatatatagatatatagatatatatagatatatagatgtatagatatatatagatatatagatatatatagatatatagatatatagatatatatagatatatagatatatatagatatatatatagatatatagatatatagatatatagatatatagatatatagatatatagatgatatatagatatatatagatatatagatatatagatatatagatatatagatatatatagatatatagatatatagatatatagatatatatagatatatagatatatagagatatagagatatatagatagatatatagagatatagatatatagatatatagagatatagatatatagatatatagatatatatagatatatagatatatatagatatatagatatatagatatatatagatatatagatatatataggctgggtgcggtggctcatgcctgtaatctcagcactttaggaggctgaggcaagtggatctcttgagtcttagagtttcagaccagcctgggcaacatagggagaccccatctctacaaaaattaaaaaaaaaaaaaaaagcacggcatggtggtgcatgttagtcccagctactcgggtggctgatgtagaaggattgcctgagcccgggaagtcaaggctacagtgagccacaatcacaccactgcaacctgggtgacagagcaagatccggtcttaaaatatatatatatatatatatatatatatatatatatatatacatatatatatttatggactgcctactatgtctgaggccatttataagcatccagaagctgctgctgaagaatctggagaagctcctgagagtagaatatggcccaagctgttttttggtcacagatactactcggtaaacatagccccatggctatgacaagaacaaaggatgcttgatatgttaagtagttcagggcttgggttctgaatatagggttccattttagctccttagcttttaattgctaattctgcattctctttcagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaaggtgcgttggttggaggccctgcttttggttgactgagattctcacctagtctttctaaactttctttaggcatcagaaacataacctttcatataattgtaatgataatatttctaataataatgaatttcattctctcttctcttgaaagactgaaaaggcagttgcttggaagaaatttactacccagaaatatgcttgtgtctaccacacctctcatgtatccctgagtgttgaacttacctatgcttttctaaatagtagagaatttaggctatcatgatgataaggaagaatagtagcagctttcatttatatcactattaaacccatcaaagtacaatcacatccattgcccttttaagacaggacgagaggcaggtgagttatagtggaaggagaccaggttctgatccaagcctaagatgttgagtgatcttggaaatgtgccatatccattctgagcctcatcagccttatctgtacaattgaaagtttagaaaaattatctctaagctcccttctaacactataatcctataattatattattatttattttttaaagataagaaaattgaagtacaaaaatcaaaggacttgcccagattcattcaactaatcaatcataaaaccaaggcctataacccaagtcacttccagcccatcgttttttctatgccagtagaaaatattgactgataaaaaagacaagttaattatttaaatggtagtttttaaaacatgagctaaataaaaatatagtccctaatattggggttgacagaatataggatgggtaatcaagcattctatctctgtcttgccacaggtttcctgtgtgatctataacaagtcacttcacccctctgagcttcagtttccttctttgcagaatgagagggttagagtagattttttggggggcccttacagctccaacattcgaagagtcgatgatttagtcaatcccaggcacatgaatttatcatttcttatgcttctgcaaagcatttttataaacacagatgaaaattcaaacattttaaaaagtaggtagagagctaaattatatacttcttcaacttagtccctcatgactagtaggcaaacatgccctgaatcaatgtgtatttattgagcattttcctgcaggccagtggtactcaaacttgtctgaacattagaaccccttggcgagcttctacatatacctgtgtcccatccccagagactataatttaattgatttgaggtgtggcctgggctgtggcatttttaaaagatccccaggtgaacattgtgtgcagaaaagtttgagaactactgctgtaggcccagggtcatttatggtcttgctactcaaagtgtggtttatggactggcaacagctaggagctggttaaaaatgttgactctcaggcccccactcaagacctactgcatcataatctgcattttaacaagaacctcaggtgattctaatgcacattacagcttgagaagcactgatttatgacacaaaatcttcctcaatgtaacaacccccatcttccagagtacacagggggcagcgtgtggacaggaaggacaggagctatttgataaggtgtagagaactggggcattgaaatttatgagaaaatgtatttattacgaatacagagagaacacattctttttatttttttttttattttttgtttttttgagacagagtctagctctgtcgcccaggctggagtgcagtggcatgatctcggctcactgcaaccttgcaacctccacctcccggttcaagttattctcccgcctcagcctcccgagtagctgggactataggcacgcaccaccacacccagctattcaaactcctgagctcaagtgacccactcgcctcagcctcccaaagtgctgggattacaagcgtgagccactgtatccggccaatggagagagcacattctaaggatgatatggacatccgggccacccagcaacaatgacctattatgacttccaagtctgtggtctcactggatcctcaaaccttttagtatcacatagtggtagtttcatgaacacaattttctcttctgtcaggggtctaacacttaatagtttaaaaagtaatgcaacaagataatttcagacaaaaactaatatttacacaaattacccatgataacataaaccctctcattgtataatattccaatttgaatctcaggccttcagaccaagtcttatttcattgtgtgcttaaaattttattgatgcagatgattcaattaaaaaattaaataatcaaaaagctgtgagaacaagacaaacaacagtcattgcttttaaaacaattgtcctctcaggttggtaatgtttattaaaacatttggtggccgggtgcagtgactcacacctgtaataccagcattttgggtggccaaggcaggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctcaaaaaaaaaaaaaaaaaaaaaattggctaaaaaattccacttctaggaatcctaagaaagtaaccacagacatgcacaaagatatacaaataagaatttttgctgcaatgctgtttacaatactgaaaaattggaaataatctgaaagttcacgaatatgggaatgattaaacaaattatggtgtatctgtaccgtggaatattaatatagccattaaaactcattatagaccaagattgaatggcagagaaagatgtttgcaatgtatttgttaagtaaaaatagcaagctaaagaacaatatgtatattatgatccaactttttgtgttaaaaaagaaagcgttgaccaggtgcggtggcccatgcttgtaatcccagcactttgggagtccgaggcggacagattgcttgagcccaggagttcaagaccagcctggacaacatggcaaaaccatgtctctaccaaaaatacaaaaattagccaggtgtggtggcatgtgcccatagtcccaactactcctacttgggaggctgaggtgggaggatgggttgagcccgggaggtggaggttgcagtgagccaagatcgcgccattgcactctggcctgggcaacagccagaccctgtctcaaaaaaagaaagaaagaaagtgtttatatatgctaagacaaaaaaaagaaacaaaaagactggaggagcatacggcaaaatgttaacagtgaccattttcttgtgactgaattatgggtaactcttattttcttatttatttatttgtattttccaaattttctatagtaaatatgtgttacttttgtatttagaaaacataataaaatttatcatgtaaaaaactgccctccagtatcccagttggcagtatattgaagtctgaatgattaaaccgatttttctggaagagctgcttttcccactttcccactctgctcaagtttgtggagatagacgattgattgagcaacatggaagaagagaatttctgtctcattctgtgtatctgcctctcagtgagccagacatgggtgtctgcatgttgaatcactccttagtcacattgcctgagagtcaatagccacatagccaagggcacctgctccaggtactctgcaactgcagagcatcaggaggcatgcacttgctcatgcattcaatctggaaatttgttttaagtacctactgtgtgcaagacacggttacatgcactgaggacagagatgtgaacaagacaaaggctacttgccagcatgctctttacattctagcagaaaagaaagacagtgaacccaaatcaataaggtaattttagattgtgatgagtgctgtgaagaaaaaccaaacaggatcaagagagagtgaatggggcaggaagcacttttaaaggagtagtcagggaaggcttctctaaagatatttgaatagagtcctgaatgacgtgaaggggtgagaaatgggatgatcatgacattactggcctcttaaaaaatgacacatgacacagaagaaaaggaacaaggcagtgaggagagaagtagatggaaggaagaaagaatggtaaattcagttatgttgaaaagggaaaagagataaataaaattcactgataatccagccaaaagtttcattgtaacaagtgattgcagcctcctacaataacaaactaggaccaatattaaagatgtgagtttcatctctctcttccctttgctctggtagaggctgaccttgctttgcatatcaatggccacctacagggttgggtaagatgtccacttcctgaagattccccaactcacttctcacactgtcgtgccaaactcctattaacctcagtagggaaggcaccagatttaagaggccgaagaaaagatccagagccagcaaacaagacatggggttttattaggggctgacatacaggggagagagtccagtggaggtgggctggacaggagaaccaccttacatatagaaacagtccagtggcagcaggttgggcaggaaaactgcaaccacttgcaaacatcatgcagtttatatagcattttcactgaacactctccccttaacgacctggcaaccttcatctaacccaaaactcaaggcctctatcccctgtgcagccccagggatgagcctggggttcagatggtcctcacagacaaggaaataatctcccagttggccacgcctggattcccaagctcagaacacacattcagatacgtctgccatacagggtcattctaagggtacacttaagttattgctatcatgagcatttactgtacatacaaccacaataccatcccaataccttgaatttccataattacatactccttttaggttatggcattaaaagtccctattaagacttaaaagttgtcccagctggaataatacttctccttcattaccacttctgcaaggaattctggaaggctcaggatgggaacattctcttgggctgtggaaatggccagaaatgacatcaagcacattgtcttccccaaaagaaaatgagagtaggtgaactatagtgatcagaaagcaccttgaagtgcagagtgtgaaaaacggcggatgttgctaagtaggtagttctaaagacaaactttgcttttcttagcattttcaagtaccagccagagttaagtcaataatgagttttgttgtttgtagatcccttcggtcaagtaaattaagctcttgtagggaaggaggtagtggtgcaagatgactcttcaggctactggaagaacttttagcatattacaggtactgccagtgccatcatggatttcatgtcagctatagctgtagccaatattaagctggtgagcaaagtttgagaaatgaatttggctgtcattctaaaggtgataattgaatacacagaagtctctgtacactcagtgacctcttccctctctccaacccatttaaaaagtgctagcacgtggcccttaattacctatcaccaaaaagactggcccaccaagtaaataaatagctaaaaagaaggacaaaaggaggaaaacaaaaagcttgattccacaataatccacaaattgagtaattcagtctggaatcaagagaagactatggttttgtccttacaatgccaaatggtggtgggggtgggaaagctaatcaggttaccaagagacatacaatagcaatttgattacaacttctagtccaaatgtgtctgattggctaacagtgagtctccctaattagagtcacagatccaaagcactcaacactcagtggtttcatcctcaacaattcagatattcttacagatggcttctgttgttctgatttgagtgtatgctttaagtacgcagttcaagagagtactgattacaaggccagcaagcaaacttaactcactgataaccaacaagaagaaactttttaaaacaggggactgaggaaagaggagggagggtggagtgaaatgtagagcttgtgcctttatgcctgcgagctgaaattcaacagtttagtttacacattaaatgatccatcgctgagggacttgaccaattttttgtgtctcccaaccattcatttggcatagcatacatatggctaatctgacatctagattttggcactggtgctgatccggtattattgttccccttacaaacaaatcaaagagcattcagaaatgtcaagccaatttggatggatcctttgggcaagtatatgcacataaatgagtgtcatgaatgttttctaagtataccaaaatgatgtcaggggatgttaaccaaggccctttttcagcccattccctgggcctctcctggcaacactgagctggacagagcatgatcctgaccctgtatggaaattcctatgttctcttaagtgcctaggagatttgtacctggctacatttttcctcatgaaagtccacttctcagtgacagtagtaggggtctagtgttccgaagaactatggattctgtcaacacatggacttcaatcaaagttacgtgctcctttgtgatttgtggcttaatctgtggcttgttgcagtggcagcctaagctgggctaatgaagtatgggtggaatttctgtctctcgaagaatgttcttgttaattgtccacttttgataagtgtgagatgttatgaacaatgagatacataaatgcagaagttcacttctagctttagaaaaccatgacaaaattctacttgcttcctgattccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggtgagcaagacaacattaatttctcatctttgtaagggggcacagaaaaggatgagaggactcactttaattttgcttcaacctgttccctcatttggattaaaagttctttttgattgcttagaaactgacatatctaacactattgtcattatggcctttcaaatttaacgatggcctgtgctaaagatcaagtactgacccttgggtttccaaagctgcctatttcacaccaccaaaagctggagaagcggttctcaaccctggctgcccatcagaatcatcagggagagttttggtttcctttaaataccaaatatctgggccctacccccagagattctgattagttggtctggagtggggcatgggcatcagtgtttgttcataatgcttctcaggtgattgtaatatgtagccaggattacaaactgtcaaactgtagtctgtcattctttccagaataaagctcaacaaccatgaaaacccattcattcagggcaaagctaagtccctaatatcacgatgtgtcttctggggtaaaacaaatttaaaacatcatccctgccctcaagaaggttatagtcttactggagaaaccccagtcacaatgttcaattccttttctgattactcacagtgactaccacagcaagccacattctgttcattgtgatcctacagctcttctaactttttgtaggctcaagactagtgcttatttagtgtggtcaaggttcctcacaatccaagtggataagtgagatttcagctggaaaatatacacatctttttgctattggctctcacataaggctcaagagtactcgaacttctgtatgcatcaccattacacagggagctggttttaaatgcagatacctggccccatcccagagataggaattcagtagaccttgggtagagtccaaacatttgagtgtttaacaaatagccagatgattctaatgcaggtggcacttggaccatgctttgaaaaagactgctcagtatttatgaggctttttttctctccctttagacaacagcctttatctaaagaatgcatttctccctaaaaaaaagatgcttgaacatgtatatattcactcatgcttatttttggtctatgccttggagtgttgatttgccatctttaactccctagctcatccataacaggacacctaggactaggcactggtttgttgcgtttccccagcagtgggcccactattcgtcatcccacatctttcgcctctcagaggtgtgcagatgaatttcaacttgctaatgtagcgtctaaatatcctcttgttcacagttctgggttatcaaggtctatgcttggtggacacagaaaaagaggcttaatctacttcgcccatttaagtgggctggtaatatgttgctccttcagtataaggcagttgtcagttgtctacctgttattgtgataaaagctattcaggcaaggttgagactgtggagagcactctattttaactctccccatttatgaataaggaaggctaaaggatctgtgaatatttcccaaaggaaaatatgcttttcagtgagttcaagaacaagggtggcttctccatttacaaaaccaacctgcctgcaatcccactgcaggctctcagtgcttagccaggagggcagcccagcggtttggcatggacacagtctatccaggttgggggcaagtgcagaatttctaatactgcctatggctgcagaagctccagtaagcacttatgctagattccatgtggctttccctaggagagagtcccatggtcagcagcactatctcccttatctccatccactggagaagccgaggggaagccagtaagccaaggaaacaaatggagtcaattataacccttgagccatccaagttcctggttaagcacattacacagcccaactcgatactcttaagccctagtaatgaaatgatatgctgagcctgagcagaaaaaaaggagttgatggttccagattgagtgcctgaccatttgctccactttttgcttggccctaggcattctccagcacttccatattgagaagatctccaagaggatgtttgaggagcttcctcacttcaagctggtgaccagaacaaccctgagtaagtagtacttctcttgactgctccctgaaaaacacattcagttttcaatttagcatagccacagctaaagtccctccgcaatctcagtgaacattagcactgctcagtatcaacactaaaggatgttccatctctcttctgggtgacttagcagtgaatggggtgtctgaatgtaatctgaagagcttggacatggtgaatacaaacccagatgtagtctgagcataggatacctcaggtcaaggcttcctgaatgtctttaatgaaactgctaagcacagagtctcaagagggttggagaaagctcataagattccaggtctggtatatttatggagacttcacatctggaagggtgtatcctctggtggtgggtatgagaggcaaagagaaattaaaggcatatcaattcctgtgttatatgaaagcacttttactcctggggaactgcccctgggtggtcatgtttccttaaaagcattcaggcactcaaaaacacttgcagctctcccactttccacactagatggagcctagggactaagatacttctaggcattggggcgggtgttgagcacttctaatgggataaaaggcacacagtttctatccacagggaattataatggatgagacagaacatgaaaatgacttcagtatgaattagtatagttctgaggagttaaatatcaaagtgctcaggggaatctgcaaagaacaatgagatgagagccaggtgggcttagtcggggaaggcttcggggaggaggtgtgttttgaaagagaagggtatgactgggcaatgggtcaggaaatcagtccaggaaaagagtgcagcctaagagaagactcagacaggagcaaacaggaaatgtgggtaggggagaggaatgatcacaaaggccacagaaggtgcactaaaagattagaagatttggaggtagaaagtagtcatagggcctgaaaaaaagccagtaaaatgttcaaatgtaaggcaagtagcatctgtagttgctgcaaatagcatagagatatcaacatggtgctttggaaagatgtctttcggctatcagatgcatatattacattaagcacacactttgacgaagccagattatgaagtgcccaatttatcatgctaggacattggacttgatctccaggccagagaatgccagtggaggtttttaagcaagtgaatggtgcattcagatctgctttatttatttttttatttttttagaaagaggtcctcgctgtgtggagtgaaaggtggacccttattaagagaagtgggatagtctgaattaggaactaattatactatattaaatcaatgagacgggaggagacgtcactgtgagaaacatttctgaggttaaatcaacaagatcagcatcaaagagagaaacgagtttggaatgggtccgatattaataactcgactgggtgaatagtaataccattcaccaacagggaaactgtgaagaataagcaggtattggtgaaaaagagtttcacttggaacatgtttaaattaatatgcttaagagccatctgagcagagttagggtccaataggcagctagaaaaagagccaaggcagtcagttgcttgtctttggcaggactcatagaaaataacaggacagtatgagaattcaaatggaaaagttgggagtccttacatgtgagtaagaaaggaggcagagtgtaagatcctaggatcaattatgggacttctgaagttacatgttttagttcatactgtgaacaaggctttgttctaggttccaggggacttaaaagatgatttagatatactctgtgcccatggcaggatttggggtatataatggagtagaaggtatgtgcctcaaactgtgtgtagctgaaagaagttggtatgatcctacagggtcacctaggagcaaagaagaacaaacccaactcttttatataatgtgcctagcagagcccagcacattatagggcttcagtaatagctggttccttgcccaaatcctcttcttgtttttttgtttttccttctatcttcccattgagtcatagagaatggggaaaagggagaaatccaagggagaaaggagcagagaaatcaggcccatagggaaggtgggtcattattctcttgtggctaaggaaaagaaaaagaggttcaagacaggtttgggcttaagaggagttggcttaacttggactaggagttctccaggttgcagtaccatgagcacaggaataaaaagaagacaaaacacagtatccagggtgggcagagacaacaggggatggaagggctacagccaagtttactctgcgtggaaagggattccatggggtatatgagaatggatgaggaaccatgggaagggatttagggtgctaagggggtataaggacagcatgtggacgtaggagaaagcaacgtcgagaagtttttaacaaaagatagcaggaatagaggaaagagtgatatataatcaaatagtaatcaagtaacccaaaccaatatttggggaccctaagggtaagcaaagccccagtaatacagtaggtgccgttttccaaagtgcctttttgacctggtgccaagtaagctgcctaaatagctaacaagcagatattgaagcattttgtaaatgctaaatatactgtaaaaattccaagaataacacttaggttttgctcttgaggaggggcagttctatattattcttgggattcttacaaatgctatgtgttgaaatgaaaacttcatttcccattttccatatctgctactagaaaagtgttttggggccattttttgaaaccaagtgatatttgtattccaaattccctggtaggtccatgagtaagtgggtaagcatggggtatattggttctattcctaatttgctctgctttcctcttacacactcccggccactttgcgtttgtttgccttttaggccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaat

SEQ ID NO: 3632 - DNA, 122194 bp, human
gtgcttgcggacttcccgccagcgccgagcggccggcttctcgggccaagtggggagcgagcgggagggcgggcaggtggccccgggccgccgcgcccgcgccttggctctgcccccgggagccgagcaagccgctgctccctcgtggtgtgagggcggtgatgtttttcctcccacccacttttgagttccccctcccccctcgcgcgcactctagctctcgccacaacctgccagccccagacctcggacgagagcgccccggggagctcggagcgcgtgcacgcgtggcagacggagaaggccagtgcccaggttagtgagcagtgcccggcgcccgcttccctcacctccttttccagcctttgcacaggtgggttgccttctcttggccggagccgtccctggaagtttccccagggtgccccaaattcccctgccaccccaacctgttctgtgctccagcagttagcaacctggatggaggtggggcccaaggcttctgaccaaagcaagttgggggtctctgaattcgaactcacagctcgtccctccccactcggcctgcatttctttatgctctggcgctttgagaggtcacttaggtactccaccctgagctacccaagggactctgcagtccccttaatcactgcctgtattcctgagcctgttttctcattttgctgatgaatacatggtaaagttaatgtagcagggtagatgggcgaaaggctccctatcctatcctctggccatctgcctcattttttgtccctgactacgggggtcagaatttgagacactaggctctggaagcaacgtggtatattgccagaacatagggcccggaaagcctgctttccagtccctcccagccctgccactaaagttatttgagttctctgggtccccccagtgcccattttgaaggtggagttgtgtggaatgaaatgaaatgatagaaaggtgttttgcaagccaaatgcgaggcattgtttgtcagtcataagcagcaatgaaagcatttcctccaacaagagataccctgggttaaaactgccattttcagtggcaacacaccaccagttaactgaacttttcttgctgggtggtagagtggggagaggatttcagctgatggacaagggcctgggactccagtgtctttcttattgtttgtcggaaagaaaattgctaccctaggggctgtcccacagatgatagtcaatgtgagattacaaggtcagtcaagcctctcaggaggattaaagagacactgtggggcgtgaagaactggctgacatgtgttcatcccttagccttcctgtggggatgtctctttgcttctgttctacccaggagacctgttctgaaagtgggctcctgacacttgatggcccagattgccttgcagtcacagctgggcaaggagcagttggtccctttgcttaacgcagatgaacaatgtgaatgcttgtttcatggaagcaccttaataaatacctttcttttggtacttgatacatttctctttctcttgtaaaacacaggaactctcccatcccacctccactacctgtgttagttgcagggttttgtttttttgttgttgttgttgctttcttgttgggtcctggatcccctgaagcatgtcaatggctacatgtctaagtaacctgtaaaagagccagtgcaagttcaatggcacaacagcctgtgtgaagcagacagagagttaatgcagaaataactccagttaactgggtcaaagtataatttgaaaaattaaggacagtttggctctttgcaagaataagagtcggctaagttcgctgagcaatgcttgctagtgtttactgctgcagtcccaacacatgttttgaaccacccccttccctaaaagaaaaagctgaagagataaagagaaattgaacagtgaggagatctggggagggaactcttcttggttcatatttctgcacagaatacaaaggcaggacttcaggatcttgtaaatcaaaagtgaatatttataaagcgattcattttctgatgttctccatcacagcctgggaggccacacagatgacaggaacgccaaaggagattaattgctctctagttaccaacttttttatttgctcataatattagttgggacctaagaaaggcaaaaaaatctatgagctgttttcttgccaacttgagttatgaagcaatgctacagttcaccgaatcgcccaaccattatacaagaaaagcagccctgttgattctcgcatggggagaccctaaaaccatggtttcagaaacacccgttgaaatccatatatgaatgtgataaattggatttcagtggttaaaaatctttctcttttggaggcttggggaataaacttattagaataggctcaggaagaacctcactgaggtgggtagctgtgttaaattgttaatgaaaatgatttgtttcgaataaacgtggtagccctcaagggacagtaacattctgagtgattgtaagtgggccacaaactcacagaggggaccaagacatcagaactcaggtctttagatgggtaggaacatgtcctgagagaatttggttctttaaggagcagggaggaggtaaagaaggaaggcagacggtgctgcaaatcttgtttgatagcacagattactctatcatcagttcttccttggttatgcattcataattgaaacagtggattttgaatgacccaggcaacttcatagcatttaagtaggagctgtagcatctacttcagagcccaaagatattcaactctccaaaatgatcgttttgcattccttcaagttctttatgtgcaatatttaggttggactttctggaaagatcaatgagttcatttcccattcagattgaatctggtgtttttagaacatttcaatattttcagatcacccattggaggaattttgcaaactctaacatctgtggaaatgatccgtgactagatgtgagctacagcaaactttctgtgttccaaggttcaaaaggtttaagatttctaccccttatactgggaatgccaatctcatgttttgaagaactgtagttgttttaatggtcttttgcatggtggtgcaaggtgaacaaattatctatttaatttgcccaatttcccctaaaaatggcccatttaaaatttccattttacaatggacttcttgggggaggaatatgttggaaccattttaagcagtaaaacttttcaggtgtttaattgcatccatttgctaattacatctatcttttgcaatattagttgccaaaccaaagatccttgtagatctcatagaggacacaggagaaactgatcaatttgtacttcattccaaaaggattaaaagtagtcttgaagctaagattagttaactttcatttcagaaattgcttggtctcatgcttgttacttttaccttgtttgctaaaataaccgtttttgcaagctaaagtttcccttttctcccaaaaaaatctcttgagaaatcaactttaattcccttagaaaggaagatttcaaaatttattttcattttcctataacttgcctgtaaggacttagcctcagctttggataggaatgcaccctcattcacttgaattttcacccacaagccttgcaagacaggagaggcaagtcctttatcttgtgcaggcagacaatacttacacttatgtaaattctaggacattttttttttattctagcaggttagaagcctgagcatcagtgacctctatcatttccagaagatctgtgttaagtcttttttctgctttcttcccaacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacgtaagtgtcttgcatttggaaaataatacactttttataatttctttgaaaatgtggctataatctgtagcaattatgatttagcccaaatgtggccgtgccattattctaagagaagaaagtgaatgttactggtttatgcatgaattgataaaagaatgagagctttgaatcaggccaactaaatttggggctgtttttctgattatcatgtagtctttgtctcatagaacatatgacacattagcttattttctcttccctgttctaaactatacaaatctcattacattttacgtaactctagaaatatctgacagatgagctggaattttcccaaatttcagactcttcagcaaaggctttcagtttatgaaaaataatgacacagaaaagaaaaaaaaagaaaaagaaaagcaggctctgcctattcccttatgccgaaaaacgaggaaggacgaaaccttcctatgaactgggctcagatgaaaaatgttttgaggaaattgagattccagggaccgttagcaaattggatgccatttattgaaaagaacatccccgcaaagccagggaatatttctagaaagtcagcgatccgtgtaatgggctaacacattggagaaagcagagagtggcaggaagtgggggcgggggggataattaaccctccttgctgccacgtttaggagatttatgagtaacggtcgacatatccgttcttgctgcctttgcacaatgtgggtcttaccttctttgggccacttgcagccatctctgaggtagatgcttgctctaaatttgaaggaaaagcctaagctctagttcccctttttgacagcatcaaaaaaagcacaaaatggaattggtccaagaggggcattctctgcttcactgaacttattcatgagaaggagctgtgaaaatattcttggtaggaactgaagcagcatctgaagcccttcacttaaacctttatctcttttatcacataagttaaatagatcaggcagaaggcttgctgacaaggagaacagtgccaagcctattccatccttaagtgtgtttctgtcccactacaattttcatagtaagtgtagtcttcttcctgggagaaacagtgtttaatagtgtttttgattatgcttttgagcatgagcggtgtatggtgatatctagtatgattgggacacaaaaggaagtttagtggggcatgatctcagcaaggaagcttggatcagcctctactcttgtatccctcaaattgcttccttcttcttccacttgaatatagttcatctcagaatcctcctcttccagaagccttccttgatttaagtggatgtgacagaagcatccatgcattctcagctcagctcacaattagctgggcttagggatgaaatattactcaataagtacaatgtacattatttgggtgatggttacacttaaagtccacactttatgcgatatatccatgtaacaaaactgcacctgtaccccttaaatttatacaaaaaaatcttcctgtcttagagagaaacttcccttatagcctgttaatgatgacctcatggggaaagcttgtaactctcagaagaccatctcttatggaaagcctttcatatttatgaagaattgaatattgtccatgaaacttagacaaagaaagatgtgacttaaaaaaattacaaacccaaatctactactttctaatatttccttgtgctgatgaatttgtcccaagcccttttgatattcaattggtgccaaagtgattatgtaacagatggcctagggcaccagatctggtccagtgtttcaggcttattgtcagatgatgacgctaaggtcatggtccttcccttagtgagccactgagcatcattatgtgtgtccatgcccaagctaactgttctgaagacatgcaaaatcatctctgctaaagggaaaacctcaaagcatatgtcctatatatgctgtcttgatatatgcatgcacatacacaaacacacacaatatgcatgcacagagatttatattgcagctctaacagtgagaagtcagaagcagtggaaatgtcagttcatagataaatagttacaaaaatgatccaggtaatgcaatataatgctactattaaaaacactgtttattgaaaatttggtggccctgggaaatgcttgttaacttatttttaagtttcttaaattataaaattaatatatatgcttattatacaaaacaacatgaaagcatctgagcttcatatggaacatgtgtccctaaactctcattccactctcctgggataaccattattagtggtttgctgtgtgatcttccaaactactttctttgttttataaaattatatatacatgcctgtatgatattttattttacaaaaataggatattatatacacttttctgtgatttgcttttgctcaataatgtgtgtaggacatccttccatgtcaatacattgcaatgtaatagtgccatattctttctaatgcttgcatggtttgcagttgcataagtttgcattggtttatttaaccagtctatatttgtagatattgaggttgtttccggtttttgctattaaaagtaagacatttatgaacatctttaggcacttattcaagtatttgtgagaaatagtcgaagtgcatgttcagttttaatcttcataagtactgtcaaattgcccttcatataagttgtattaatttatgctcccaccatctatgtatgaaagtccatttctaattccttcaccaagattataatcaatctttgtattttggggccattttaataggagaaataatctgtaagttttgcttggtatttttctctttctgcagcatcttttcgattatgtactagttcaattttatttcttcagtgaattgtctatttttagtttggttgcttgtgatatttatttgttaaaaacttacttattaaccttttatattttaaatattatttttgatatgccacttgttttaatctttaagttgtatttttcccatatagaagttttaaaattttacgtagtcagatctgtcattcattttctgtatggcttctggatttcttattcctaggaaggtctttctcaccctatatttttatattttcttctactgctgccataattttatgttttacccatagttctctattccatctgaaatttatattcctgtatggtatgcaatggggaactaattttttttaaatctccggatggtaggtttatgaatgttatttttgctcacttttatgcttctgtctattccaaaatttccacaattggcaagtttcacttttaaaacaggagaaaagctctttttaaagtaaaagtacatcttatttcccatatttttactgtgcaactctagagacaagttggtatgtgagtagatgaagaaacagaggggttttctaaaattaaaaaggaaagcaactggaaaaacttcagaaaatgggtaagagtaggcctgggtcataaacccttcacgtctctccttgtctgacaccattttaccaaaagaaggcaaagttttttatcttgcaggggctggttagaatataagcttttaggtcaaggaatgtgttttgtagcctgtttgctctcctatttggggcatcacaggggaatgacgggggatgccattatggtcaaagatgctcactcaattgattcagaaatctgaagaggtgtggaaaaaacgctttgtttgtggaaagctcatcacaaggaatggtgaagatgggtgctgccacttgctggtagctaattagccatagttacaatttctcttataagagagaagacaggctcaggaaacccgaaaatactgatagtgcattgcaatggatgaatgagccatttgttgcttacataaaagtttgttactgtttagcatcagcaaggtttgagttctttagctgggaaaaggtccttgtgtataactccattatgctctgttgttaaagttgtagtcaatgaggccaggaaactcttttgaagttcaaaggagcgtaacattcacagcataatattcatgcaaatatgggataaatgggctgaagagtttgcccatttggcagatctaacttaggtaatgaactattgatcaaagtgaggttgaagaattgaattgttaagaatattcaattatgtatttctaatagaccagcctgtgccaagtctggcaaaggttctggagagagaaattgttcatgtatttcatgcagtccactcctgctttacaaggtagttaactggatcttcaaggagctagattgtcacttatttttctcctcaagagaaaagcttccaatattcagatttggctaaaagtgggcctctggacttctcaggaaaggcaagccaccaaaagattgaagggaaggaagaagatacttagaaagtttgaaacatgtgaagcccacttagaacttctctattgtgagagccagccaggaaggcatgggttttcctcctccagattctcccttggtcatttgaggtgattattgagcaagcaaatgcgtggacctgttcacatcttagaagtttaattaagtggaattagacgaaaggaatacctaaaattagatagcttaatgcttttcaaagtatattcttaattgttttttattttggtgagggggcagtaggttttgtcatggaggctctgtagttagcctagatccaatccccagctccttgacttacttatgtaccttgggaatgttacctaacctctccagctttcgttttcttatcagtacagtgggggaaataatagcataatgagcgtgagcattgtcatttgaagaagaaacgagattgtgtacaccaagtgctttgcatagtggctggcacatagtaagtttttcataagtagttgctattagagcaactctcttacaagccaaagatattatccccttaattttaaggtgagaaacttgaaactcaatgaaatcaagtgactttgtacaaggacaagcagcaagtcccagccagagctagaaccaaaacccaggtctccgaattaagtgttctgttcactatacccatctgcctcttggaattctttgaggaagtcagttcattgtcttgaatagaagcccagtcctttatacatggcagccacttaacacataagagatgatccaagtaaatgaataaaaattttctaacccaaattcctaagagggatagtatactatttgggagttaaaagactgagacaaggactaaaaatttttcaggaacctacatttgctaagccaaaggaaagtagtgaggaaggttaaaagtatgtgcgtctatgtctatgcttcttatatttccctgacttctcagtaggattggaatgtcttcatagtttaatggaaagaggactgtgcttaaagtcaagagacctggtttccggtcagtcttcccttgtttgccgtgtggtattggttgaatcattcgtgttctatgaagtaaagattcactacttacaaattgaaaagaattcttgccttctggactgaaaactaaaggagaatagtataggggctggggaggtggaacaagggaaacgaaggccctggttttgtgtacttggagcaaaccacatggatatttaatattgtcacaaggtaattgcaaagaatattttatccatttaagatttatagcctgtctgcttctagaaaggttagatacacattagagatgaaagaataggggcaagataatgtttttaaagatgaaataaaatagagatcatctgaagaaaatagaaggaatagatgtttttaacatttggtttagtagattatagcatttataatgtaaatctggcttatgcctcccaaaaggatgaaaagagaaactttgggtttgttgtcaagagaaaatttacagtttcatctacagagattattcccacctctaacccactcaagcagtattgatcctgggatgtttgaataaggcacattctgggtaaccttggtttcatagaaaaaagaattgtctggcatttctttactgatgctttgtaaaggaagaaggcaaatattaaattataattcaataaaggactttctataagcagtaaggaaatgcattccaggtactttccctttgaatgatctaaattggagaatagaacatggaaatgttaaatagatgtttaatatgtctactagactggattgtcaactatcagatgccctaagcaagctttctattaacatgatttgtttctgattttaaaaatagatgctcattgttaaacattcaaaaggtacataaaagtatagggaaaacaaaaatgaacagtaatcacaacgtgtatggataaccatagttaattgatatatatatatacttgtagtctttttttctaagctcagttatacaaacatattagtttacaaaactgaagcactttttaaacagtatggatcagggtttgtttatttatttatataaacttaggggagacaagtgcggttttgttacaaggatattctgcatagtggcgaagtctgagcttttagtgtagccatcacccgaattgtgtacattgtatccaataggtaattcctcattccccatacttcttctaccctcccacctttccacatctcctgtgtctgtttttccaaaatgtatgtccatatatacacattatttagcttccacttgtaagtgagaacatgcagtatttggctttttgtttttgagttgtttcacttaagatcaattcacaattggagtctctaaaatgcacttgtagtaaagacaacatcccatgttgtctgtaagtgaaagctgggcggtttagacacgagttgcaggatatgcaaatttgattctattgtgagaagttcaagagctcaacttttattctctaccaaagggaacaaaagtattcctgatcaaacagaaagcctcccttcacagagatttgcaccgctaaagtgctgataggaagaacagtttggttttttgaacaggcatttttatttttgcccaaagttctatgccatatgacatggaagagatgatattagcctgaaaaaatattcaggtcaggtttcatcagcttagcagcctttctgtaaaaggatctcctcatggcctcatagtagacactaatgagaatatcatcaactcccagttatttatgctaatgaaagatagaagggcacaataaattgaaatttcatggaaaatctccagttctcatcttaatggtgtcaccttgcttgactgccaaacttctttgaattatggacccttttcttttcgatgggtttgcccacctgctaataggaaagtaaaataaccacaaaacaagtagtgagagggccatgctgtgggaggcccaggcaggtgaatcacgaggtcaggagttggagaccagcctggccaacatggtgaaaccccatccctactaaaaatacaaaaaatttaggtgggcgtagtggcgggtgcctgtaatctcagctactcgggaggctgaggcaggagaatcacttgaacccaggaggcggaggttgcagtgagccgagattgtgccactgcactccagcctgggtgacagagcaagactccatctcaaacaaaaaacactcagtatataattttgggcaggtgatccagcaagtaggaaaaagctaattaacttctgaatgaaggaaaaagctgcatacacaggacggagaatgttgcttcttcatgactttctttttttctctggcgtctgcaggctggaaatgaagtcttaaagtcctgagaaaacatgaaacagagtcttcaactctagaaacccaattgtcagtgaaataagaaacgttttccccttaactactacatcttgcccttcctacattctgcttcaagtttgataaatgacagaagagacgtacttatgcctttattttttcttcactcttctagtagccttttaaagaaaaaaataattaaaaaggaatttgtttacttgatgtgtccactcatataatgaatagcagagattcatctttttttccactgaccatgtgttataatagaataaatattattgtaatactgacatgacaatgtgtctacagtaatagcgcttatcaaaaacagttcttgggaatgttttcttgattttggactggtgatgaagttactgacctttgcctaatcctgggagctagtcagtaatgattggcaaaacattgatggcatagtgacacgtatctgttgttgtttactttttgtcatcattgttcctattaacaggggcccctaaagtagcagagatagccacctctaatgagggcaagctgatacatttgaaaaatagctgtgatgttgcaggttgaaggtccatctcacaagttagttggaattcctttgggaccaaattctactctcagacaccattagttagcagtaagtcatgcatctgatttgtgctttttgtccaagatgatatactgggattttatgtgttattgattatactgcataactcattaaattctctccttggtaatgtcaacaatttttaaaatttcaaacttataagcatatactgaaattggctttatcatagtttctcaaatttggtgattgtccaatgtgttcatggtgaaattagtataattgtgctaaccactcaatattggacaaccatgctcaaacacgtcttaaaaattatggtgttccagcacttttggaggtgaggtgggtggatcacctgaggttgggcacagtggcaggtgcctgtaaccccagctactcgggatgctgaggcaggagaatcccttgaacccaggaggcagaggttgcagtgagtcaagattgtgccattgcactccagcctggacaacaagagcaaatctccatctcaaaagaaaaaaaaattataatgtttacttttttgatatgctataaaaatatcagtgtcagtaattgcagaaacattgtttaatagcactaatggcgtgaccattcagctccttgtctgccttcagttcctaaatttgctccttccaggagttgtaggtttctgtctgggtcataattagccaaatcccatgttgctgagataataagaccaatacacttgatgaaataccattatgttttcattttagatcaggtttctatcagcagttagtgtttgagtaagatatttgcatcctcaagaagcatagtttggaagacactggtacgtgggataaatgccacgtgaacaaatgaggaaagtgctgttaggtttaaagagaatgaaaaataacttttagctggggtaatcttgtcttcccatcaagatttcaaagcccttaaaagcatgagcactattttatacattatgtgttgtcactgatgtaaatacaaaaatgcaaaatagtctctgccagctgcactattttatatagtctttgttgagtattacttgacttcactacaaacaacattgatttttaaaaggtgattaaagttgtgttaaaaaggtatagtggaaaggtaatttgagaaaaggttagtaaagaatatgtggaagctctttactttccaagttctaaaaacagtgacctgcaccttaccaactacgtagcaggagaggcagaattctgtaaaggttatagtctttggttctaaagctacaagatataggtttgaattctatttccataccttgattagtcatgtcaacttgggcaagttaccaaacctctctgtgccattgattcctcagtggtaaaatggggccaataatgagacctaccttgtagggttgttgtaagaatttagtgaattcagatatgtacaacccttagagcagatcctgcctcataggaaatgctcaacaaatataacttgttgtttttgttattgttatcaccgttctcatctggctctatatttttcttgcagttggttccctggctgctttttacacttatcatctacctcctagcctttgagctaaattcggggcagaaaattcagatggctcagctttcaaactttgtctaataatactccttagaggctgaatttgggggaaaatgtaatctattggctgaaatcagttagttgggttatctgtggttttcaagaataatggtgaactcacatatactgaagcgatccatttaatagtgtcagtgaaataatctatcttaaatattttttagagaatagatagcaacttgcctgaaagttatatattaagaataccttcctcatcacatcaatatatactgtccttttggaaacagactttcctgcaagtcagaatcttaaacagtttggaagagagttttagaaatgtgcaaatgaacttgaaacccacatttgtatagcttgttttatttcagtgcttgagtagtcttttcggtggtctttatcttttattatcccctttcttctttatcaagtaagaaaagggtaggtcattcaaccatgcagaacatatagctgataggaaaacatattcagtttcatattttaaataggtaaatattatgtcaacctctgattgagctaatctaagcaagaaaaataattcagaatcaaacacataatatacagttatagcttactctgcaatgtggatttaaacctacaaagtaacttttagcttacctccattcaagttttagtggccccagactcatataagtatgaatatttatgctaacctagtaatgccatttgaaggagccaccttgtaggatttgcttccacatgtatactcagattctttctgaaatgttgaaataagttgtatatgtgaaatgcaaatcacttaagtgtttgtcagtgagactatacatttattgtacagaaacagtaactctcatcccaccgaaatggtagagaaagatgccttatttagatgttagtcttgggaaattcataatcatctctcatcagttaaatatactgggattattaaaatatttaaaatatttcttaccatgtccttgaatgttgtggagcagaagtttaatttgtatctataccaaaaaaaaatgtattgctaagatttggctgaaaaacactaacattctgccttaaaagtatgttctgttttctttcaattaataaatattttgagcacctacttttagctcacaaatagagattaatataacaatgttgacgatgatagtatcataaaaggggaaataaaaattgttactaaaatgaatatatattcaaccttgccgataagaaaaagaaagaaatattggttccattttcccttacttaaccaagttgccaaaactttaaacagtccattgctgggcattctcactcactgctaatgggaaagtaaattactgtggcttttctggaaggttgtctggtaatgtaaatcaagaatttgaaagtactcaaaacatttgacccaagaaatctacttctaagattttgcattaagaaaatacctaatgttgcaaacagaactttatatgtaaggatctttgtcataatttatttaatggaaagaaatggaaacaacctaatatcccaagataggggattggttaataaattatggttcagctgtgtattggtgtagaactatgtaattagtcatgaggtatgggtaaactatttaatggcacaggaatgttctgatatgttaatttataatgtagtttataaaatgtatataatatatgctgttaattttgtaataaaaccttaatacacataacccatggaaaaaaaagatcagaaagagcttccagtttccagtctgataaatagtgatcttggaggttgtcattcctgttgtcaaaagaaaaaaaactgaatgaactgaaaatcaacaatagatgcagtaagatgggaaatggaaataaaaggtatacatattgggaaggaaaaaacagtattacctttgttcatagatgacatgtttttctgcatagaaaatcccaagggatcaacaacaatgacaaacacactcctgttactaataagtgattattgcaaggttgaagtatacaaagttaatataaaagtcaattgcttttctgtctaccagcaattaacaagtggaatttgaaataaaaaatacaatattatttatataagcagtcattaaaatgaaacaggtgtaaattcaacaaaatatgtacagtatctatatgatgaaagctataaaattctgatgaaagaaataaaaaactaagtagaatggagagatactccatgtttgtgtttaggaaaactcgatattgtcaagatatcagtttttcccaacttgatgaatagatgcaatacaatatcagtaaaatcccagcaagttattttgtggatgtcaacaaactgactctaaagtgtatatggtaaggcaaaacccagaacagccaacacaatattaaaggagaacaaactcactacccaacttcaagacttactattaagctatggtaatcaaagttatgagatattggcaaagtaatagaaaaatagatcaagggaatgtaatagagagcccagaaatagacccaaataaacatcatcaactgatctttaacaaagtaattcaatggagaaaaaatagtcttttgaataaatgggtgctggaacaactgggcatccatatccaaaatgtaaataaatctagacatagatttcacacccttcaccaacatttactcaaaatggaacacagacatgagtgtcaaatgcaaagctaaagaacccttagaggataatataagagaaaaatttaggtaaccttggatttggcaatgacttgcttttttaacttttagtttaggttcagggatacatgtgcaggtttgttaatacaggcaaatgtgtgtcacggggggttggtgtacagataattttgtccccaaatactaagcatagtactcaataggtattttatctgatcctctctctcctcccaccttcatgcctcgagtaggccctagtgtctgttgttatcctctttttgcccattggttctcattatttagctctcacttataagtcagaacatgcagtatttggttttgtgttcctgcattagtttgctaaggataatggccttcagctccatccatgttcttgcaaaggacatgacctcattcttttttatagccgcatagtattccatggtgtatatgtgcacattttatttatccagtctactgttgatggacatttagattgattctgtcttttgtattgtgaatagtgctgcagtgaacatatgcacacatgtgtctttatggtagagtgatttatattcctttgggtgtatacccaataatgggattgtttggtcaaatggaagttctgtttttaggtctttgaggaatcaccacactgctttccacaatggttgaactattttacatcctctccagcagtgtataaccttcccttttctccataacttgccagcatctgttattttttgactttttagtaatagccattctgatgggtgtgagatgatatctaatggtgagtttgatttgcatttctctaatgatcagtgatactgagcacattttcatgtgcttgttgactacatgcgtgtcttttgaaaagtgtctattcatgtcctttatctgctttttaatgaggttatttgttttttgcttataagtttgtttaagttccttacagattcttgatattagaccttcgtcagatgcatagtttgcaaatattttctcccattctgtaggctatctgtttactctgtggatgctttcttttgctgtgcagaagctctttagtttgattagattccacttgctaatttttatttttgttgcagttgcttctggcatctttgtaatgaaatctttgccagttcctttttctagaatggcatttcctaggttatcttccagggtttttatagttttaggttttacatttaagtctttaacccatcttgagttgactttttgtacatggtttaaggaaggggtctagtttcagtcttctgcatatggcgagccagttatcctaacactacgtattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctctttgatactataatagtggatacatgtcattatatatttgtccaaacccacagaatgtgcaataccaagagtgaaccttaatgtgaattttggactttgagtgataatgatgtgtcagtgtagattcatcagtggaaacaattgtacctctctggcaggggatattgataactggggacactatgcatgtgtggcagtggtaacagggggtatatgggaaatctctgtaccttcctcccaattttactgtaaacataagactgctctaaaaaattaagtattaatttaacatataaaaatacataaatactttaaagtatttatataatactttccctccccccacagtttatgggtacatcaaatttctcttcagcaactgcaagcaaagaaagaaaggagtgaaatatttaagttgttgaaagaaaaaggctaccaatctggaattctgtatttagagaatttatttttcaaaaataaatgataagtaaagactttctcagacaaaaagtgagagaatttgtcaccagtagaccttccttgcaggaacttttaacaaaaattcttcataaaaagggctaccaatctggaattctgtattcagagaatttatctttcaaaaataaatgataaataaagactttctcagacaaaaattgagggaatttgtcaccagtagaccttccttgcaggaactattaacaaaaattcttcataaagaagaaaaatgacataggtcagaaacttggatctacataaagaaaggaagaacattagcaaaataataagtgaagtaaaatatttttctttttcttaattgacataataaaggacagtttgttcaaaataaaaatagcagtgatatcttacatgtctgtagcttatgggaaagtggaatgagtaacaggtgtaataaggaatggaagggagggattgggaaaattctgttagaacatatctgttctacacatgcagtggtatagtgttatctaaaagtaaaagtggacttggattaatgtaaatgtatattgtaaactctagggcagccactaaaaactttcttaaacgaagtataattgatatgctcagagaagagagaaaatggaataatataaaatgttcagttaaaaccagagaagacagaaaaagaaaggaagacaaaaaaaaaagtaacaaaaaaactagggcaatgaatagaaagtcattgcaaatacggtcaatattaaactagcaaatcaatagtcactttaaatgtgaatggtctatataaaccaattaaaagacagagactgtcaggggattaaaaatccccaaaatccaactatgtgttatctataagaaaccactttattttaaaaaatatttctaataagttctattgtgtacatttaaggtatacaacatgatgttatgagatacatataaaaattgtaactgtactgaaacaaattagtatatttattcatcttacatggttatccattttcccccacaagagcagttataatcatattaattgaacaatttgtcccttcaagtcaaattcctcagttgtgatgggtcagattcctcaattgtgaccaaccattgcaggtgaaattcaaattttatttttttagtggttttatttttgagaaaaattttatttcacctctcccaatggatagacatttatttcaagatacactgcatcctcttattgtcaacacttcaaacctaccagctactgacatcttgaaacagcataatttgttatccatgactcctgaaagttcctcatgtcaccaacccttatatgatacaaatgtaaagatggctattcgtggaaatgtgttcaccacattgccaagtgtcttgggtctccttttgaaaagaatgttttttcacaaaagtcaacatttccctgaaaatgcagctccatcttctattggtatggtctgtggaagtcacagagactgaaatttcggtccatattatggttgataactacaatttctgttgcaaagtatgcaagcattactttgaactgcatctgatgcaacttggtggtctaggccattacttgcaaattgccaaggcctattttgggaacaatgctttcaattcccttttattgcatgtatcagaacaatatcctgttaactaatatgatggttcattttactgcatatatgagaagaatgtcctgttaaccaatatattttgacttttggttttagtatgttttagtacaaatatccagggacaaattcttcagttgaatacatccaagagacaatttgttcaattgatctgctataatctaatcatttagcaaaaattctgactacaatacactatcattagctatggttctcatgctgcatattagatctttagacttgttcatcctatatatctgctgcattgtattttttgacctgtatctcccatttccacacccctacaccaatcatagtcaccactgttttattctgtatctctgtgaagttgacctttaaaaaaaaaaagataccacatataagtgggatcatgtgatatttttctttgtgtgtgtggcttatttcacttattgtaatgcataccaaagaatattttcagctatacaaaaggaagagatcctgtcattgccataagatggattgacttggaggacattatgctaaatgaaagaaacctagtttaaatataaagacacagatgggttaaaagtaaaggaatggaacaatatatactgtgctagctctaatcaagagaaagctggagttgttatattaatttcagacaaagaagactttaggacaaggaaaattatccgggaaaaatggggggcattacatattaataaaggggtatattctccaagaaaacataacagtccttaatgtgtttgcacttaacaaagcatcaaaatatgtgaggcaaaaactgatagaaatgcaaggagaaatacaaactattagagctggaggcttctatacccctttattagtaatttatagatccatcaggcagaaaatcagtaaggacatagttcaatttaatcatcagtcaactggatttaactgatgtctgtagaatactccatccaacaacatgagaatatacattcttctcaagatcacatggaacattcgccaaaatagaccatattctgggtcataaaacataccttaggaaacacaaaataatagaaatcatactatacttttttttttttttttttttttgaggcagtctcactgtcgcccagggtggagtgcagtggcgcgatctcggctcactgcaagctccacctcctgggttcacaccattctcctgcctcagcctccctagtagctgggactacaggcgcctgccaccacgcccagctaattttttgtgtttttagtagagacgggatttcaccgtgttagccaggatggtctagatctccttaactcgtgattcgcccgcctcggcctcccaaagtgctgggattacaggcgtgagccaccgtgcccggccctacaatatatacttctacaccatactggaattaaactagaaatcagtaacagaaagctgtacaattccaaactatttagagattaaaaaccacacttctaaatcgcacatgggtcaaagaagaagtctcaagagaaattttaaaatattttgagctaaaagaaaatggaaataccacttatcaaaatttgcaggctgcagcaaatgcagtgcttagaaggaaatatatagcaaggaattaatatattaaaagtggaaagatttaaactgaataatacagactaccaccctgggaagctagaaaaagaagagtaaatcaaatccaaactaatcaatagaaaataaattttaatggctacaaaaatacagttagatagaatgaataagatgtagtatttggtagcaaaatagagtgcttttatggattgtgacattggtcatttctaaactttttgcctaaaccagaatcacaaagatattctcctgtttgttcttttagaagttttaaaaaattaggttttaaagtctataacccatcttgagtttatttttatatatagtatgtgatatggattaaggttcattttagtttatgttttgtatattactatccaaatatttaggcagcatttgttgaaagtactatcccttttccattgaattccctttgcacctttgttgaaaatcaattgaccacatatgtgggtagattttgaatctattttattctgttgatctatttgtctaacatttcgccaacaccacattgtcttgaaaacgtcagtctgttgttgttctttttgcttttgagacagagtcttgctctatcgctcaggctggagtgcagtggcacaatcttggctcactgcaacctccgcctctcaggttcaaacgattctcgtgcctcagcctcctgagtagctatgattacaggcgtgtgccgccatgcctggctaatttttgtatttttagtagaaacagggtttcaccaggttggccaggctagtctcgaactccttgcctcaagcgatttgcctgcctcagcctcccaacgtgctgggattacaggcatgagccaccacacccggccaaaaagtgtaattttatattaagtctctgacatgtttcttttgcaaaattgttttggctattctactttctttgcctttccatataaatttttcattagattaccaatttttataaaagatcatgctggtaattcgatttagattgtatggaatctataaatcatattggagagaactgatatcttaacaattttgtatctttcaatccataaataaagtgtatctctccattttttaggccttcattgattttttcatcagcgttttttagctttctaagcgaagatcttacacatattttgttagatttatacttcagtattttcaagttttgggagagctattgaaaatagtacactttcaatattcaatttctaattgttcattataaaatatataaatatgatttataaattctctatagtaactttttaatatattcttatagattttctatgtagaaaattatgtctatttgtgaatagaaagttttatttttttactttccagcatataggccttttatttgttcttcttacccaatttcactgactaatatctccaggagtagtgaagcagacatccttgtataattcctgatcttaggggtaaagcagtctcttgccattaagtgtaatattagctataggttttttgtagatgccctttatcaggttgaggaagtactcattctagtttgcagagactgtctgtcatgaatggatgtagaattttgtcaaatgatttttctgcatctgtggcaatgattacatgattttccttctttggtttgttgatatggtgaattacattgattggattttgaatgttgaactagccttgaatttccaggataagccccacttgctcataaaagtattatctttctacatattgttagatttagtttgttaaaattttgttgagaatttttgcatctatgttcttaagggatatttgtctgtagtttctgttcttgtaatatctttatctggttttggtatcagtgtaaagcttgcattaaatattcagttgggaagtattccctcctcttcagttttctggaagggtttggtagaatgtttgatagaattcaccggtggagccatctgattctggaattttctttgtaagaaagttttcaactacaatttaaattcctttaaaatatataggactattcaggttagatatcttttttttttttttttgagacagagtcttgctctgttacccaggctggagtgcaatggtgccatctcagctcactgcaacctctacctcccatgttcaagtgattctcctgcctcagcctcccgagtatgggattataggcactcaccaccatgcctggctaatttttgtatttttaatagagacagggttttaccatgtaggccaggctggtcttgaactcctgacctcaggtgatccacccacttcggcctcccaaagtgctgggagtacaggtgtgagccaccacgcccagtctcaggttaattatctctttttgattgagctttggtaatgtgtgtctttcaaagaattaatccattttatgttgtttcaagaattaatcattctatgttgttaaactaactggcatacagttattcacattgttccctttttacccttacccttttaatgtctgtagtcaatgcaatgaaaccctcttttttgtctctagtcttagtagtttttgtcttctctctttttatctataggggtttatcaattttattgatcttcctaaagatccagttttgatctcattggtttttccttattgactttctgtcttcaatttcattgatttctgctctttattattctattttttttcttattttgtcctactttttctagtttaagatattgatttgagacttttctccttttccaatatagatatttagtgatacgaatttccttctaagtgcttttttagctgaatccctaaatgatgtgctgtgttttcatttagtacaaaatactttctaatttcctattgatttcttcttcaacccacagactatttatatgctaccagcttcttaaaagtggttatcttcctgtactgggattatgtataatgtttataaaataacactctatattttatagcactttataatttacaaagtgcttcatttaatcctctaacatccacttgagaaacataatatttcacagatgttgaaaaggttatcagggtttgagtgacttactcaatgtcacacagagtaggttaggactcaaacctagattttctgtctcccagtttattattctgaagaaattgtaaagaaaggtttgaaaaataaattggaattcaccttgtgggtatttggaaagattcatagaggttctttgaagcaatcattgatatgaggcatctctctcagtttagttttaatttagatttctgattactagtgaggttgaacatcttttaatatttattctctggtatcgtttggctatgtctccacccaaatccatcttgaattgtaactcccacaattaccacatgtcgtgggagaaacccggcgggaggtcagttatgggggcgggtctttcttgctctgttctaatgatagtgaatgagtcttacaagatctgatggttttaaaaaagggagtttccctgcacaagctctcttctcttgaatgctgccatgtgagatgtgcctttcaccttccaccatgattgtgagacctccccagccacatagaactataagtccaataaacctctttcttttgtaaattgcccagttgcaggtatgactttatcagcagcatgaaaatggactaatacgttgtctgttccaatttcttcttttctgacttgcctatttctgtacttagattgtttttctattggattggttggtcctaattgatttgcatgattaaaatattccaatactaatattttgtttactatttgttcacaatatcttctcttagcttcatgcttatctgtctttattacttcaattttgatcgtcaggaaaatctgcactggactgaagaaaatttgtgtgtttattataagaggagtattgctttattttgagctagtatgatgaaaagtgggagatagaagaggatgggattagaagataaaccacttgatttggaaattcaatttaccaatcatttgtcagttgcttatgcttgcatattgcctataattgcttattgcccacagtgtactaggccatgtgatgaatagagagtaaagaataaatgttacctactttcagggactctgatggagaaatatatcatgtacaataaggcagttaacatggtatgtgctcaagtgaactgtggtataagataagctgtggctaccaaaatttctgttccagcaaaggagagtgagtggtttgagttagttgggagttgtattagtcagggttctctagagggacagaactaataggatatatgtatacatgaaagggagtttattaaggagaactgactcacacgatcacaaggtgaagtcctgtaataggccgtttgcaagttgaggagcaaagaagccattagtggctcagtctgagccccaaaacctcaaaagtagggaagccaacagtgcagccttcagtatgtgactgaaggcccgagagcccctggcaaaccactggtataagtccaagtgtccaaaagccaaagaacttggagtctgatgttcgagggcaggaagcatccagcatggaagaaatatgaaggccagaagactcagcaagtcagcttcttccaccttcttctacctgctttttctggccttgctggcagcaaattggatggtgcccatccaaattgtgggtaggtcttcctctcccagtctactgactcaaatgttaatctcctctggccacatccaaaaacacccagagacacccagatacacccagataggatacacccagaaggatgctttgcatccttcaatccaatcaagttgacacttaatattaaccatcacaggagttgtttaagcaagaattctgtaagttgaatgggagcagggactttgtataaaaattttagttcttttcgtctgcaacacttagcatattgcctgacagtgctcaaatatttgttaaatgattgagtgatgttaacatgtgtaggcaaagccaatcatagagacctaacacaatgcatcatctatcattcctataccaccaacagctctgagaatgttctgatacatccacatttcagacattagcttgcatttccaaagaaagggaacacaaccttttcaagaaaaagaacacatgatatgctccctttatcattgtaacggagtagtagttaaaattttgtattgctgactatggccttatagtatagtttgaaatcaggtagcgtgatgcttccagatttgttctttttgcttagtcctgctttggctatgcaggctcttttttggttccatatgaattttagaattgttttttctaactctgtgaagaatgactgtggtattttgatggggattgtattgaatttgctgattgcttttgtcagtatggtcattttcacaatattaattctacctgtctatgaacatggggtgtgtttccatgtgtttgtgtcatctatgatgtctctcagcagtgtttttagttttccttgtaaaggtctttctactcctttgttagatgtattcctaagtattttattttattttattttattttattttattttattttattttattttattgcatcctttgtaaaaggggttgagttcttgatttgattctccacttgattgcttttggtgtatagaagagctactgatttgtgtacattaatcttgtatccagaaactttgctgaattcttttatcagttttaggagctttctggaagactccttatggttttcaaggtaaacgatcatattgtcagcaaactgggacagtttgacttcctctttactgatctggatggcctttatttctttctcttgtctgattgctctggctaggacttccattactttgttgaagaggagtggtgagagtgggcatccttgtcttgctccagttctcagagggaatgctttcaacttttccccattcagtattatgttagctgtgagtttgtcatagatggcttttattacattaaggtatgtcctttgtatgccgattttgctgagggttttaatcataaagggatactggattttatcgagtgctttttctgcatctattgagatgatcatgtgatttttgtttttaattctgtttatgtggtgtaccacatttattgacttacatatgttaaaccatccttgcatccctggtatgaaacctacttgatcgtggtggattgtctttttgataggttgttggattcagttagatagtattttgttaatgattttagcatctatgttcatcaaagatattggtctgtagtttccttttttggttgtggcctttcctggttttggtgttagggtgatgctggcttcatagaatgaattaaggagggttccttcttgctctgtcttatggagtagtgtcaaaaggattggtaccaattcttctttgaatgtctggcagaattctgctgtgaatccacctggtcctggacttttttttgttggtaatttttaaattaccatttcaatctctctgcttgttattggtttgttcagggtatctaattcttcttgatttaagctaggagggttgtatttttccaggaatttatccatctcttctaggtttcctagtttatgtgtgtaaaggtgttcatagtagtcttgaatgatctttcgtatttcagtatttgaagatactcctgttttgtttctcagtgaggttatttgaattttctctcttttcttggttaatcttgctaatggtctatcgattttatttatcttttcaaagaaccagctttttgtttcacttatcttttgtgtcttttttttgtttcaatttcatttagttctactctgatcttggttatttcctttcttctgctgggtttgggtttggtttgttcttgtttctctagttccttgaggtgtgaccttagattgtctatttgtgctctttcagacttttcgatgtaggtgtttagggttatgcactttcctcttagcactgccttagccttatcccagagattttgataaggttctgtcattattatcattcagtttgaagaatttttaaatttctatcttgattttgtttttcacccaatgctcattcgggagcaggttatttaatttccatttatttgtgtggttttgaaggttccttttggagttgatttccagttttattccactgtggtctgagagagtgcttgatacaatttcgattttcttaaatttattgaggcttgttttatgacctatcatatggtctattttgcagaaagttccatgctctgttgaatagaatgtgtattctgtggttgttggatgaaatattctatatatatcttgtaagtccatttgttccaaggtatagtttaaatccattgtttctttgttgactttgtgtcttgatgatctgtctagtgctgtcagtggaatattgaagtcccctactattactgtgttgctgtctatttcatttcttaggtctgttagtaattgttttataaatttgggatcatggtactggtataaaaataggcatatagaccaatggaacagaatagagaacccagaaataaacccaaatacttacagccaactgatcttcagcaaagcaaacaaaaacataaatgtgggggtccttttcaacaaatagtgctgggataactggcaagccacatgtaagagaatgaaactggatcctcgtctctcaccttatacaaaaatcaactcaagatggattaaggacttaaacctaagacctgaaactataaaaactctagaagataacattggaaaaacccttctagacatttactggggaaacatgccaccaatatttcaacgtaggttctttctattttccataaatgtcaaccggctaagaaataaagagaaagagtacaaagagaggaattttacagctgggccgctgggggtgaaatcacatatcggtaggatggtgatgcccacctgagccacaaaaccagcaagttttattaaggatttcaaaaggggagggggtgcaagaacagggagtaggtcacaagatcacatgcttcaaaggacaaaaaagagaacaaagatcacatgcttctgaggaaacaggacaagggcaaaatcagaaactcctgataagggtccaacaaagatcacaactcaaagggcaaaagcagaattactgataagggtctatgttcagcggtgcacttattgtcttgataaacatcttaaacaacagaaaacagggttcgagagcagagaaccagtgtgacctcaaatttcccagagcggggtttttccccaccctagtaagcctgagggtactgcaggagaccagggtgcatttcagtccttatctcaaccacataagacagacactcccagagcagccatttatagacctccccccaggaatgcattcctttcccagagtaatccttgctaggaaaataatttagagatatcttccctacttgcatgtccatttataggctctctgcaagaagaaaaatatggctctttttgcctgaccctacaggcagtcagacattatggtcgtcttcccttgttccctaaaattgctgttattctgttctttttcaagatgcactgatttcatattgttcaaacccacatgttttacagtcaatttgtacagttaacacaattatcatagtggcactgaggtgatgtacatccttagcttacgaagataacaggattaagagatcaaagtaagacaagtgtaagaaattatgaaagtattgtttgggaactggttaatgtccatgaaatcttcacaatttatgttcctctgccacggctccagccagtccctctgttcggggtccctgacttcccgcaacagacattggcttagacaaggatttcatgaccaaaaacccaaaagcaaatgcaataaaaacaaagataaatagctgtgacctaattaaactaaagagcttttgcatggcaaaaggaacagtcaacagagtaaacaaacaacccacagagtgggagaaaatcttcacaatctatacatctgacaaaggactaatatccagaatttacaatgaacaaatcagtaagaaaaaaaaatcctatcaaaaagtgggccaaggacatgaatagacaattctcaaaagaagatatacaaatgcccaacaaacatatgaaaaaatgatcaacatcactaaagatcagggaaatgcaaatcaaaaccagaatgcaataccaccttactccttcaagaatgaccataatcaaatgcaataccaccatactccttcaagaatgaccataatcaaaaaacgaaaaaacagtagatgttggtgtggatgcagggaatgtaaactagtacatccgctatggaaaacagtgtggagattccttaaataattaaaagtagaactaccatttgatccagaaatcccagtgttgggtatctatgcagaggaaaagaagtcattattcgaaaaagatacttgcacacgcatgtttatagcagcacaatgcacaattgcataattgtagaaccaacccaaatgcccatcaatcaatgagtggataaagaaacatatagataaatagatagatagatagagagacagagacagagagtcagtatgtgtgtgtatatatatatatatatatatgtttctattgattatatatatgtgtgtatatatatatgtgtgtgtgtatatatatgaatactactcagccacaaaaaggaatgaattaacagcatttgcaatgacctagatgagattggagactattattctaagtgaagtaactcagaaatggaaaccgaacatcgtatgatctcactgatatgtgggagctaagctatgaggatgtaaaggcataagaatgatacagtggactttgggcacttggggggaagagtgggagggggacaagagataaaagacaacaaatatggtgcagtgtatactgctagggtgatggatgcaccagggtctcacaaatcaccactaaagaacttactcatgtaaccaaataccacctgtaccccaataacttatggaaaaataaaattaaatttaaaaagattttgtacatcattgtcagacaaacctgggtttgagttccatctcagcttcttactggttatatgactcttgattttccttatctataaaatgagactaataataatatctaccttatgggtcattgtggtgaggatccagtgagcaaagtatgtataacactaatcccctaataggaattctataaatacttgctatgccacttctcttgatgtataataaaatggatggaacttgtgattgcttttgaattttgtgacttggttgatgtttcctaacaggcatattctccatctccttcttcacagattcagagacatattgcatgtttcaagacaagaagtacagagtgggtgagagatggcatccttacctggaaccttatgggttggtttactgcgtgaactgcatctgctcagaggtacaatctctcatgacatgtgatttcccagtttgctcctcagcatgccgagaggctttcagtgcccaaatggccagggaccatggatgataaaatccttaaagaaagtaaagaagcagaccgatcgcactgtctcacgcctataatcccagcactttgtgaggctgaggcatgtggatcacttcagcccgggagttctagaccagcatgggtaacatggcaaaaccccatctctacaaaaagtacaaaaattagctgggcatggtggcacatgcctgttgtctcagctagttgggaggctgaggtgggaggatcacttgagctggggacttctaggctgaagtgaaccgagattataccactgcactccagcatggttgacagaacaagaccctatctcataaaataaaagaagaaagtaagaagacgattgcaagaaaaataaacattttctgtcttctgtcctctcttgctttttggcttgattttcatgggttctctgaatatttactatggacagatatttatgatctcttagcctaatgatatagggcatggttagagaaggcagaagagcctgatagtgggagtggaggcaaaagctcaatagaatgtttagattgtaagacaaagtagtttttgaaaattattttaaggctgacctttagggagaatattaggacaaattataaactggttcattgggagagtggattctatgttgtctcagccaataactgtaattaagactgagtttgtgaaacgttggcctgtacctcttaaggattagagctcccttggcttagccttggctcttgtccagtcatttagaaaggattttggttggcataaatgccatctttgcaatagataaagcaggttgttccatcttcttcccatggtcttgacccaggagcacagctgtggtccatctttctcaacaaacctctgccattatatgttaggctagagtttcttgtttgcactatagatatttgtttgggggctgtcctgcgcattgtgggatgttaagcagtatccctggcctctacccattagacaacaagagcaccaaccccaatcctaataaccaaaaatgtctccagacatggccaagttgcctggggagcaaaaatcacccctggtagagaagtggtgcactaggctaattggaaagggaggccttgtactaggcattgagaattctgaacttacacaaagaattttcaagaccagcttcttacctgagaccttttgtaaggactgcacctcttccctcatgcccagctagagcaggaacaatcacttgcaagcctgatccatttaccatttgaacataattttgggctgtcagaattttgagcatgtggaaacataattatcaggtaacatcaggcagtattaagaggctatgaggttctagaataaagacagaccaagtttccagccctgcctctgccacttatgagccactggacaagttacctgacctctgtgatattcattcatcttcctctttttataaatgggataatgatattaccatttcatatggttctgataaggattaaatttacaaatccatttaaatcatttaaaacaatacttagtcttggtaaacattcaagaaatgttaacagctgttattgtcatcattgttgtccttatcattgtggttatcatcatcatcgttattattattaatctattagctctagaacagaattcagtatatagcattaatgaggattcactttagacctcagctgggaggtgtggtttctgatgtgcttcagtgatctcaattcaagattataccacctgcctctgaggagtgtgatacctgaggagcttctgtggtgttgccaaatgcaacactccaaaaaaaattattctagaaagtacacaagaaaaggaaaaggttgggataaggcaattccaatttggataaaagaagcccgcctctttaaatggttagggcatgtattaaatagatcatttggggattgattaactgcctgggatggcctgattttgtcggattcttgacgcgacacatttcgacacgttggagatggacagctaaccattgggagctgaggctttgatgtctgcaacgcagtcaaaatgttaaaatgatcccaatgccaacagctcaagcacaaggcattttctatttctatatcctcttcactactttcttcccccacaacagcctgacaaatacaagtagcccttgctgcaaatgatttatggatggaaaatgtaaatgaaaaatttatttccagactatgtctttgttctagaaatggttgtgagctgtcagagcgaggggtcttgtaattgtaaatcaggcagggacccagtcgccccacccaggcatactacctaatcagctaaattccaaactctagctcgtcctcagaagaattttggctaaaaaggaaatgagaagaatcacttggcccactgggccaaggcagatttatatggaatccaggatccacctgctagggatgcctccttgcccagggctgggtagcagctcaggggacccattgctcattgtgtctttcatgttattggacaggtgattatgaaatcagagtaggttcttggaaaagacatgcagctagagctggggaatggtagaaatgccatggagccaggccagaagaagcctcccacaattaatgggaagctttgaaaattggaggagtggtgatctcagccttagaaaaatatgccaataaactatcaaccaacccagcagaggtgctggtgatgagaaaaggaaagaaaatgttgaatgcattcagcttcttgggaatgcattattcactgcctgggtgagtccctgcatgactgtttcccaaactggcttgatcccagcgacctttgaaagacatttattttttctcattgccttctctttttcagaatgggaatgtgctttgcagccgagtcagatgtccaaatgttcattgcctttctcctgtgcatattcctcatctgtgctgccctcgctgcccaggtaaagcaatttgtctctttctttcctagctgtggttctccatttccctcttcacccaactcaactcatctccataattccccagaagggaaacttccagacagataacaataggaacctttaggcagtccaaactggcctctaaatactttttatagcccaaatggggtacattctaggctctaataagttattgggtacccagtaacagatttttattgggcttttaatcatttgaaggtgggtgtcaatcggagatggaaattgtggcccagagattttctgctataagcagcctcttcctgccatgggcagcaggcaccaggagagttgcagcatggcggcatgtgtcttatacaattagtgctggaattgcatccgagcatagcttctaaattatgagggggccattcataaatcaaaggagctgacccagtgaggtttatgacagtataaagctgcctgcctgctgaatagtcacctcctccagactgcagttattatgtacacattgttaagtgtaattctaaggggcagccaggcagagaatttttcacacaactgttaggacatctactttcacgatttgcagctacggtatttgtctgaggcaggggctccctcaatgacactttgttcatgtctgactggggcccgattcccaccccaaaagcgtgtggagtgattcagagaatgcctgtgggcccagtggcaatcctagaaaaagctacttgacactcttgggctttgtgaagtagaagccttatcatcctgtaagttgattccatttccctttagggtagaaattcttgaactagggttcctggatgggcttttgagggtcagagaaccctttaaaattgcttgcagtttttggtgtaactatgtatatttgtaaattcctttagagaacatccgcagctttattgtcagtcccaaaggggtgtacaggaagaaccactaccccagctaaggtatagacggtgctttttaagtggtgaggaacttccagaacttataagagagaaaccaaatgtatccaggcaaaaatgttaggaataaggctgggaatggggttcaatgaaaacccagtcaactgaaatgttccaagagtggagaatttttttttaatggagaagaaacacccaaactctttttgtcactacctttataaaatatattttcctgcatcagtaaatacaccctaatgaacacaggtgattcatttccagatggcagaatatcatgccatatcacaggtttttaaattctgagtgttggtgctgatagtatatgctttgagatgtcagagattgacttggcatatgaccaacctaaaagttgttgggttttttttggaataagtccctaagccaggcttactgtttctgtatgtgtttatttgcttcttcttcctaaactggattgcaagaatgtggtatgggtgggggtgggggcgctctggtaaatgggaacaatgtttctgataaagttgccactctggagagcttctttgttttttttttttttgtttttttgttttttgttttttgtttttgttttttggttaacctgccaggtagcctgtcagacagccttataaaagctttttattcctcagaagtctccaaaagtggtctaatgtcataggaacttatctaaacttctgtgtaaagattgttcttccctgggaagaaggttgaggcatgacccagacccagagcatggggcaaaacaacatagaatagaatatggctgcacctaccccagctgcctaacaggaagcaagtattgagaaaaagggaaagtataagctagcagttattttgagagaaaaataaagtgttaaaagaactgagctcaaaaattccagaggtgaaagcgttgaaagaaataaacaccattatggttaagacttaaaaagctcattttatggtatggaggatagaaataaactattccttttcttttccttcttgctcttgcagctcacttctccatgagttcatttttcttcttgttaactataacctttaacagctctttctgtgggtagtagttctaaaattccttagtccttatatacaaaaaagtgtatttattttacaaccattcttgaatgataatttggctgggtatgaaattataggtgcatgttcatctcccctcagcactttgaagatattactaaatggtttgttggctttatgtttgtttatttgtttgtggttaagaattctgctatttgtagttcttttgcgggttcttcgttttttttttcttctagcttttaaaactttcttcttttcattgatgcacacaatgagatgtgtaagtttgattattctcttcagcctgctcagcacatgattttttcagccaaaggagtcaaatttctcttcaatttttagtcagttttttttttgaaaattatctcttcaccttcttattttttctcattctcaaaattgtctttggtgtatattattgcatctcatttaatttatcctttatgtctcctaatgtctcctttatttttccctcctgatattctccctaaaatgatatattacttcaactctgttctccaattcatgaattctttccatgcatactatttaggccatgtgttgggttttgtttgtttctttgtttattttcaataaccttgtttcccctcaggttttcaagttatttaaaaagacatctacatgatgctaatttataacctgttattgttttggggaatcttattctcttttttacttctttaaagtatttaaaagtttatttgaagtccatttcagattgttcaaatatctaaatatttttagatgtgaattgtcacctttgttgggtttcttgacagcttttcttagttctgaattttccttggttttctactttttctttcaaagctcattatccatgggtgttttgggtttgttttgtttgtttgtttttgtttttgttttttcttacatgagcccttctttgtgggatggttgttgcaggctttatagttcactttgctctaaaccaggtcatatattaatgactcggtttgggctgcctcatgcctgaatggtctatttctacctctgttttcttgtgcactactagtctctgataatgatcatggactgatctacaactgcctcatctacaactgcctaacttggacaatcagtgttttttagggaacactgagtggggagagctatgtcagcccctgtttacatgcgagtagtgtgaccctagtccccaacttcacatgggaagccacttgcaagctgtagtttctcctcagccatttggatccaaactatccatattcagtcccagctgctgatggaccatatggctttggctcccatttattgctgtactttccttctatattttattccacgaagagtttttttgtgtttctgaatataattttgcagttttcacgttttatttatttatttttctagttccacatttcatctctctttgttttgaaaataacagggagatttctcatgtgttctctttgccatattgaaccagaatgcaaccagctattctttctttctactgaagataaaacaagagtaaatagctttaaatcatagcagagaggagtggagcttgacaaaaggaagaactttgaacaccgtggctgttaaatcctagaataaatgactaaggataattttagtctctttacttaatatttctagaaataaaaaggtacccacccatctgagatagagttggcacagtcctgctttgagacagggcaatggatgtgatgactcctctgtgttccttccaccccagtgattattaggcatgaggaaactcatgccttcagggccacagaaatgtttggtcaaagaaaagggctctggttttccatcttaacccaatggaaggcactgtgatgaaaatgtcctcatttaagaagaaaatatttaaagccaagatgatgaataagctccgtataaaaagacgacaaataagcaaactgtataccccagatactggctttacatactgtcctatagcagtattgatttagagaagcttttgcctaggtggtaacagactcagtggaagtgtcctacctatcatgcttagagcttagtttccattgaaggagacagaggagccatctcatttcatttgtttatgtatttcccatggctcttgctttctaaactcgttacccctaaaatttccaaggagcccacctgtatttgaaattgtctcctacagctcctgctaaaccgtggaaatcagagtatgcaggcagctcttccagaaataccagagagaaatctatactgattcccacaaagagcaaataaattttttttcatcagcacttgtccaagtcttggcagaggtcaagtcttagtcacataccacagtgctctactgggcccaaagaggctacatggaggctggaacattcttaatggaaaagtcaagactgcataggactcatgaacgtcattaaattcatcctggtctctaagcaagactctgtggagtccctgataattaagagattttagtgatttgaaggaattaaattccctatcttctcttttgggggaatgaagtggtaatgctggaagggaaagtaaaacaacatgacttattttcataatatgtgtatgtatatatttcataatatatatattttattttatatatatgcacagagagagaattttatcacaaaaagaagaattttatagtgatcaggagtctaaatcatgatattatctaagagggctttttaaaatggtcattccactgagaatttgctattcagaattaataaatttgggttttcctggaggtattccagcattcctgggttattaaagagctcttataaaattgccaaaataactgatttgatctggttaacagagacctaatccacagtgtttccttttggctaggtgtgaaaaagtttggcactatgaatggttttaataggaatagtgacagtgtggtttgccaagagagacaccccagtcttagatattcaaggtaggttagggaaaagaccttaccagtgttgcactatagtatgtgttcccataaggagaatgtgggaagccctgtgtcatttctctttcaacaatagttgggttgtgagtgagctagcaaacacaggcatttctgccacaatacaatatgcacatatctgaaaatcctcacattctacaaaattgtacactgaaaaatcacagggcttaaggaaaaagtagcattagagaaaaccactcaaaacttaggcaactttgtaaccagaatattaacaaagcaactatactaatgaaatactaacacagtttaaaaaggcatcttacatttctaataaaatattacagtaaatatagacttctagacttcaccttttaaaatggtaacattagcttgaaggaacagtgtttaaggaaggattgaagctgctaagttatagagacaacagtaaattgcacaaagatcacggagaatcatgtaataagcacttacaagacagagcatgtggcccaactgaggcaagaggaagaatgtagggcaaatggcttcctgatttcagttgagttagtgtacttggcttttagctgctgtcacttggtagtgcaaaatattaatttgctgggtaatcatgtatgaactaatgcaatttctattttataccaacttcattcccttatttagcactcacatatgaaccacttgtgttacacaaatccacactatagcacagactgtgtaagatgaggtgggtacatggcatttgactgtagacaagtttagagtaagagttgaaaatcacttgtttactctgaatctgcttttttttgtctttaatcactgacctatctgcccttgtgttccccttttctcccatcccatgtatttatattaaaaaggagtctagagtctaggtctatgactatgtctgtctatatctgtgacttccacagttacagtaatcaagtagacaggccttttgtgtttcctccagtttttttctagggaaggttcaaaagagagatttatttatttattattgtggtaaaagatgcataacataaaatgtatcattttagtgtataattcagtggcattaagaacatttacaatattgtacaagtggtaagaacatttaccactaatctagtttctgaaatttttcaccaccccaaaaggaaacctattacacagtcactctccattccccttttcccctagcccctggtaaccatgaatctacttctctatggatttgcctattctggacatttcacataagtggaatcatacaatttgtggccttttgcatctagtttcattcacttagcatagtgttttcaaggttcacccatgttgtagcatgtatcagtatgacatttctttttagggctgaataatcttccattattatgcatagaccactttcgttatccattcatctgttggtagtcatttgggttgtttccaccttttggccattgtgaataacgctgctacggacatttatatacaagtttttgtgtggcatatgttttcaattattttgtatatacctaggagtggaaattctgggtcttatggtaattttatttttaatttattgaggaatctctcttaaattttaaggttgccccatcttcttttagttcatttctttgagtacctactgccagccatcctcatggttgctgctgatttgctgcttttgccaccatccatatctgatctccattgctctcttctctcttctattctcttctgaattctatattcgtttgtctcttggattttatcaaaacagatcaattcctttttaacagtaacagccaattagcatattgttttccctagtaaggtgactacaatagctgtagtgtgcaagatgatcaaccaggagccactcctttgcctgcaaaagattggtatatatattacacataataattacatatatatatatatgggtccagagttatccaaaagcctgaggattctgaaatgttggtgtctgaatagcagatattttgctttattattattattactattttaggttacagaggggctgccaaaggagatgttcacttttgatcactagaccctccatgtccatactgactgttctcttagacccctttaaccatcttccatgccttatttccactatttttctcatactgttggtccttggacacttgacacagtacaaggggttaaaaccttcttcaagaaagtagcatttgctgggtgcactggctcacgcctgtaatcccagcactttgggaggccgaggcaggcagatcacgaagtcaagagattgagaccatcctggtcaacatggtgaaactctgtctctatttaaaatacaaaaaaattagctgggtgtggtggtgcatgcctgtagtcccagctactcagaaggctgaggcaggaggatcgcttgaacccaggaggtggaggttgcagtgagacaagatcgtgcctacccttcccagcctctagtaaccactattctactttctgtttctatgagatcaacttttttagcttccacatatgagtgagaacacacggtgtttatcttactgttcctgacttattttgcttaacttagtattttcaagtctcattcatgttgctgtgaatgacaggatttctttattttttatggctgaataatactccattgtgtatatataccacattttctttatccattcttccgttgatggaaacttacgttgattccatatcttgctgttgtgtgtggtcctgcgataaacatagggatgtagctatccctttaatacactgatttccctttttttggatatatacccagtagtaggattgctggatcatatagtagttttatttgtagcttttttaagaagcctccatactgttttccatagtagctgtactgatttacattcccaccaacagcatatgagttcccttttctccacatcctcactagaatctattacattttgtctttttgaacataaccattctaactgggctgagatgatacctcattgtggctttgatttgtatttttctgatgattagtgatgttgagcatttttatatacttgttgtctatttatatgacagagccttgatacattagtacccattatgaatctaccagagaggtatatgggatgtaacattgtctaaatttattcagccataatacccattttttggaggcactttgcagaattagggttctttgttatgtgcttcaagaagtgttgtattttgccattcaatttctaggagcaatgtatgttatagcaataagctattggtatatacagtatcttagtttggagaagtttgttagggtagtaggcaattttagcacaagaccctaaactagtactactcaaattttaacatgcttaaggatcaccttgggagatttgataaaatgcagactcccagaccctacaccaaaaatcctgaatcatttaggctgcagtgggtgtcatgcatttcacacaagcatcccagttaattctgatgcagtcggattgaggactgcactacagtaatagggcccaggggagattttgagaaaggaggtcaagagaactgcccacagaaagccgttctgggtaagatcttgcagcagtgggatctccagagggctgtgggcaacatgacaacattgtttcgctgataatggagcacatagacactctggaaacacattttccttgtgtgacatttccccaggactaaccctgcagtaacatgtgcacaatgtgccatctggcctgcccctctgctttcccagagctcccacccaaaggctgcctcttctgccatcttccacattcagagtccttggctgtcatgtccagaaagcaagaccctccgtggggagcttccccctctaccccgcccattgttcatgacttgttgttggcgagaaatgaatggcatttctcggaattagcccaggaatttctgctgataaacaaatgaaactctcaaagggaaaagcaatcaacatagtttgaaataaaatcagtgttttcagcttagtctgtttttaacttagtttgaaataagagtcacatctagggtattttaaggaaaggattagcaaaatgtcctgtagtgggcttttcatctgagttgccagactgacccttgaaccagggcctgttttcttcttgagtaagcagaagaggcaattattaccttgatttcctgtgacctgtgattctgagacctgtccagccatcggatcagctttgcccaagcccacccccacttccctgccaagttgcctgacacctgaaattgtcattacagcttaatcttttaaatttaggccttgtcctgataaattcaccaatctttgaaggtagtaaattaactcttattaatcatttttactttcgtctgaacacaggatttagaaagcagattttgattgtagaaagaggagacaggtgttgcggggggaagatcccgaggccactaagctcagctgggcacctgaagagttacaaagggagaggggcctgttgaaggaagggcctaaggagtcaagctttacctaccccaaagtcctgcagaacaccagtagtatttaggataagttctttatttgtagcagaggacacagtggtttctagaatgagttgccagctctcaagtttttcactttagtgttgttaatttaaaaccaatatgttctcaaagtaaccagatatccttgctatctgttgcctagagccaaagagttttacttcagggttttggacttaaaatgactgtaacccaaaaggtttgccagattatttgcagccactaagataagcaattgtctttattagaatgatttttgtctgatttttgtgtttagaattttataccatcagctattccctaaaagtgattttaggaactggcagacttagggtgtcagttattgaaatctgttccaaaatccgcctcctcacaggactccatttttggccatcaaagtagtctattttataaatgtcttgatgtgttgtcttttgtctttgccacatatactctaagacacagagactgggaagtggttcagcaaatatatgtatggctacttacaaagtgttttctagagttatgctcccagaattggagataggctaagaaatatatgtactgtatctctcagtaaagggctaaatcaaagctgtctgcaggagggggaggaagagggctgcttggattttagtttaattgagaagacagagaaatacgtcaaacttgggagttgaggttattttttggaacatgaagataatgtaagtgtccccacaagctctttttcttttcttcaataaattcatcctgttttgatttcttcacattcacaagattgtgccctcagggatctaaggccaaatcagagtccacactcactatcataccttttatataatatattcttttattattttaatagagaaatggatattgagaaggagaggacaaggaaatgtggcatgctttcttccttgttttctttctttgtttcccttctttccttccctcattccttcctttttattttcattctcttttttgtttaatttgtgattattttcttgtgctaaaaatccataacataaaatttaccattttaaccatttttatgtgtacagttcagtaacattaagtgcattcacactgttgcacaaccatctccaccatccatctccagaacattttcatctccccaaactgaatctctatacccattaaacactaactcctcactttctacttcctgtctctatgaatttgactactctcagtacctcatatgaatggcattatgccgtatttatccttttgtgatgggctttttttgcttagcataatgtctttaaggttcatccaggatgtagtgtgtctctttttcaaatggggaagagagagaagaaatttgagaagaggctggtggtagaaatgaggaagtgaagtcaggagacaaccaaagagtcttagaggaatctagcaaatgttgcttttcagaacacattttttctggaagactccagagaccacactgtctttgaaaatgacaggcctgacaagcagtaactagtattactgcctgtgtgaaatgctaggttttgaaagacgtgttccttattaatgttccccagggaacttcagagagtgtcatctattaggagctgattactggcaagttttgtcatctgcttttggagaaatccataggaatagaacagtacccctgtttctctttatctggagaagtacttttccaaaagggcctcttctgcgattgctttctgagggaaattgtgtctggagccattcaacatagctttattagaaagattattaaaggattagagtatgaaacctatgaggtgatgttgaaggaaaactgtaattactgaaactggtgaaagaaagacaggggccttcaccaagtttcagaaacataaatgggtcttagaggaggctgatcagctttctccttccacttccaaagggggagaaagagtagaagtgagcttcagtataaaaaacttaggcacaaaaaagtagttccaggcatagataagggaagctgaagtcattttacagtcaatatattatattaatagctcaggctcaatgctgagtaaacacaagacacacataaatgcacaaacgcatacaatatgattccattaatatcaagttcaaaatagggaaaagtaaactatattgattatggatgtgcataaatgtgataaaactacaatggaaagtgaagaaatgattatcacaatagtcagcatggtggtgagttgacctccattggggggtggtgcttctggggtgttggcaatgcactctttcttgatccacgtggtagtcacatgggtgtttgctttgaaagcatcagtacaactctacatttatgttgtacgtatgtaagttatatttcccagtataatataaagtgggattacattttcatttgttcttgatggttctgattggaggcaaaagtaccagaagaccttgcaagattacaaccaagcataggattctgtatgtgcatatggcaatttgggggactgttatatttgtctacttgtttgcattgttttggtcttcttgatgtttggttttgtgtgtgtgtgtgtgtgtgtgtgtgttttgttttgatttttttttttttggtttttggtttttgggtctttttgtcacaaagaatagcagtaccaaaacctagagaaaggtgtgctccttgtcctctaagtgggctcttggaattagtaagtaggcatttgaggcattgatttctaagctgtagagtgcacagtgtattggcatctggatgaagccatctggctccaggattttatcactgaccagagggccagagggcatgtttggcttccaggaagtcaggctggtcaggaacccctttgggaaggaagaagggctttggacctgtggagtatgcctgccttccctcaaagtgaggttttattgtgttatcatggggggaggaaggcagggggggccaataaagagatggggcctcgctctgctgtccttccagttcactgtgggacattcacagagctgattaacctctttgtacctattttctcagcttgtaaaatgagatgataattcctgccttctcttaaagtttgcattgacagtgaacaagaaagttgatatgggaaattgctttgaaaagtataaggaggtatatataatcaaggcagtgatcagcaatgaaaagaaggtatttaaatcctgggtccccagatttcatctgggcatatctcaatatgggcaaagcctgaaaccatagcattttggtacgtgttcctctagatcccaatgatagcagcctcataaccaggcattgaccatgtgtctccagcctcagggaaaagatgaggggagtctaaaggaaacaagtgacaggtttaatgactgtcaggcaaaaggcattaaattaatggcatcacctctgccttgcctttctatttccttctgattagattttcagaggtgcctgtgtgagtatgccgcacaataatgctgatgttctcaaagctgagtgagctcttaacagaaacataaggtagtgctgagaatgcactcagagacaaggtaaaaatctctagactgccttgagaaattgaaggggatttttctgggggagggctagaactgatacctcctccctcctaaatcataaaaagagagagcaagattcaccattatgtgttgattaggctgccttactcctgtttggttcctaccttctgctaatccgtggtcttgctagaggctgtcatctggcgcctcttgcaggagcacagtgtgtccgtactgcagggggcctctcagaccactgggatcagggaaatgagccattgctgtagtgttacttccaaaccagggaggatcagcacacacacacaccctttctgcccccaccaacttctccagggctttagaaatgtctgggaactgttttgttcgtcacagtaatgggaggatgtcattggcatttagtgggcagcaacaagagatgcaaaatgttccacaataagtaggaacacaacgcatggaagaagtgtcccacacaaaattccagtggtggctctattgagaaatactggacagcagccttagtcagagaagcctagtgaagggcgtctcttcctaaccagaagttggtggtatgagtccacacattcattaattcactcactcactcatattaatttcacaaacatttacagagtataagctttgagacatagcccatgtatggtgctgaggtttcagagttcctgcctcgacgagttcacaatctagtggaggagacacgcataacaagattattaaaatgtaatgtgatgagtactctggtagaagtgtggacaagggctgtgcaggcagagaggggagaagataggcactctccaagagccaggaatcaggcacagtcccagaggggagtggacatttgagctgggttctgacagatgaatggcactttgccagatgtagaagagggaggtggggagggcacgtgcagaggcatgtgtgggatccgtgactgcagttgagtatggtctgtgtaggagggaggaggctggaaatgtcagattgatggaggcccagtctcaaaggaccttgtacatcctgtgggtagacattattttgcagagccagcccactgcaaaagtagggaggaggtgcagtttgtctttagtgttcttggatgtctttttgcatcccctttcctctcttgcagtccctcatatcctcatctctctcccagccacttacaaaggcagctgatgagactccttccagcagaaaggtcaatgcttagcttaactgtaagaattcactaaggatagatttctggatgtcaaagggagagtctttgggcagagaacctggaagaactgagcactatggagatagggcagaggagctttgttcagtttacacacacttgatgtaagtgtaagtgtatgtaagcgtgtgggtgagcatgtatgttggagtgggtgacattgtgtggtatgtatgtgtgtgtgtgtgtgtgtgtgtgtgtgtgtgtgaatgagagagagggagaaatgggacaatgatagttcctatctcaaaggactgttgtgaggattaactgaattaaggtatctaaaggagttagcatagtgccctgcccatagtataccctcaataaatgcaaggtattgttggtattattttagaatgcagggccagaattcagtctggagaagggggaacatgcttactaccaagatggagatgaagattttacactaaggcttagtggctacgtctggctagtttcaaatatgtgcctaggacacattctatcactgggataatataatttttcagcatgttggcttatcagaatgtacatgttcccaagtggagccatagcattacactgtatatatttgggtactttctccatctctactcatggaacacatggcaggtagaaagctgttgttttacaaatgacgtggacctgtcttgaggcccagatcagctgatctgtcctcatgtatagcaacataaaatagaagaaccacagcactagggccagagccagggagatgcattagaaaggaattaacttgggaggatctgaattagggaacaaaagtactagccagagaaggaaggaagaagcaaaaagggggaaaaaaatcactaaaaggacaggatacataagatcatccagctgcccccaaactgaacttacaatgttttctgtgttctctttggaagaggagttggcttgtccagaattcaatggaaacttgttgattgacactgaattgggcacaagttcaatgtgagtgcgcctgcagctatttatttgattttttaaaaatgcaccctttgcagtaagactgtttagtttctactggcgccctggggcagtgagtttagattgttaaaatagcagccattaacactctctgtgttatgacactgtccttcctaccccactttagaggaatcaggcatgaggttgtttgacaaaagtttaattctcctctccccaccaaaagaaactgagattcctcctctgagtcagaggcacgtttgcccagccctaaccctgaaaacctccaagtctgcctacccgcctcaccaccatccccacaaacacacacacgtgactctcatgtacatctggaacacacacactttcacatacactctcacaggctcacacccacacccatcccacaagctagaggaaccctagggagcccttgtgcttgtcttgctgttcttttgttttgctttcctgtatttgctttgttttgatttgaaatcagtctttgggattacattggataattttttcatgttattaatagtgctgtgcagggagcatgtaaggacttcctcctcagtcctggccatgcttgcttccccaaatacaatgctgactctcattgatcaatcaaactgatctttgtcagactttgcatacaatacctcatgggcaaatagctcagggagctctaaaagatgcctgaattctgggattatctagattattcatgagtctgcttaaaaggaaattttttaaggcaggactggatagctatggctttcccaaaggccctggggaaaaatcaaaggagcagagacaatgtggaaagtgtggaactgctcagctcccagagcaaggcaataatctgaccaaacactaagcccccacccaaagtcagcattggtcaggctgaacagccatcatgagcacaagcctaggaggcatggaagggaagttctgtgttctctggacatctgtgatacatgttgtctataccagcactgtccaatagaactttttgcaatgatggaaacattctatatctgcactttccaatgtggcagccattagtataggtggctgttgaacatttgaaatgtgactggtgtgagactgagaagctgcattttaaattggatttaatgttaatcggtttaaatatgaatagacatatgtgactagtggttactgtggtgtatggcacagctttatcccattcgctggatacttctgtgcggcagtgaatttaattttgtacctcctctctgttcagtgtcttgcaactacatcataaactttttgagggcaggaatcatatattgtacaactacagaaagttataccttgaaaagatattttttttcagctgcctctccccatatttgacaaatagggagactgcgaaagactctgtaactttcttgaagtgacagcactcattagtaacattacctgagcctggaacccaggtctccttgcctcccggactgtgcttctaccacatctcccttgcagacaagttttcgaaagaggaagagttttcttcctctccactttcttcactgtttatatctgagattcagcccctgatacttggaaataatttggatctcaagtctacatttatctcctcatctgccaaggcacaaaataggctctggacaaatgtctgtggggtgaaaattctctgaggtctttctgttgtctgttatcttctatatttttaaagaaaatctttttctgcctcagtgtgtttgagacaaccattacttatgctgtttcagcccagggagatggggcctctgtagatgtggccctggcctgtgcaggtgctcaggtatacattagagaagcctgtgcaacagcctggcaggctgataaaaaagctgtagcagtttgggacctgggcccctctgtcttctaaattctctagacttgatggtagacaaggatgccatcagacatagcgccctcccttcaccacattttcatagtaacctagaactaaagatgcttcagggaggagtctagggccatatcttactggttactttagaaagtaagagaaaatacccagtagaaactaacctcagaatcacctgctaaaagaaagaataattcaacttgtaggtccaagtaaagtatcctttcatctctcttctcctttctctgttttccaccccaggcctttgccctcaacccagagccaacctatggtaacacagcaatagctgaattgaagcaaaacctgttaacagtcaccaaaggctgagtttcggccaagcagatagctcctccaggcagcccttcaaaagccaggcagaggcaagggggtaaatagcctgtggcctatctgcagtagaatggccagatggtttgctggtgccaccaaatgaaggagtgatctggtactaagatagaaggcttccagggaccctcccagccctaaaaatcttaagcccaagtgtagtcatcagatgccaaggacactggagaaagtctttggagcatgtagaacaccaagccaattggagtgcctgctaggacagcacaggattcctagaattccggccacaccatatacacccccacccccagagggcagccagtggccacagcagaggccttacccagcaggctgagaccctcatcagaccctccaagagcctacttccttacttagggcctgcctgcttgcactgtgctgagttcagggaggtggacaaactgtacctcccactttagcctaagaatctgacttgccatggactctccaggcagtgaatcattttgagcaagcacttaagcaactttccactgagtcattctgaggactgtcaggtttgctaatcctgatatatactgtgtataccctttgttcagatcctatacccatcctgatattggaggagaggggttataaacaacagaactttaaggatgtgctcattagaagtcatttgtattagggttccctttgccctactgactctaacagggcctgaagcactaagagaaatcctgctggtaccaacttttgatttgtgtatgcttttggttacatagctatcaagagtatgtactctttacctggagtggcagtgcacattggatttcttttccagaccctccatggatctgttttcctttggcttcttctagactaggggccagcatttctttttttctgtaaagggccaaatagtatatatgctagcattagcaggccttgaagtctctgctgtagcaactcttgcattgtaatgtgaaagcagtcataggcagtatgtaaataaatgggcatgaatatgttccaataaaactttatttacaaaaacaagttgcaggtcatatctggcctataacccctgttctagacacaataggctaagtcaaattagtagctgagacttagtttcagctgctagagtgcttaagcatatcacattggggaaaaaatcactcttatcctccattcttttggggaagagaggtagaaattgcaggaatattttcatctttcccattttgaatatcaaagcccattcctcatcaaatattacatactccatagtaatcagaattggctaaagtatgatgcagtagcaacctacaaagttcaggacttaaaacaacaaagatttatttcttactcatactacctctttgtcttaggttggtgcctgtcattatcaccaacagactctggctgacagtgccgcaccatcgggaatttagttccagcactatgggaagggaatataacacactgtggtctggctgtttaagacttttggccaggagtgatacagattacttctgctcatctggcattggccagagcaagtcacactaccatgacttgacttctacaggacagggaaatgcaatactaccatgtgcctggaaggaggagaatttgaatattgatggaaagccctaatgacaatcacacactctaagaactccttttcagtttcttcttcatgtcattccttgcctacctttaggttatctggcctagttgtatcttttgtccaaccctacctggccttcctcagacatgctggtcattgacattgatacatgggggagggacaacttagggactaaagcattgggacagtaattattccctaaaatgctgtgtagaccagcatgaacatgaagtcaggcctcagagccaggtcttacatgccgttggatccaagggttgattgccattgggcagcaagcctgagaaaaattggacctcccataactctggttttgatttcactttagtttacttttaatgagaatttgaatcagagaggaagttctaagcatattgactttaggcagtgccttcccttagtgctatggagagcagttatcaagagggaagaggaatatggaatgtgaaaggtagaaagtataggtgatattaatgcagtattatgggctaaagtgaaacatatggcccatgattttagaagaaggaatatatctgcaaagacaaaataattagttgggataagcccattgctctaacaatccccaaatcttagtgactaaagacaatgaatgtgggagtggaggggcctatggagagggagggcttttgctccatgcagtcattcagggacccaggcccctttcactctagtggtctttctttcctctagagtctcacagttcatcactggagcctctggtatgtggtccttagtttagggaaaagaaagcaaggagagttttgcaggacgttttataggtcagtcttctaaggcatgtttatcatttcttcccacattcaattgactggaactcattcacatggctccacctaactgcaggcgagactatggaatgtagtgtagctgggtgccaggagtggaggatggagatgggtttaatgagcacacaacattgtgtattccgctgcatacttgtcttgagcaagggtgattttttgtaggaagggttcagtctgactgagtcttaactgaagtcttcatcaacatactctcaatattgaaatgttttccccttacagagcactgtcggccttggttgaacagaagactagtcctgactgcagaggccttagataaatgcaattttgccagtccttacattttacttcataattcacatggcctctggacagatatgtaagagcacttgcattctcattggtacaggtttgggatatgtatcctggggcaggaacgtgaaatagatgacattcaatggtatcgtgagcaatgatcctaggaaattcattctgaatcctaaactgggcgtaaaccattcttaaaaagtaaaaggaaaccattaaaattggaactacataactaatctttgttccatttttggcctggctaccagggcattcagagtcctttaacacactcacatagaatacatagaataattatgttaatcctattcattgtttttttttttttttgaaggagtctcactctgtcacccaggctggagtgtagtggcgcagtgtcggctcactacaagctccacctcccgggttcacgccattctcctgcctcagcctcccacgtagctgggactacaggcgcccgccaccacgccgagctaattttttgtatttttaggagagatggggtttcaccgtgttagccaggatggtctcgatctcttgaccttgtgatccacccgcctcagcctcccaaagtgctgggattacaggtgtggtatttcttatagctacttctcggttcaggtgttttctattttcaattacttcatgatatatgttgtttgttgagaacaggagaaaaaaataaggcatggcttcttcttgttttatttaggctcggtttgaagactggcatttgtgaaaaagatttttctgtgtctatcgtgacttcctgagcagttggttttatatggtgtagttttggagatgaacttcagctgaaagaaaggctcaactctaagtttgatgtgagccaaaggagtgcatcacctcttcaaggacagctagatctttgctgtctaatctaaagctgttcaccagaatggagaaagcacttttatgttccttttctccctagctatatttcaaacatttagggattagatgatttgtatctattattttttctagtccagagcttcgcaaacactttggggccagataattctttgtcatatcgtctatcctgtgcattgtgggatgtttagcagcttctctgacctctacccactagatgccagagtacccttctcaactcgtgacaaccaaaaatgtctccagacattgccaaatgtcccctggggaaaagttggccccagttgagaactactgtagttgtaaatttttttttaattgggggtagataccctcactttcccagaatcctgttctgtatttgacatttcttgcagagatgggagttggaaacaaaggttatggatgtcagggagctcagttctaagattgcctgcatttatacctccctggggtgtggactcaggccatatggaacaaatatgacatatgtttgtccagtacgggcagtaaaaaggcttctcaatactcattaacctttgagaagctgacttgtttctacagcattattgaaggttctgaataagatgaactcttagaatctgaatcactgggaatcttcctgaagtgcagatgatgtttcagtaggtctggagtgtgggtgtgagattctgcatttctaactagctctcaggtggtattaatgctgctggttcccataccacactttgagtagagggttggtggtctctggagaagaggagctggctaactagacactatttttaggttctgcagaaggaattgttctttccaagattattccattggcccagtaagtagtgaagtaatctgcagttcttaaacattccctccttctcctctcaagaaggtacaacccacagtgatagtctccctgctctctctttcattctctgcagccatttaaggctaatatgaggtaagctagtcaagtacttccttttgattagctaccttatattttttggaccttctgtgtgtccgtgtgtaagagagagagtagtttcctttccagaggaaatagtggggataacttcggaaaagccattacagtgtcagaaataggtggctattttatcctagctggagtttcagataatggaaaatccatctctagaacaatgtagtatagctccacttctgggatcacttctggttggccacttcctagcctttgtttcctcatctataattgtagataatagcaataatcaccttagagggtggacatagggagaaaagaactaatgaatatcaacctgaagccctgagcacagaaccagctcagtgtaagcatgagccagtaaatattagttcctaatcttattggtgtggttattgtcattattggaactgggatcctcagactctttttgcctctaaattgtttgcatatattgtactcctatcagtgacatctttcatcatgtgcagtgattctcaatcagggatgaggtggtatgtggagtttgaaaccactcccaccagacaccatggtctccttgttcctcttttgagggttattggtctaagcaatgactgaatctcatattgtttttccagccttggtaagtccaaagatgataatataccttatttatttgtttgatctctgacccctatcatcacttttcactctaatcactttaatatgagcatctggctgccaaaagaagcccagtttcaaactggaaatttttattaatatttgacatatttttacttttcacacctttctttcctaaggaattgtcaccatcccatggcaatcaatggtggagttctttagaatccagatttcctaacaccttccctttcctttctgtgtattgtgtagtcttaactaaataactctccccacatcaggaattttggtctgggttcttaaagaatttcctaggagaagcaaaatgatactttgtcttttcctctagtagttccatgacatggcagatgagctgcctccttggtcgtcaggaagaggtagactggattttcctaacagcgttcccactgctccagcagcctggagccttgtgtgccaccactttccttgcaccctctgccagtggcctccagggaccactttctgaagccagctgctaacagttttccaaacaaaataatatgtgcattgggggataacttttctcaattaatcttcaagtaccaaatgcctcttttcttcctttatgcctaatgtgatagcaatgggctctttcagtcacctcctgacatatcctgtccccgagctcattatctcttttccagtcatctcagaatagtttttcaaaaatgtaaatctcatcaaatcatttcactacttaaataacttccctggcttctcatcatatacaggaaaaataccaccccctggacttgacttctttgtgtctccaggtgcctgatgtcattgggctgttgttgcaagtggttctggttattagcactatacagtatttcacaggggagcattttctcttgatttatagggcttgctaatgaaagaaaagatactggagatgctatcagccatctaggagtaacgtgttaggtcttagctgaaggttgagtgtgactgaagttgggagtgcggttctggattcagcagataatagtgtccatgagatggcgaatatccagatcctcaaaatatctaggttttgatgtggtgcagggcagtgctttccaaggagtgtttctggggcattcatagttgttacctaggtgaaaaaaagagtctggtggataagtaaagtcagagaaaatgctgagttatcattaaacaggtttctttactatgggacttgtgagatccttttaacatattgaaagggacactgaatgttgaatgtggatcttttcccaactttatttaagcacagaattttgttttcacagagcatcttgtggactagtagtgctctgcagagcagacttgggaaatgctggtgtaggcaatacaaaggaatgcttgactgaactccccactgtctcatccagatgcctcacattgtttctgtaaatgctgcttgagggtaatgactaatttgtccatttcaaagggtcattgaccttcaaaaaaaaatctagttctcaaaggattagaactaaccaagtaatagtagaactcattcttaatttattcagggagaagaggaaggcagtgagtgacaacattaccacataacctgttattaacaatgaggcatcgtgaagaatcattgatttaacattacacctcctggtaattagaggtttttaaaacccatagtacagtagcaaaggaataatacaaatctatcagattcaccatggaagggattctttttgttgggctacataatccaagttcacatgaagatttgaggttgaggaattagcctctgaaaacagagggatttgtgttttatcttccgcaattattagactggattttagtgggcttctctagccctcacgttttgctgctctaggtaaaatgaagagacctaaatttgaatctttgctttggcactaaatagcagtgtccccttggcatctctgggcctcatttccacctgtcaaaagagaaggccatttccagtttcctcttggagatagaaccctaggaggcttatgtaatgagattggaatggtccatgagctgaataatggagctgatgataaagctgttcagtaaagtggaagaagaaattttgacaggaaagaacatagaggttgcctctgaagactggattatgagaaacttccacaagtaagtactctcagcacacagaaagctgaaaacaagtgtgcataaccttagagccacagaatctggacagagttgtttgcagagatctcatactgctgaagtgaaatcctcagcccccctgctttgtatggcaatagagagggtacttcttttgggtcatgaaatcctgagaatctgattgaacccacagacccttttcccagaagaaatcgattctgtaactcacttctgaatcacttttgaaaatcatacttatttctctccagctatctgcccttaaatgaagaatcaccttgcctctagatatgcatatttatatgttaatgaaattaataccagactcttaaaattagcatgtatcactatttgaatatttgttccttcttgccatgctctgttccttttttttttttttttttttttttttgagacagagttttgctcttgttgcccaggctgtgcgatctacagcacaggctgtgcactgcagcagtgcaatctcggctcaatgcaacctccgcctcctgggctcaaccaatgatcctgccttagcctcctgactagctgggattacaggcacctgccactacaccaggctaatttttatatttttagtagagacagggtttcaccatgttggccaggctggtctcgaactcctgacctcaggtgatccacccacctcagcctcccaaagtgctgggattacagtcatgagccactgcgcccagccagcatgctgtgttctaatgctagagccagcaggagatagagaagtagaaggcatagaccctgtctcctttgcacttattgatcacttaaaaagcggcacactttatattaggtgctagatggtaggatgcaaacaggcagaccatgagagttgctgcagaaaatcagagtgtgtttgatgggccctgggggctggatatgagtaagcaaagagtagtctgtgggggcagttggggctagcatgagtcagggcagaattggccaatcagaggtagagcattctttagccaagtggcacatcctcaggggatacatctttgacatgaacttcatgaccctggctgggccatgctgtggtgtgggtccgtacatggaactccagtctttggggtgtgcttactcacaagcagttgactgacactgcaagactagagttgctacctataaggcagcacatcacaagctgaagggacttttctaacttctatgggatgtagtaactctggacactggaccatcaaagcagacaaaattatacatctctttttgccttcaggtagaatgcatttggtaagcagggagataatcataatcagttgactttgttgtatgttgcttctttactccctgaatctttttgaaaaacataatcatttttgttctttataatatatccctgtgaaagagaagcaggtgaaatgattacctctgacacacacatacacatatccacacagaaagttctttagaaactgaagcctagagatgcaaagtgatagcagttccatcacacagcaaacaaatagtacaacttagctaagaatacatgggccctccccctgccccccaaaaaacccccaaatctatgccatttgcaagcactctttgcttcacagagacatggccctttcttgcacactctctcctcaagccatccttcctagccatctgtctgacaagacggcatattcaggcagggtcagctactgactgacagcagctgaaacactgacggaagtgggatgaaaaacagcctgcagatggggtccggatgaggagggggagagctgggattagactaggatgtgagctttcagcgccctcttccactctcttctcgccagctggagcagcagatgactgtttcctctcactcggcaccttcttggttgggacagagtgttgtgtctgtctgtttagctgcagagtgatctgttgaatctgctacaagaatttcctggcctgggacctcactgggggttgggccaagggtagaagtagggaggccactagtcttgttgaaggtgtggtcccacagagtctcctggaagctttcaagcaggaaaatcttccccccatcaccccctcctttagctgagctgtctggctgacccactccatctcccaaagtggatacaccacggctggggacactaggcaaaattatgacttgagattgactccctctacccatttgtgattctccctttctttttaatttacctttctcttcttcaactgcctatcacctacaaaacaccttcatttttttcaggcccgctccgctctgatacccagtctttgtgtttgtattgtataacgtttggaggttattttttttttttggtaacgctttattgaggtatacatacctcatactgaggtttacatactgtaaaattcacccttttatgttgtaaagttggttttagtatatttacaagatgttgcatccatcaccactatctaactccagaatattttcgtcatctctaaaagaatcccatacctactagtagtcactcccattctccccttcccccagctcctggcatccagtgttcttctttctctctctatggatttgcctattttggacatttaatgtaaatggaattatacagtatgtggtgttttgtcactggccttttttttcacttagcagaatttttcaagtttcatccattatagcaataatattacattttatggatataccatattttgttcatccattcatctactgatggacatttgcattgtttccatcttttaactattatgaataatgctgctataaactttcatatacacatatctgtttcagttccttctttcaatttttttgtgtatatacctgggagtggaattggtggcttatattggtaactctatgctcaactttttgagagactgctagattatcttccaaagcagctgtactattattatttttttttacattctcaccagcactgtataagggttccaatttctccacctacttgctaacccttgttattattgtcttttttattatagccatcctagtggatgtgaaatggtatctcattgtaggattccccccaatagcgcctttctctttactggggaatagttccagtcttgtgtattcatcactgtgaagatattaaacctctgggaaagatagggcccttctctaactaatgattgaatctgggggcatatcaggcattctggcagggtggagaggaagagagtttagggacatggtgaacttgccacctttggaagctctaccatcgcagaagcaatctgctctattgattgctttcccttcccacaaagagaccatcaagtgcagaagtaatcaagtgaagttttcttgaaaaggcaagacaagagctgggcaacgaagggtgggaggccaaaggatgtatgaagggggaaatggagaggcttcctaaactaaaaaatattaaatcctttctgaaaagcaccttcagtagtgacctaaaacaaagatgaaagtcaaaccaatcaacaattacttttgtttagcaattctggaaaacatgttgcaggagaggacactggaaatgatggttaaaatacggtgggagccatggcagttcaagcctgtaatcctagcacctcaggaggctgaggcaagaagatcagttgatcccaggactttgaggctgcagtgagccatgatcacaccactgcactccagcctgggcaacagagtgagaccccaactctaaaaataataataataaaataaaatacaatgggagtgttggccaaggagttcactttttctctctattccatgccctttaggactactcataatcacaaatacatttgtgacccttctgagcgtaaatccacctgtctggggtgctcaataagtccaaagtagagtctatgtgcttggtaaatggctctggctagaaagcaactgcttggctaaatcacacctgacggtcttcccactgagatgggaaaatggggcagatagtgtttgcccaggagctggggcataaaaggattcttagtggatgtgatggctcagaagtgaatctctagttaccacttgggatctgacagtttttgagaagttctacagggctgtgaaagactgcacaggggtaaaaacaaaccttgtcattacattacaggtgttgagaatttctaaaatttacagtatataatactgattgaaaagtaaatgtcactgctactttggagttcagcataagccttatacagaggcagggtctgccagtgtggtaagaggatggccactgtaagggttaagtagccccacatctctttccctaccagcctgctttctgccctccagaaaccctatcatttatagctagtagtaaaagaacaacaattgcatttattgggcattaatatgttcctggtactatgctgaacagattatgtcttaccttgtttgatcatcccaacaacctatggggtaggtaccattatcatcccaattttatagatggagaaactgagactcagagatgctaagaatttgctcagctaataagcaataattagcaatggagctttaatttgaatccaaatgggacactctgaagtaaggcttctcctctccctaggacaggtcttggaagctgcatttttagcaagttccctcattcaggtcttaagttctagaaagtttcacactctttacccggtgctctacagcctcattatgaataaaacatcaaaggcctatgttacaatataattatctagaaaaggaccctgttttaaaacattatctaccattttcatttcagtatgaattacttaacgggattagtattaaggcctgccagcatgacctcaatgtgatgggccacaggagagttaagttcttatgggggaggagagtttggggaaaatctagaaatcgttggactctacccgaggaaagcagatctagttaagtcatcacatcaagaggcccaggggaaaaagaagtgatggcagttgaagtgctgaaaaaaaaaaagaaatctaaaggtaggcatcattgattcaactgatgggcccatttgaagcagtacctctgatctcagggagcatcccaaggaaaatgtcgtctgaatccacatagcctcagaatatgagcattgttactttttggaggtggggggaggctgcagacacccactcttctttgtttttgtttttgttttgagatagagatttgctcttgttgcccaggctggagtgcagtggcgcaagctcagctcactgcaacttccacctcccaggttcaagcgattctcctgcctcagcctccagagtagctgggataacaggctcccgccaccacgcctggctaattttttgtagaaacggggtttcaccatgttgactaggctggacttggactcctgacctcaggtgatccactgccgtcgcctcccaaagtgctgggattagaggtgtgagccactgtgcccagcccactgtttttgatacattcatcctgcaagatgtgttgcatcctggatgtatgctcttactttgcctgactgagatgcagctagctcccagctgctcctccctccattacagcagtgctctggtagaaggccatgggtgatttcccactagcaaccttatttgtctatgttccttccatttgggccaaggactaaaagccagctcagatttacacaattactttaacattgtttaagaaagcaatgtaacaacctccactttgcccagatggacgggctcaatgatgtcggtggagagaacccattattggaataagactgggaacacaaagtcatagctaggatctctcccactagtaggaatacagccgggcttctgatgaccagctttgtaggattgattttctatggttggaatggacccaaaatgttcacctagtctagtctacggccttcaagtagaagttttttcaaacgtagtcttcaaatttaatgaggaatacatttatatcattcaagaatatgaatgcatatgtatatgtacatgtatatatgattatatatctaggtatacatataaaagaatgcaatagaatatcttattcaccccgtcccacactcacccaattcttatcttctccctacaacatgtagttcccccccataacttttagtggttatatatctttccagatttttatgaaaatgtaagcaaatatgaatatatatatatattttaaaaatattttttcatttacataaaaggtagtctattgtgcacatcattttaccccttgttttcatcatttaataatatatctttctgtattagtgcacagagaacttattcttttatagaactacataatattttgttataataatgagccatcatttatttaaccagatttctatcaatggacatagaagttgtttccatattcagccattacaaacaatgctgcaatgaataatttttatatgtttcacacatgtgcaagtatatctgtagaatgaattcttaaaaataggattgttgggtcaaatatatatgtatttttaaatgaacagatattgctaaattgcccttcatcatgttttaatcaagtcttcacagacttaccaagagagtgttttattcaaacttttggatttttctaaatctgctaagaaaaatggtatttcattgcagttttaatttatatttctctaatgaatgaggttgattttttcatgtctaagggccacttgtagttccatttctgtcaactgtctatttatatcctttttccatttttaccattgggttatgaatctgtttcttgtcaatttatagaagctctttatatattagggacaaataggattttaatccccaaacagcaaatatgtgaagagattctattccagtgttttacagtgtcttatggcagcaaactctttcttcaaatgaaatttaaaaaagctaataaaaacacatttcactaacaaagtaagaggtattctgttgaagtagaaatggggaagggattttttttttcacatccctcaagtacctctgaagaatcctaaagcagcacagaacctagtttgaaaataatttccctacatgcctagttggcctgtggttccagtttctaataactctttcagcaaggaatcttttttagtatctaacctgaatccttattgatgcagttgatactcctccccacttaacattggcaatttgtgattatttgacctctcttccattatgaacctttatgtgttatttaaatacattatcatttaacacctttttgtgccttcccctccaatgaaagcaggattttacttgaagtcaggggaatgtcctatttatctttgtagctttaaggtaacataatgccaggtattgtcaatgtatagtcaaggatctattagtgccaggtatagtcaaagacctccacaagtgcttgttgaatgaataagaaaacaagagagaaatagtgttttgactcatgtctccatagcacctaccatacacatcagtgcaaagcaaatgcctttcagttagttatcatctatggaaattgggaaaattccttcatattcttcaactttactgctttcctctctgtgacctctttctagagcaagatcatctaccatttattgtgaatgttatgtaccagatacctttgggctttttaaaattaattatcgctgaacctcacagccacgtaaagtagaaggcatactcaagccttcctaagatcacagaaccaagacatgccaaagctggtgtcttagtctgtttgaactggtataacaaaacaccacaaactgagtagcttataaacaacagaaatttatttctcacagttctggaaggtggaaatccaagatcaaggtaccatcagatttgttctctggtgagggcttggcttctggttcagtgatgataccttctccctgtgagcctatatagtagaaggggcgaacaagctcccacaggcctcttctattaaaagcactaatctcattcatgaggatgttgcccttataacttaatcacctcccaaaggccccatctcctaaaagccatcaccttgggggttacgatttcaacatatgaatttcagaggcacacaaatattcagatcatagcagctgggaccccagagaccaatgtttgcagaccccagagaccaggctcagttatcttctcttgcatcactgtgagatacgcacatagaaacagcatcctattctaggggtttctttcaaggcctttttgtcattctctcttcccatatatttctgagacttggggtaaagccctttagatgatgtagttttactttgttggatgtgtatgtctctctgtgtgtcatgggcaattaaagggactataacctcttctttctagtctttaccttcatttccatgtcccttctccagccacctcccaatagcctgcaaatgttctaggactctatcagtagaatgacagagaaccaaagaaatgctagcatcaggctcagccatcagaagaaaagtaggaaccaaagtaatggcagcaatggcaaaagaaaagatggcttggcgtcaaggagattagcaactgatctctgaaagctctggggaggtttgtatttataacactgggagcagatttgtctcctgacatacaagctgcttttctgactatccaagaactgtcctactatggaaatgatcattttatagggtggggagagtggggaagagagcagtcagcatgaggacttggttccagagtgtgggaagaagggtaacaccaggagaggagggaaggcgtacaaaaagaagtgaagtggaaccacaggcttcttggtaaaatttgccagttgctctgaaggacaaaaaaaaaaaggcctgtggcagttattcagactgaggtgttagttagtgacaaggtgtaagtgtaccctctcatataattcttgggattacaaaatctgattgcaaaaggtagccatttaacctagaggaatggacttccaatagtggcattttaagcatcagtgtgagaaaaggtggtaagagacatttgggataagggggtattttctgagcatcccggaaatcatagttctgcttacatatgagatcatccctcacttggggagaagaaacctcctctttcccaacacatctgtggtcacatgacttagtgcttgtctgctcaccctacaatggttttttctccagtcctcctcttagtgctaggtgggaatttgactggaaacagaagagatgggggaggttagaagccacgcagcctggtcattcctattgtagcattccctgaggggccctgtagccagctttgctttgaactgattttctgctagttttcagtcaggaacactgaatgtgttccaaggatatttgtttactagcccagccaccttggaaaatctgggagaggagaaggtaaaatatgaggtggtttttcttccttctgcagttaggaagcatgctgtgttggccctctaaagatgcaaggggagatttgagtccatatcgcattcctagaaatattgaagcttaaagaggtaaagtgccttgtacaagattgtggggagtcagtaccattgagttgggattgtgactcagtgatcctgctctgaagctttaacacccattctgtgaagagcacaaatttgaaagcaggaaagctatatttctgagttggctctcttgttaaacagctgtgtgacatgggacaaatcttttggagtactagtagcctcattttcagtaattcgccccccacccccgagatacacaccattaagggtgttgcaagaatgaaataagaatgagatgttaagaattttattgcataaaactagccttaagcatgaccataattggtttctttttctttgattctactgtgtcttcctctctttctctttctccctatctcctgttgagtagaataatagactccagtgccaggttactcagaagactattgcaaggaagattctcaagatcattcttccactggaaaatctcaccctgcagttgccttgccattgattccttggtagaaggcccggttcaaaaatcaagccacattcttttgaggcaaaataattccaaacttcttttttgttgttgttgtttgtttggtattccaaacatctgccagctcccataagagccgtgacaaatattattttgtaggtcactgtagatttccttcaccacaaaatgctgagatttggaataattagagcccagggggcaaatgggcctgcttctgtcctttctctgatgggtttcactcatgtctgccagctgcagctgtctgattgtatacgcttgtgggcaggggcagggcctcttagcccagacagagttaattagtatgagttaaactctttctaggagctaaggctgtctttataaggcaaaagtaaggaactttctttatatcctctaaagggtcattaataagtagttaacaccctgagagtgaattactcagaaattgatgttagatcgacttatatagcaaagtatagaattgagttagttacccaaatcgctgaagccaaaagaagtgcattgtctgttttctgggtattttaggccacaacattagggacagcatagccttcatgttctagtggtttgggttttggtttttaattaaatggtcccttccttattataggtttgaagtgattggcactttttttgatagtggttatgagggaaggttctagaatcagtcagacatcaagttatatcttagtgctgccacttgcaagttgtgtcaccttgggcaagtcaatctcttaagccttagtttcttcatctgcaaaatgggcataatcatgtctacatcagaacattattagtaagagccaatgagattatgtatgtaaaagcactcattcctgcctggcacatagctagggcttgataaatggtatctattcgtgtattattattattattatggatgttattattgttagccttatcattttcactacatactgagaataatttcattctttttgcttgtttgtttgtttgtctgtttgtttgttttttgagatggagtctcgctctgtcgcccaggctggagtgcagtggcgtgatcacggctcactgcaagctctgtctcccgagttcacgccattctcctgcctcagcctcccgattagctgggactgcaggcactcgccaccatgcctggctaattttttgtattttttagtagagacggggtttcactgtgttagccaggatggtctcaatctcctgacctcgtgatccgcccgcctcggcctcccaaagtgctgggattacaggcatgagccaccgcgcctggcccattctgtttttttttaaacagttgtattgaggtataacttacccaccacaaaatagactcatattcattacagttttgactgatggaaaagaaaggatggttcaactctctaagcctctccctaatgaaacacacagctcccctgatttctctccttccactgtcttatggcaggcactttccaagctctggttgtatcttttgttggtttcaattccttttttcaccactcactagctttgtgacttcaaataattcacataacctcagcaatcctatttccctcaaatgaaaatgaaggtaagaatttaccctacttgattcacagggttgttatgaagctccattgtaataatatatgtgaaatctctttgtaaatggtctgctgggttactataattcacaaatatgagtttcaataatattcaaatgtcatattgtgtgcttcagacattagatgccttgagagatccagattgtggctggagttatttagagaatgcttcgtggaggaaaggcggcataagctgaaccttcaagatcagataggacctcaatgggtggaaaagagtcagggagtgggcagtctcggtggagggattaaaaaaaagcaaaaccacagaggctggaacaaacagataagcacaaaagtgatttaaaatgtaggcggtggccgggcgccatggctcacgcctgtaatcccagcactttgggaagatggggcaggcggatcaattgaggtcaggagtttgagagcagcctggtcaacatggtgaaaccccatctctacttaaaaaaaaaaaatagccaggcgtggtggcaggcgcctgtagtcccagctacttgggaggctgaggcacgagaattgcttgaacccaggaggcagaggttgcagtgagcagagctcgcaccatgcactccagcctgggcaacagagtgagactcagtctctaaataaataaatgtgggagggaataaagttaccagggcagtataatagatgggtccccttctgaagcaactgggggaaaagattaaatgagatagcatggactccttcctttcaggaaagataatatcttattcatctaggaatattagctccatctaggcagggaccttgtccatgttctctgatccctctctaacacatattacaattcctggcacatagtaggtgctcagtaaatggtcaacaaataaaagaatggatggatggatggatggacggatggatggatggatggatggatagatcataatgtcagctgctgtacttgtctggctgttttaacattattcaaaatcattggtcactggagcggggactgtcttaaaactccctctatgtagtacagccccgtctgctgttgggatttatgaaattcttgtcaatgatgccaatactcagtgtggtttttctccaccctgttctagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggtaagaccctacatcttaacattcctgctaggccctactcaaatacaagagcttcctctgtacttgtactttcatttgtgcctgcactgtaaggtgtttgaataaaacatgacttgcattaaatcataagcctccttgacaatccaaactccctgatcttcacccaccctgaacaactctgttgaagggctcaggcccaatcatatcccagtcttaaagctgtaggactgcttaaatgggcaaaggtgagctgtttgtgttgatcggcgctccttttcataataattataccaccaaagcctccatctgaaggactcacaattatttgaagctttgggaatgctatgggtggaaaagtcactttgactatctagggccactcactccaattaacaagaaaatgagttgtctgttagttcccatatctgaagtattttactaaccagttaattcctagtgccctgcaatgagaaaactctctataaatgcttggtcatgatgactaccaggacattacttgtcagaagaactgcatttactttacaaacaacgtatactaattacatcttatctaatatgcagtccggagaatataatcaatagaactagaaaatggagtaaaatgagtgtttaaactgaagcaggaaggaatgaagttagatgtagtaacaacttttctgcctgcaagtggcattaagcactggattgtcaagggaagctatagaatctcttccctttaggacttttagtaagaatatagtatctcagtagtttaggagaattttcgtgtggccttgctttcttaatggccttccaggaatcattctagccccaaaagaatgtgcttctaagaactaagaacaaggtttaaggaataacatttgaaagatagaaatttaggaaatcaggattattgcaaagacagatgtaaccagcaagtaaattttatcctctcccttgccttgtgctagactgagctgtggccatcagatcatcttgtatagttttgtattaccccagagagcttgttcctttggtttggaagggagagtctagtgaatattacaaatggaagctatgaaataaatcttcattcctttaaacccccaatccagctgggggaccaagggtaccatgaacagagaagaaagaaacaagactataattcatggttcagaggctcatggcatccctgacagactactttgtaccaccttagaccatgatgctcgactaggattgctaacttttctgtggcttagtctctggcatggaggaattgtaggagaaaaaaaataatgcgtaataaaatgtaggaagtaccgagaactgacgatgggagagctggggggaaggacatgccgtgttttgagtccctgctctatttcaggtattaagtgaagcctttacacttatcctagatgcttctaatcttaattctgtttctccttggcaggagggaaacgtgtattgtggtctcaagacttgccccaaattaacctgtgccttcccagtctctgttccagattcctgctgccgggtatgcagaggtaggtgtgttatatcccaagacccctgggtgctgctatcctgtgtagtagaatttagaaaggaggaaaatacctgtctaatgtcctagggaaaggtaatttttatggtagccttagtttttaaaggtggtttaattaacaaagggaaaaataaataaagcattgattttaaaggccacagcctttaaaaaaaaaaaaaaaactacaggatggagtgctgtgcttcaggggaggatgggaaagagtcatcaaatgtgaaagtgaatatatttatttctccatccttaatcccttctagcttggcccttaaattattgtatcataaaacacagactattttcattcatagccttagaaggaagaatggaccttgcaaggaattgatgtggccattttgaagactgtgcagggcaaatttaggtatactttttaaaccccataataagatggtgacaaactcaataaaagcaaaacagaaagcattttctcaaattatattcaaaattgaattgtcttctcacattagtctttttttctttaggttttattttttttataatggcaccagttttttcgctaggttcctgggatcaagtgtaatcccctttaatttctcctttgttacctcttctcagattaccaaatctttcagcagttatctgtatctctcccttttcccactttcccactggcaatatccttattttgtcctttttccttctatccagtcaacatattttttgaccatctactgtatgctcagcattgtgctagaattggggtatttatattgataaatacagtagatatatagggtggtgctagaccatatggcatctttatgtgagttacaaaaaggattcccttacataagatactttattgccatttttcagaaaatcccagggaaagcacctttgtagctgtggcatccttttgcagcacacaacctacacaacaatatatatagcatacatagcagccaagatatgttctttgctcttatggaactcaccagaaaagacaaataataagcaaacgtggaaatacagataatgcaagtactatgcagaaaataaacataggactgagattaaaaataagtagtttatttaggttgagttgtcaggaaggcctctctgagaaggtgacatttaagctgagacctgaaagataaaaagaagtcacccatgcaaagatcccaaagaagaacattctaagtagagagaaaagaaagttcaaaggccccaggcagggaagagcttaaagcattcaaagagcctaaggaccagtgtagctgaaatgtagtgattgtggttgaaactgacatgggatgaggctgaagaggtaactaggaattagaccatgcaggattctgaaggccatgggaaggattttggatttccatttttaatacattgggaagctattggaaggttgtgagaaagagtatgaagtgatccaattaacatattaaaagatctcactggctattatttccagactagactggagggaggcaataatgcaagtggagagactagcaagatggttagggtagtactctttccagtgtgagaaaaagggtgcttggactgagaacacagtagtggttcagagtggagcctttggagccaaactgccttggttctaatcccagccttgctactttgtagttgaatgaccttattcaacctttctaccaatctttaaagtgaggataatgttagctcctaccttcaagatgtttgtgagatttcaatgagataatataagagaaggacctggcacagtgtcttgtatatactgaggacccaataattaaaagtggacaaatttgaaatacatttggagccgtggttctcaactatgggtgcatattggaattaccttggtagatttataccagatcagaaggaggaggatgtgattccaatatgcagctaaggttgtgaaccactgagttagaggaaaaaaattataggatttgctggtgggggatgtgtaggtgacttctatacattactgccattttaatcttccaaaaagcaatccatcaccgtgttacacccctgttcaaaaatttttatgccaacatgtatttggacttactatatgtcagtcccagttctaactaagcattttacagatatgaactcacttaatctcatgacaaccctatgtgaggagtactattgttctccctgttttatggatgaggaaactgaggcagagagcggttaagaatcttatccaaggtcaggtagctagtgagttgaggagctaagatttgaatcctggcagcctggctccatatttcaggctctaaccacagtgttctgccactgaaagggatgactccctgtcgccactcaaatacatgtcaacccccgactctgatagtgaaggcctttcatggtctaacctcaagttacctttataggtcaatattcttccattcatgcacctcagggcccactgcattgttcctgtgctctcttacctttttacctttgctcagtcctcttcctgtcagtgtttctcacactttagtgtgcttcagaattgctcagagaacttgttgaagttcagattcctggatcacacctgcagagattctgatttagtggccttggagtgggacccaggaatctgcatttaagcagaccccatcgttcattctgatgcagaatggtggtctgtggactgtcactttgagaaaccattcctgagaccatgtagataacctggaaccaaggatttgttttaaaaaatctgagtttagtgcacttaaattgagcacattaaaattctgaaacctgagtgaaccagtggaaaagcaaccaatttcagttcctgattggttaaagcatctaagtccgaccatatggcaaccaatttgagatgaatgagtggtggccatttcatgataaggaactgggatgaaaaggagacaaaagggctgtctaagtaacaactgcacatgtacaggttggatggagaaaatgtttcctctttctggaaaattctttttctccatccctgcctgtggaagtcctgctagtccttcaagacctagcacaaatgcagcttcctcagattctattgcaggccgtcctcaggtcgcattttgataagtagtagttggaaggcctttcttttctgccttcccacttccatccctaatttctccacccataaatcctgcttatccttcaaaatccagcctaattgccacttcttccatgaaatgtttttaaatcctgcaaactagaagtaaacctgtctctactctaggactcctcagcacttaacctgtgcttcttctggagcatttatcaccttgtcaacttctgttttttattatttgtgcccatgtattatcatccctattaatgcataagctcttcaagacagatactctttttcatttatctttatttctcccactgtgccaggcagagtaggtgctctttaaatgaatgcacactagattggaatgattactagaaatttagtcaggatttgaattaggtgctaccaaaaaagaatatggttgttgtgcatttttccccctgaattactgattgactgtggtagatggtgttgactatacattgattcctcgtcaataggaaattacttggtctcattcctgatctccaagttgttttcttcccctataccactttaggaaactacagttaacattgctttttggaaggactgagcttgtttggactaccagtgtatgctcatcccttttaatatgctatttgcatcagccctcataagtcaatatggatttagttacagcctaatttgatttatgctttggtaaggccctggatctttccatacatgtttctcacaatgtgtgtgtgtatatgtctgtactacagtgtagctgttacatttcagtcaagaaagatggatattttgttcctcacctcctttcttgtcttggccccaacttaatttcagtgtggctcaaaagaaagtccatactgagcagaggtgtacatgtggttgctaatataaccagttggtcactataatccagctgttaggctgatattattccctttggggaaaaggatatgtgaaatctaaactggaaaacaattgataatagaaaggaaaggcaacagtgaaaagacatgtcactgcaacctaggggcaatacggtataatgcaaaggacagaggctctgaagccagaaggtcatagatttgacattgcagggctaccacctacgagtgctgttatcttggacaaactatttaaccactcaaaaccttggttttctcaggtgtaaaaatggagattatgcttactacgtatgaaatgggttgtgtagattaactgagatggcgtagagtgctaggagatggcctaatacagagttattggtttataagtaacaattactatattttatatagtaattactatatttattacccccgagttaagtatcattgcaccttctcctctatctttgatagttttgcctttttaaaatgtaatctccatagacagaactttagttctagttcttcttgtggtaacagatcctggaactagctattttatgtactgttctatcgttacaatttaaatttcttttcttttttatgtcctcagaagcaacagataaaagctagttattactggccatgtattgtccctttatatacttgataattcattaagttctttctttgcaacctctcatccagcctaaatgcacaattttctttcatcttcctttataaagactaaatcctacacttttgtaaaaattgttgttctttcattgcctccagtttctttgcatctttcagctgtatataatgtggttgaaactcctttgaagttctaacttttgaagcacctagttattttttcccatggaaatgacgtttttacaatactgtatcttatataagcgtattactcatacagcagggaacccagaaacctctcccctatgctggccaccctgactgcaggccaaatactgaagaagaaataatcttttgactgctgaacttgcaaaccttcatataaagggcattgaaatagcctctctgcactgtccccaaacactaatgtgtgtctttcttcctgggtcagacagcaatcctagacgcggattgaatctcagacctagccttcattggctagacgtgtctttgaggctgggacagtcaaggagagcgttggcagaatgtgtgtcattgctagcacttcagcaaacctcattaggactggaagcatagtgcaaacagccactggaaccttaagggaaattttatcagaagaaaaaatctcttcagatcctgtgttagtttgctaaggatgatagcctccaactccatctatcttcctgcaaaagacatgctctcattcatttttatggctgcatagtattccatggtgtatatataccacattttctttatccagtctgtcattgatgggcatttaggttgattctgtgtcttcagaattgtgaatactgctgcaatgaacatttgcgtgcatgtgtctttttttttccccaaatactgcatgttctcacttataagtgggagctaaatgatgagaacttacgaacacaaagaaggaagtaacagacactggggtcttcttgaggatggagggtgagaggagggagagaagcaggaaagaatctgtacaacaaaccctcatgacaggagtttacctatgtaacagactttcataggtatcctcaaacctaaaataaaagtttttttttttttaaatctcttcagagattatactactgccacattctgggaaggcaggcttcaaacccaaacccacacccagcttccctccaccattgatcatttccacttcctgtcccctgctcatcttgccaaaacaacagggaaggctatgtacttggactctagacaagggaaaggtatttggggtaggtattaactgtattgaaagccaagtatgcatttagtaaatggtgtctaaatgtagcacgtacaatgtgccagacaatgttctaagcacttatgtgtggaatagctcatttgatcctggcaaaaatagtagcaactatttatatccccattctacagatgcggaagctaaggcagaaaagttgagtgatttgtccaaggacaaatggtagtaagtggcagagctagaattttaacctggtcagtctggcttcagagtttcaagctcttaacttctatactacctgttgggacccattcataggagtatgacaaggatatctcctagtacaggggagtaaaggggaagacgggacatgcatggcacattgttgtgtgcagatactcctaagagagtatcttaccacactgcccatgttttcccatcaaggccttaacttacccttctctcactctaggcttaaagtgtcttgagtgtaaatgtctactttctttcattcagcaaacattgttaagcaatcactaagagcctggcactgcaccagtgctagagatacaatggtgaacaaaaatggacatggaacctgccttcatggagttttagtagggaagatagacaccacgtcatgatataagtaattataaaattgcaactgtgccacatgccacaaaggaaagttgttataaaagccaataattgagaggggttgacctagtcagggaggtgaaggaagacttctgagactgtctctccagcctcaactcgcaccacatccctccttgttctctgcactccagggtgaggaaagattggctcaaaaattagggagataactggtggcagtcatacactcctgggatccccaacttctgatcccaccatgaatccagtccctccccaggctgtaggggtctataatgttctttctacattatacatgctacataataccctaatctaggaattttcttttactcttctttcttttggctgtttcctgtttttcagagacagggtctcactctgtcatccaggctgtagtgcactggcacaattatagctcactgcagcctcaaactacaagctacccttctgtctcagcctcctgagtagctgggactacaggcgtgcaccaccgtgcccaaccaatttttttttttttttagagacatggtctcgctatgttgcccaggttggtctcaaactcctggtcacaaatgattctcctgcctcggcctcccaaagtgctgggattacagacatgagcccagcctaggaattttctttttgagaaactacttgatcatgctaccatttcttaccatattatccaatctgaatttttcagcttgtttttaaagaccctctgtgaaacagtctgatccttccttaacctactttccagcctcatttctctgacaccaacacacacatctcctttaggctggctggctgatctctttgttctgttacatgctatgtttcttcctaccttccctcctgttatgtgcttcacttaaactgttatttttcacaagcttggaatagcccccgctcctcttctacctattcgcatcctactcatctttcaagggtccagttgaagttgcacctcttctaatagttttgcccaatcactctagttctcattgatcttctttgaccaccttcaggacttaatctggttcaaaaataagcattcagaaatatattcttgcactgttattgctttgtgtcttcctgtttcccctggcataacataatattaatcatatatcatgctgactggtttatttaatacaaaaagagccacagtcacaaaaagctcttgacagcattccaagtacagatgcagtagggaggcaggagaaatggtggaacttacaatttgctcaacccaagcccgttcatccaacatatctcaaatgagcccagggagaaaatggaagtcactttttatgaaattttgatatttctgctaactccttcaaggtaaatgaaactggaagcaattgtttaaaagtatattagtcagtgttcaagataagtgccattttacctaagacacttgatttctctttccgaaagagcagcaaaattgcacctcagatcccatctcagctagaatccgggatcttcagggaagtggtatgtgagatacttcattgattttaaacatcataaaaattgaccagtttttcaaagttttcaaaatcaaagaaaactgaagaaaataacagcaaatccaaatatagattctcacaaattagtctcaagttgtttatgttttggcccacattttctgcagaaacaccaccatctcctggtcatgatgataggaaagaaacattgttaatgagaaacactactttaaaaaatgaaaattcatcttgtataactgaaaccttatgcctgttgattagcagctccccacttccccctccaaggtgaacaagttctaaagatctgcagtacaacattgtgtgtgtatagttaaccatatagtattgtatacttaagtttgttaaaagggtaaatctcgttaagtgtccttaccacaataaaataaaaaaaattaaaattaactcagtaatttttgagtttatacattctcacctaaacttcaaaatacagtccgccctctatattcactggttgcacatccatggattcaaccaactgcagatagaaaataatttttaaaaacacgttaaaagtaacagtacaacaatctaaaaattacaaattttagaaaccaatatagtaaaatgactatttacatagcatttacattgtattaagttttataagtaatctagagattatttaaagtatatgggagtatgtgtgtaagttatatgcaaacactatgccattttttatcagggacttgagcatctgtggattttggcatctgtggggggtcgtggaaccaattccgcatagatactgagggacgactgtgtattgatatactctgatattttcatagctatagaagagtctcgctgtcattaataataccttttcaaaagtgaatcatttatgttcatgtgtatgggaccattttagagatttgccatcctcacctacctctcctcatctaaatcccaactggatctccttccatggaaatgttccagattgtttttgctttctctccatctcttgtgctcaaaattcatccccacgtacttgctgactgtcccaggaccccgtccctctaaggtcatcatgttccttcttggcatgtttcttacgtctagaatatttcttcttgaatagaaagtcattcagacagtggatgggacagcgttgactttcacattgagtttaacaaattaatagcactgattcctaatcggccatctgggttgtcctgtcagggtcagtaataccccattctgtttctgggattggaggacttttttgtgtgtatatgaatctgtttctataataaaaataaggaattcccagtgaagcatttcagagcaattatttcttcatgggtggttaaagccactctttcttcaaccttattctttctaactccttcaaggaattccatagctgcccagaaacaccattggatgtgcccattactcacattataatagtctttatgagcttagactccaacaatttatagaaatcaacctggtttgttgactgacagtgcaaacagaggtaaaagatacatgagaaggaagagcagtgtatacaactgactgcttttcattttcaggttgaccagacagtcagcatgggtaggtcattgagtttctcctctctgtcctgctttttattttcagttcatggatgtggtagcacagaactctactttatttggatacttggatttttttttttaagacagagtctctgttgcccaggctggagtgcagtggcatgacctcagctcactgcaacctctgcctcctgggttcaagtgatcctcccgcctcagcctcccaagtagctcagactacaggcgctcaccacatctggctaacttttgtatttttagtagagacggggtttcccgatgttgtctaggctggtctcaaactccttacctcagatgatctacccgcctcagcctcccaaagtgctgagattacaggcatgagtcaccgcgctcagtgggcacttggatttttaagacttcactttataactttgtaaattgtactcctaccaatgaagcagatatctttcctgtcaagcctcatttttagccaagagagaaaagagattttaattaagatgcaaactcttttttaaaaaattggaaatagaggactagcataattatgagaaattctaagccagtttagaaggtgtgagccgaagaaatctctctagccatttttaaaaatatctccaggaccctgtcttccaatgatttagagatgaaatgattccttttcaatgtgcaggcatgcagttatctttgctaggctttgtttgcttgtttgtttgtttgtttgtttgatccaagcccttttctttgttaaatacacagcacacttgtgggagtcccttaagccgggtattcccccatgtgtaagctacccttgaggagaaggaggaaaaagaagtggaggcaaagaatgggaagaaaggggattaggaatagcagctaacatttagctgacacagtgtgccaagcacaattctaaatgctttgcatatactaattcatttaatcttcacaaccctataaggtaggcattattgtctccattttagcaataaggaaactgaggcacagagaagttaattcatttgcccaaagtcacataagtaggaaggagcagagccagaatttgaatccaaactgtttggctccaatctgttctcttagccattatattatactgcctctcaacttggggaagcaaagcaaatttgggaactcttatttctgaggctaccgggaggaacagactgtgtgatgaccatctttccaggggccagatatggtaacaatccagcagatgcattgggactgctctgagaagcaaagattctgtttctcaccataaacttggatctgtttagccacatctccattgaaagagcagagtgtggatggtgggtaccatccagctcgtagtttctgtattcactctcttctgatttcctcctggaaacgcatgcattctcacaatgcactttttaaaaagtaagtatttatgatttttctggacaaataattttgtactcttcttcagatttggcttgctactgttggcaggaattccccccgttgtgtgtgttttggtatttctcaaggagctattttgttaaaaatactaagatcttatattgacagcccaaacaataaagtacttcatttgacaaagaagtattttttaagaaaataactgtctgatcctttttatggctgtatagtattccatggtgtatatgtgtcacattttctttatcccatctatcattgatgggcatttgggttggttccaagtcttgctattgtgaatggtgctgcaataaacataccggtgcatgtgtctttatagtagcatgatttataatcctttgggtatatactcagtaatgggattgctaggtcaaatggtatttctggttctagatccttgagaaatcaccgcactgtcttccacaatggttgaactaatttacactcccaccaagagtgtaaaagtgttccaatttctcatcctttccagcatctgttgtttcctgactttttaaggatcaccattctaactggcatgagatggtatctcattgtggttttgatttgcacttctctaatgaccagtgatgatgagctctttttcatatgtttgtgggccatataaatgtcttcttttgagaagtgtctgttcatatcctttgctcactttttgatggggttggtttttttttcttgtaaatttgtttaagttctttgtaggttctggatattagctctttgtcagatagatagattgcacaaattttctcccattctgtaggttgcctgtgcactctgatgatagtttcttttgctgtgaagaagctcgttagtttaattagatcccatttgtctagtttggcttttgttgccattgcttttggtgttttagtcatggagtctttgcccatgcctatgccctgaatggtgttgcctaggttttcttctagggtttttatggttttaggtcttacgtttaagcctttaatccatcttgagttaattcttgcatgaggtgtaaggaaggggtccagtttcatttttctgcatatggctagccaggttttcccaacaccatttattaaatagggaatcttttcctccattgcttgtttttctcaggtttgtcaaagatcagatggttacagataagtggcattatttctgaggcctctgttctgttccattggtctatatatctgttttggtaccagtaccatgctgttttggttactgtagccttgtagtatagtttgaagtcagatagtgtgatgcctccagctttgttccttttgcttaggattgtcctggctatatgggctcttttttggttccatttgaaatttaaagtagttttttctaattttgtgctttataaaacttgcagatttcttgtattgttgtatatcatcattggaagctcaaatgcctatcagtggagaatccttatactagtttccttttaaagcttctctcaaatttcagcacacttgctccctcccagcagaatttatagaattagatgtttggcagaggctccctaaagtcatctgcttctactcacttcttcatctctagcttcggtatggagcactggcattaaagtgctcccccatggaacccagctcatggtaaggagagacttcacaatgggtttattcctccctgctctcttccactttgccctgattctgctcatttcaacttctgcctcaaaaaatacagagaacatttcccctgtctcagggatttgtctcatgtccctttgccttatgattagagtgactatgtaatttactatctcaaccgaggcacattttgaaagcaagagctgcaatcttaataattatgcctgccagaaaaacaggcaataaaactgagttgtctgagataaatctgctctatggctaccctatttatgatgtatggttcaaaagtggccacatgctggcatagttttgctctctgaggcttatcttcatgggtatctcggaatctcattgtacacttagtccttttgagaggacagtttacctctctgacctgctcaagccaccagagattaatggaagccacaggagttataaacagtctgaatttcagcctagcttttggccatttttcaaatacttgttctccctttctcccactactagaaagccaacccattacagcttcatagggtaccactcagagagagtatgactgaggtttgaataaacaatacatgtggcttttagggttaaatgaatattgtttgacatacagtacactacacttgtttttatttcagttcaaaaaattggttaaaattatatcttgttgcttctcaaaattaattagaatccatctgaatccattagaatctctgttttttgttttgttttgttttttacaaaaagacttggctgaatgaaaaagcctccatctcattcagataatctttccagtgatcagacaaaaagagcaaagaaacaggttttttagggtattggtgcctactttttttcaaagtatgatatctaaggttgcaaatggacatacctattttcagctatccagacagactgtacccaggtctagagaaccacttatagccttataaaatgtcaacatctaagaagataattccagtttaattatgggttaaattaaatagaataattcaaatgttaaaacgtttagcagctacttaatagacttaatagaacattgaagtttagagaatgcaattttgatgactttgaaagctcagaggcaccagaaatgctaacagttcctagtatttatatatttaatgtatataatttataatgtacatagtatatcttatatataaatatagtgtatatatacatatatgtgtgtatttatatacaggttaaatatcccttgtccaaaatgcttgggactggaagtatttcagatttccgatgtttttggattttggaatatttgcattgtacttaccagttgagcatctctaatccaaaaaccccaaatccaaaaatgctccagtgagaatttcctttgagcatcatcagcactcaaaaacttctggagcattttagactaggaatactaaaacctgtatgatatatataacatacagttttagtatgatatagatgatatatatatatatatcatacagttttagtatgatatagatgatatatatatgtaatacaggtttagtattcccccattacttgtttttgtcaggtttgtcaaagatcagatggtatatatatgtgtctgtgtgtatatatatatgtgtgtgtgtatatatatatatgtgtatatatatgtgtgtatatatatatgtgtgtgtgtatatatatatatatatatatatagtctccattactttttaatgaagtgctgaaatttaggtatgcattcttgtctgcaaatgctcatcaaatacacatcacgacacactcatctgatttgtgttacagggtattagtattcttctcctatgcctgatagtgacttgcctccttgattttccatcttacctctctgctcatttgtaagaggcgctatgtgcttctataatgctttgagattctgactggactataagtatttaatgacactctttaattaaaatccttttaaaaactctagggtataaattaaataaactgaacttttcagaaggccagctaagtaaacattttatgtcaataccaatcattaaatctacattttaaaaggacatttgatgaagagaactagtctatcatttttcttttgcaacttgttttctcccttttgactacttaaattaggcttgaaaccacattatatagcttttacattttgttttgccatttgctggtaaatctttactggtttctattcgtctctctagtcccatattttatttggcccagacccactactgcccactgaaacaagggggacaagtaaatctaagctcatccctgctcaatcactgtccccagctctccagatttgcaacccaagagttgtcagatactgatttcccctttgccttccttccccatcatcaaatcttccttcagggtcttatcagtttcttttcatctgtaggagtctcattcaatccttcttgtgtgttattgcacagatgctcatggcctattacatattactatagcagcttcctgtatggcctcctgcattcgagttactccccaactagtctataccccattgccagaataggcttccacaaatatcagttttatcataggaacccctacagaaaaattggcaacataatcaaatgtgaattcttcagccttttacaaaattttatatttttttgaatttttactgtttactttttacaatttaattattttcttaaaattgtgtgggtacataataggcatatatatttatgaggtacatgatatgttttgatacaggcatgcaatatgaaatgaacacatcatggagaatagggtatcgatcccctcaagcatttatcttttaagttacaaatgatccaattacactctttaagttattttaaaatgtacaagtaagttattattgactatagtcaccctattgtgctatcaaatagtagcacattatttactacccctatttacctcaacaacacaccccactgtcattctccctccctccttcgctctccctctcctccctttctctctacaagttcaattaccagcgtaatttctcttgttttcatatctgaagtttctactcaagccacaccttgcttgctgtctccagtatgtgacttgctgtttacaaagctctggtcctttgccaatgtcactccctttggttgaggtactctctgcccttatcactgtcggtttatgctgtgcagtatctacttctaaaaatgtgacttaatggttctttcaggaagctttctacgattacatctgactgctcactcatcccattcagtgtctcctaagcatgtgtatttcatttgtatttgctttttttgtgtgtttttaggctgtttcctatattgatttcccatcacctccaacctgggtgtaaatatcctgagggcaagagcccagcctgattttctcctctttctgctgtagtatcaggctcttcacccaagaagtgttcaaagcatgttaactgactcttgggcataattttctagttataaacatagttgaaatcatctttgttttacagtagtcagtcagggtttccacagagttcagcttgcagtctacaatctttactcagacatggaataaaacaggcagaaaagagtatatatactattgaccaagcacttaattctgtatgttttactgcagttcaattcaatacatatattgagcacctgatgtgtacgcagcaatatgctaagtgctccagcctggttattcacaaactcctgcatccatcagaatcccctggaaggcttgtcaaaacccaggatcaccagcccccatcctgagtttctgacttagtaggtatgggttgggatctgaaatttggcatttctaacaagtttccaggtaatgctgatactgctagtccaggaagcacattttgagaagcagtggtctaggagatacagaggtggtctaagacataatctctcattccaaggaatttacagactctctagggagacaaggaaggcccagaaaacatttaacagtaataaatattgtacagtgttttagtatttattgattcgacaaatattgaataagtactatgtgcccagcactgccccagatgctggagttacatcagtaaacacaatagacaaaaatccctgctgtcatggggggattctaatatgggaaagcagacaataaacaaaataaataaaatataagaaatataagatagtaataactgctaaggagaaaaagcaaagagcaggcataaatatcagatgggggttggaactatagatagggtggtcagagaaggcctcccagttccatcatttgacaagtatttattgagcgactactatgtatcaggcactgttatagatgatggtgatatagtaacacaggtaatgaacccttttcttatggaatggacatacctatttgggagccaggtaacctagagttttggtgttaattctcacaaactcattattagactctgaatggctacttcccctctcagccatggtttcttcatctgttaaatggagcagttggacaaagttatgcttgacgtcctctatacttctaaaacttcaggatgcttagtcttttaggcaatcagaaatatgtaagagtgtttgaagaagactttgcagaggagagaaaacttaaatggttttcacaggcatgggggagctatggggtgtgggagatggaaggtaatttcagaagaagaataacatgagctacagcacggaagcaacaatgggagtccagtattcagtgaagagcaagtagctcaaagggttcccattgaagagtagctgagatcattgggtaggcagtagggggtgattgtagagagtcttggttgggaacccactgagggttttgatcagggaatgacacgattatacaatcaaagtggtgttttactgttttatgaagattaacctagcaaatagttaaatcctcaaaattcattatttttcatcagataatatttgaattatgaagatttacagtcatactctgttataagtcactgcctgattctaatattgctatcaaactaatttttaggtcgttttcaagcccttaaaagcctatgatactacctaatttcccctaacactactactacatgcttgaactggtaacatgttactctttttgtgtgtgtgtgtgacagggtctggctctgttgcccaggctggaatgcagtagcatcatctcggctcactgcaacctccacctgccaagctcaagcagttcttctacctcagcctcccaagtagctgggactacaggtgcacaccaccatgcccagctagttttcgtattttctgtagagacagggtctccctgtgttgcccaggctggtctcaaactcctgagctcaagtgatctgcctacttcggcctcccagagtgctgggattaaaggcatgacccactgcacccggcgtgttactcttatgaaggcttgagagagtaatcagaatagaaaattcttagtacttacacttttttgtgtttctggttatcttataaaatatatgttgaatattaggtttatcttcagccatatatataatttaaatagtactcatttcaagtgatgcaaacatctctaagacaaggctcttcccattcgcttgcttggtcagaggtaacacaagggcaatattcttggaaatgatcctcttgttttttaatcagttgaggtatatccacagctcttgtgtgtttgttgctctagaggctgaaagtagaatattcttcctataagcagttactttagaagataatgataaggagttctctgtccaaagagtgggtcatgtagacctagagaaaggtgtgtcataagaaattatgacagatcaaatcctcaaaactcattattttaatggtagtttaaacagaagtgaattatgacctgcaaaacacttaactgtcacgaagtaaaatgagcaaaagtgacagtgatggttaaattaggtggaaagtgattattttccttttattttccaaattctgcataatgttgctaggacatctatttagaaagtggcaactttcttcagagttgttttgaaaaatgaggcacacccagagaaatctttcacagccgctttttgaaggacagccacaaaagcaaaaacacttcaagaactttgggatcatagtaccaaaaatgttgctgggtcacaagggtgataactttcccttttatgaatgtatgattttctccttatttctttttaataaacaggagatggagaactgtcatgggaacattctgatggtgatatcttccggcaacctgccaacagagaagcagtaagtgtgaatagctcaaataattcaacactccacagcatcaggccaagctttcctctcctcgtggctactattctagcaaatccaaaaaaaaggcccgatttctaacaccatttttcttcccttttctcaaagtttttaatgtcatcaccaactggaaaccatttaagtacactgtaaaattggtaactggaggcaggaaatgtgcacaaagaaaccatagccccagccctttgtctaggtcagaagttggtactctttcaggatgacttgccaagtctttatgtgttctctaaggaagctaggtcactcctatcctcaacagtgaggaccttctgtagggttgtaggatacaaccatctttttggtgggatttggtaggtacttcagacatgtccacataaactctttcccaagccttaggctctcagtcatacagttggaaaagaggaaaggtagcagtctggattctcctctcttcagcctggtgatgtctcccttctgttctctgcactaatctcagaataagcctcacaagtaggcatctgtctatgtaagtaatagcatcttttgttcttttgtattttgaaggaatttataaaatagcattcctctctaaaaatatatgtctaagaagctttacactacaaatttcttaaaatctgaaaaggagatgttccgattcaaagaatctatcatacaaaatgcacagtggtgaccattgcacataaataggtgttcatcacatccttgtacaaaaaaagtatgcaaggacattcactgcgttgttgttttcataaaaacaaaacaaatggagacaacctaaatgtctactagggacttggtgtgtacatccaattaatgggacactgtgcagttgttaaaagaatacggtacatctaaatgtagtaaagtgaattgagctccaagatatgttaagtaacaaaacaaggtgcagaatgaaattgtacactatcacttctttatgtaaaaattgtatgtgcatgtatataaatgcatataaaccaatctggaaggtcacataccaacatgtcaggtgtgctaatcttaaaggagtagaagtgggcaggaggaaaggtagattttgactttttactttatattttctgtataatttgatgttttcctataagcatcaattagttttgtaataaaatatatttgattttctaaaaccctagaaaaatctcagcaaggattgaatatgaggcaggagtccagggaattacagggcaagcctgaggatattgagcatgtgaggaagatgttgataggggatgcagtagaatgactcatacaaacatcacagtgctgctgaggctgggcttcctggtcatcacatgggccacttctaacttgcatgctcccagcttgccaacacccaacccaaagcttcagcagtgagatggaaccatttctatttgtcttactctctatcagtattattttctgaacactgctgtttctgaatagttgcagaagaattggggaaaggggtttggagaacagtactctggacatctcaaaaaatcagcatcctgcaagagagggtaggcttccctgtttgctggttaatataaaccctgaggaaagattttctccacccaactctatctgctttatagtaagtgagattccttccagagcctgacaggagatgatgtcagtctcagttttctgtgttgtctgttcctctttttctcagcccctattttttattgtggtaggtagttgagagtggctgaattagtggctgtcaaccagatgtcattctaaaccaaatttagagtttagtcaccttaagctatgtgacttattccctgagaggcccccacactaagcactatggccaccttagcagtcttgctggtaatgccatgaattagcctttcttcttgacttcattttacactgccctcaattccagcccttatctttcagcttcattgacaggcctagtgataggcctggacttaatccagtacttcctgtagcaaaaaaggtcgggtacagaatgtgggcccttgaaatagttattgattttcaaaggagttcaagacctatctttagaaacaaacatttgtgcctggtagaccaaaatggccatatggtttcactttattataaataaatatttccctttgttctaaaagggatagatattgtgggatatgatttgaataataaatagcatctgtagtaatggaaaaatatatacctggcacatagtagtcacccaataaataaacattgaatgaatgggtgtgggaggtggcgtaaaatgtgtgtgatggtggagtggggagggggttcctcattaattttaatgcacaggaatttgtctcaaatcagagataaactcttcaaatttgttgtttgctcttgaccagcctaaaatgagaaaataggagaatcccttctgaatatcctttgcaggcccaacttcctcagggcaagaagaaaaggcagccctaacaacagatttcttatccaggagactgtccttttcgtaaactgttcctatttaccgggaaccagcaaaacctctgttcaacagaaatacagctgactggtttcttttgccaggtggtctgaaaaccatcggcttagcaagttttatgaagtgcacaggaagaggaaccagtggttcaaatatgactcctttgtaaaaacctgaaacagtttttgtttgatttctaagttgtaatttctcatgaattggtcctcgtgccattggtggggagtgtgtctgcgtgtgtgtgtgtgtgtgtgtgtgtgtgtgtgtgtgtgtgtgtgtgtgtgtgtgtgtgtgtgtgtggagtggtgtggtatgtggggaggaagaagtaggtgcagactagaaagccaaaacatgaaagcatgcataattttgttttggacaacagccaagccctgatttttgccccctgtagattacgttgaaatttaccattaaaaaaagtgaaagcgtttgggatagaaacgacatgaaacagataaaaatccatgtctcatttgtactgtcagaacaatggtttgggaaggaaattggcctaagtgtcttccagccagagatagtcctaggttggtagtgattaagatacaatgttttaatggctgtatggattagaatatattctgaagccgctttttaaattaaactttttttattttgagataactatagattcacttgcagttgtagcagaaaatacagagagatcccatattccctttgcccagtttccccaaatggtaacatcttgaaaatctatagtacagtatcacaaacatgagggccctttctggaccctgatgttttcttgtctacaccaataaaactcttatattttagactttagaacatgaaattcttgggggtcctctacaatagtggggatttttcaacactggaaaagaactgttttagagccacctctaaagcctgaaatatttttcagtctttcaagtaagtaaatcaaaaaataccaaaatactgagcaaaataaaagatcatagctatatggtcatttctaactggttttgacccgctctctcaagcaggctagttgcagctaatttttaagataagctccaatttcacttacaacttcagggcgttaataacctttttctcctttgctctgagttacaaggtcagaatggcccctcataagtctctttcatttgtttaggggaggaactctaaaagaaccattacccttaaatcaaaatcacacaccaccaccacccactccagcccccaaacagaaaatcctttatgtcagtgattcccaaccttggcttcaaaccagagtctcttggggagtatataaaatcctaatgcccaggccttcccccaaaccacttacataaggatacctcagagcgggacccaggtatgagtattttttacagctcaccgggtgattttagtgtatagccaaagtggagtatgtggtatatgtggttgtgaacattgtagctgaatgaacttttgtatctgaaagaacttctctttgcaccagcttttagtcaaatggttatagaccactgagtttgattggacattctttcttccactttctccttcttctccttctcttcctccttctattcatcttccccctactcctacactcctaccatctccaaaaactcaatcttcattatcaccatgagtaaactgcctctcctccttggcctcagtttctctgtctgtaaaacaaaagacttcaacaagattaggttctgggggactgactggtctacaatagggcctgtgatcaaaattcttgaggattttgttttttcatcatgatcattttcctaccattattatatgtcccaggtctgagacgttggtgctaaagaatggcttttcattttgtgttcaccatcatgagtcagagaacttctcgtacttgcagcttatcctgggtcaacaaccttccctctctaattctatcccagtccaactgcttctttttaggatcagtgggacaccaaccagccaaactgtcctctatgtgttcctttggcaaaactttgccaaacttcaaaaaggacagagcaacctataatggcctttgtggaatgtgagtgattatggcagaaaaggacatatgagccattgtgggaatgagaaatatttgaactgagaatcctatccatgtgcatgaaaacaaactgatgcaaatttttatttgtgtgaattttgatagcaatgcaccaacataggctcttcttagatagaataacattgtctttcaaaaggctaaaaaaggtcctcttacttcagctcctgtttactctccctttcccctaccagtggccccttcctgccaagagggcaataatacttcccaaagtgaaatttgcaacatgcctgtctgtggcccataactttaaacagtgttttatgggatatggtcaggggaccccataactatcttcccaaggttcctcactatttctgtcactgaatataaagaccttccttttcaattgcctgtgaaagagttttttaatgggttccccctccttcacccctaacaattgcctataaaatacaattaatcttacttggctttaagccttaaggttccattcttcattcatttcatcttcttgtacccccagcctactttagctcctgggagaggggtgggtagcacaatagtctggtcatcacgtgtgttgaacccttgctgaaagattacttgtatgacaagactctaagcttttcttaggtaccagagttttgttcactcaacaagtatttgatgaacaccttctagatgcctgacactaaaatctaggcactggagatatagcagtgaacaaaaagtccttgatttcgtagagcttacatgccaatactgtcatgtactatcaattcttctacctataaaatacctagggtatttgtactgcattgtatgatcttatgccattacctgtctttagagtctaagtacatcttatcaagactatactcgaatctcatcttttcctcctatccagttcaccctatgcatgatcaggattcaatgctttgaaacagttctgattacattatttctctaactttaaaaaaaaaaatccctcaaagccttctatgccctcacctctattgcttaccaaataaagtcttcaccccttagcctgtcatttaaagtcttccatgatctggcttcaacccacttttggaatgttattctgcaactgttcccttttatggactcgatgttctcttcttcaccttctcaacttgtaaacctctgcctggactattccacttaacttctgcctgtaaaaaagtctacccatccttcgtggcccaggtcacaagccctccccaactagaagctctctctttctccttctgatttgcacaggactgcttacttcttctgcagcctctattcacattctgccttgcgtgcagactactgtcttaactcttaaactgaaatgtgagagtcttggcagcaggaaggacgctttagcctttttggctcttttctccctgagaagtttgcctgtaaatctagtcctatcttttagaagaagagagataaaccttggcaagttgtcattaaaaaaaaattttaatgaaaaaaatgtcagctgcttgtacatgaccacatccctatttctattggtgtaggtaagcatgcagctgaaatcagagctcaccactataaatcaaaattattgaatgacttctagtatataacttaatctctgtgatctcattggtggcttttggactaaatttgttcttgttattttacagagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaaggtaaggggcatccttcttttgtatacttccacaacaaggcttcagcagccctggtctttgcagggctggagctgggaaaggaccctttctcccaggaatagcccatattcacttgtggctcacttagcatcaagtctgtgggtatagtcaggtgactccaggagactctttggacttccttaaatgcagccaaaagagcatagtccggtcccttttgtaaacagcctcttgtattttctcaattatccctggggattgtaggtcatttgggaaaatttcttgggtctttaacagaatgagtgattgtctgtgttttagtaggggacccaacattcaaaggtactcagtgccaaacatcactgaagctcttatctataccttagaaatagcaattctcacacctcaatgcaccccagattaccctggggctctcgttaaagatacatattcctagccccacactcagattctggttaaatgtgtagcatatgagactatccttagaaacgagtaatccaggtgcagtggctcatgcctcacagcactttgggaggtcgaggcaggaggatcactcgaggccaggggttcaaaccaggctgggcaacataataagactctacaaaaaaaaatttaatgaaaaaatattagccaagtatggtagtgagtgcctgtagtcctagctacttgggaggctaagacaggaggatcacttgagcccaggagttcagggttacagtgagctatgattgtgccattacactccatcctgggggacaaagtaagaccctatctctaaattaaaaattttaaaaaggaaaaagagtaatccagtgagaaatcccaaaaccacctggctgagcaccaggaagactgatcaggttaagactgacatgctgtccacttagttgatcaactggctacagcaggcacccatagacttccatagcttccaatgtcttcttacacagcattttctggcctccacccgccccctgcccccacccccacacacaccagtagcaggagtcagggaggagaaactcaatcaaacaattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaaaaattaaattgcttttgaaatttgcaggcttaaaaaaacattcgaaataaaaccattaatggaaaatggtgatgtagtagaagaattggaaatacttactatcgatctgtgtttgatttgtattttattatttttaagttccaaggatttctgataaaagcttatgaaatcaggaagaaaggtaaagatagcttgattttcaattctaaattgcctccaatagattccatttgctgtgaaagtatttcaaagccttttaaaagtgtagggaaatggattttgaaaatcctaaatcccataatttccacaaggtctctttaatttcagggcagaggctcatcccttgattttctccatgtcctacaaaaaccccagctggtttacatttattcatttgcccccactgatttggatgcaacagttctgttctgacctttctaatatagctcactgaggaatcacttgtccccacccccaactcccaagctggatgattcaaaatcatctcgataatttttggggtaaggagagggctatgtttccctgtccagaattaacttcaccccattccactgcagagtctcatccagtctagactattcctttagtccaaatgttcaggggagatggagcctagctatataacactgggaatcctgcctgccctgctcatcatggatcgttcttttccttacatctcttgctaataatgtggtcctctgatatatctacttggctccttgttagcatcaaataagagaaatgataggaatccaccattttgaacttgaatccagcctaaattttcttgaagcatactgtgtgtccacttgatcacattgtctagaagggaacgttactgtttggggagaaaaaaaaaaaaagaggtaagggcaggagagtgaacagcacatctggcctgtcttgtgtgatcctgtccacagccctgacctcacagttgaggtgtcagctctccattttgtctcattgtaacattgtgagccactccagtttaggttattggaaatctttacgtgggttgaccagttagagtgtccagtattctagcagctcttgcaaaggacaggaaaaggcagctaacattattcttatttcttaatgtgactcagtggacttgatgagaaagaactagcccagtgattcatccttctgaggccattgtcttgcagccaaatcagccaattcctagaaatgcatcaagtgggactatttctccccaacagcccagcctgaagtgatacaacccaccctagagatgttgttgattgggatgccaacaggtttccctgggtgtgatgaggtgatgggaataataagaaacacacccagtcctagtcatgacttgaaatctccacaatgtctcagcactctcaaaaagggagataactcatcctcggacttccccatctgcagccttgtgcagttatcttggagcctagctccatgccttatagtaggagccagatatatttggtgttgatttgcatagaaagatactcctgtggccccttccctttataggcccctcagcctgcatcctagatgcttgctccttttttgggtgggtctggggagggaacagggtctcactctgtcacccaggctggggtgtaatggcgccatcacggcttactgcagcctcgacttcccgggcccaagtgatcctcccacctcagcctcccaagtagctaggactacaggcatgcactaccacacctggcgactttcgtattattatttttgtagagactggggtctccctttgtttgccagctggtcttgaactcttgggctcaaaggatcttcctgcctcggcctcccaaagtgttgggattacaggcaggagccaccacacccagccagatgcttgctcttttaaggtccttcagaagacatggggccaatgacttaacttcccacttaacaaatgtcagactgccaaaggatatctgtgaagcaagcagtgatcagctgtagccaaatatctatagccagtatgaggtgggagactgaggaaattgcctgaaattagaggcataaaaggctatcccttcacaagttacccaggagggcttggtcctttccctctcaatcttgacttatcactttccttcctacaccaaacagtgccgaacaccattaagctccatacttatatatgttggtggatcagacagactcatagcatttgacattctgaatggatttgcttcaggatccggaagaaactgtccctttgggaagagcagtaatttttgcatctagcctccatggaaagcaaatctcccaaggaaattttcatgcctggaagcacatccacttgaggcatacaaattttctatagaactgaaaatattaacattacattctactagagatagaactctgctttcatgcattcatttattctcatatatatatatgagaatatatatatatgtggctgggcgcagtggctcgcgcctgtaatccaagcactttgggaggccgaggcaggcggatcacgaggtcaggagatcgagaccatcctggctaacacagtgaaaccccgtctctactaaaaatccaaaaaaaagttagccgggcgtggtggcgggcacctgtagtcccagctactctggaggctgaggcaggagaatggcgtgaacttgggaggcggagcttgcagtgagccgagatagcgccactgcactccagtctgggcgacagagcgagactccatctcaaaaaaaaaatatatatatatatagatatatatagatatacagatatatagatatatatagatatatagatatatatagatatatagatatatatagatatatagatatatatagatatatagatatatatagatatatagatatatatagatatatagatatatatagatatatagatatatagatatatatagatatatagatatatatagatatatagatatatatagatatatagatatatagatatatatagatatatagatgtatagatatatatagatatatagatatatatagatatatagatatatagatatatatagatatatagatatatatagatatatatatagatatatagatatatagatatatagatatatagatatatagatatatagatgatatatagatatatatagatatatagatatatagatatatagatatatagatatatatagatatatagatatatagatatatagatatatatagatatatagatatatagagatatagagatatatagatagatatatagagatatagatatatagatatatagagatatagatatatagatatatagatatatatagatatatagatatatatagatatatagatatatagatatatatagatatatagatatatataggctgggtgcggtggctcatgcctgtaatctcagcactttaggaggctgaggcaagtggatctcttgagtcttagagtttcagaccagcctgggcaacatagggagaccccatctctacaaaaattaaaaaaaaaaaaaaaagcacggcatggtggtgcatgttagtcccagctactcgggtggctgatgtagaaggattgcctgagcccgggaagtcaaggctacagtgagccacaatcacaccactgcaacctgggtgacagagcaagatccggtcttaaaatatatatatatatatatatatatatatatatatatatatacatatatatatttatggactgcctactatgtctgaggccatttataagcatccagaagctgctgctgaagaatctggagaagctcctgagagtagaatatggcccaagctgttttttggtcacagatactactcggtaaacatagccccatggctatgacaagaacaaaggatgcttgatatgttaagtagttcagggcttgggttctgaatatagggttccattttagctccttagcttttaattgctaattctgcattctctttcagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaaggtgcgttggttggaggccctgcttttggttgactgagattctcacctagtctttctaaactttctttaggcatcagaaacataacctttcatataattgtaatgataatatttctaataataatgaatttcattctctcttctcttgaaagactgaaaaggcagttgcttggaagaaatttactacccagaaatatgcttgtgtctaccacacctctcatgtatccctgagtgttgaacttacctatgcttttctaaatagtagagaatttaggctatcatgatgataaggaagaatagtagcagctttcatttatatcactattaaacccatcaaagtacaatcacatccattgcccttttaagacaggacgagaggcaggtgagttatagtggaaggagaccaggttctgatccaagcctaagatgttgagtgatcttggaaatgtgccatatccattctgagcctcatcagccttatctgtacaattgaaagtttagaaaaattatctctaagctcccttctaacactataatcctataattatattattatttattttttaaagataagaaaattgaagtacaaaaatcaaaggacttgcccagattcattcaactaatcaatcataaaaccaaggcctataacccaagtcacttccagcccatcgttttttctatgccagtagaaaatattgactgataaaaaagacaagttaattatttaaatggtagtttttaaaacatgagctaaataaaaatatagtccctaatattggggttgacagaatataggatgggtaatcaagcattctatctctgtcttgccacaggtttcctgtgtgatctataacaagtcacttcacccctctgagcttcagtttccttctttgcagaatgagagggttagagtagattttttggggggcccttacagctccaacattcgaagagtcgatgatttagtcaatcccaggcacatgaatttatcatttcttatgcttctgcaaagcatttttataaacacagatgaaaattcaaacattttaaaaagtaggtagagagctaaattatatacttcttcaacttagtccctcatgactagtaggcaaacatgccctgaatcaatgtgtatttattgagcattttcctgcaggccagtggtactcaaacttgtctgaacattagaaccccttggcgagcttctacatatacctgtgtcccatccccagagactataatttaattgatttgaggtgtggcctgggctgtggcatttttaaaagatccccaggtgaacattgtgtgcagaaaagtttgagaactactgctgtaggcccagggtcatttatggtcttgctactcaaagtgtggtttatggactggcaacagctaggagctggttaaaaatgttgactctcaggcccccactcaagacctactgcatcataatctgcattttaacaagaacctcaggtgattctaatgcacattacagcttgagaagcactgatttatgacacaaaatcttcctcaatgtaacaacccccatcttccagagtacacagggggcagcgtgtggacaggaaggacaggagctatttgataaggtgtagagaactggggcattgaaatttatgagaaaatgtatttattacgaatacagagagaacacattctttttatttttttttttattttttgtttttttgagacagagtctagctctgtcgcccaggctggagtgcagtggcatgatctcggctcactgcaaccttgcaacctccacctcccggttcaagttattctcccgcctcagcctcccgagtagctgggactataggcacgcaccaccacacccagctattcaaactcctgagctcaagtgacccactcgcctcagcctcccaaagtgctgggattacaagcgtgagccactgtatccggccaatggagagagcacattctaaggatgatatggacatccgggccacccagcaacaatgacctattatgacttccaagtctgtggtctcactggatcctcaaaccttttagtatcacatagtggtagtttcatgaacacaattttctcttctgtcaggggtctaacacttaatagtttaaaaagtaatgcaacaagataatttcagacaaaaactaatatttacacaaattacccatgataacataaaccctctcattgtataatattccaatttgaatctcaggccttcagaccaagtcttatttcattgtgtgcttaaaattttattgatgcagatgattcaattaaaaaattaaataatcaaaaagctgtgagaacaagacaaacaacagtcattgcttttaaaacaattgtcctctcaggttggtaatgtttattaaaacatttggtggccgggtgcagtgactcacacctgtaataccagcattttgggtggccaaggcaggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctcaaaaaaaaaaaaaaaaaaaaaattggctaaaaaattccacttctaggaatcctaagaaagtaaccacagacatgcacaaagatatacaaataagaatttttgctgcaatgctgtttacaatactgaaaaattggaaataatctgaaagttcacgaatatgggaatgattaaacaaattatggtgtatctgtaccgtggaatattaatatagccattaaaactcattatagaccaagattgaatggcagagaaagatgtttgcaatgtatttgttaagtaaaaatagcaagctaaagaacaatatgtatattatgatccaactttttgtgttaaaaaagaaagcgttgaccaggtgcggtggcccatgcttgtaatcccagcactttgggagtccgaggcggacagattgcttgagcccaggagttcaagaccagcctggacaacatggcaaaaccatgtctctaccaaaaatacaaaaattagccaggtgtggtggcatgtgcccatagtcccaactactcctacttgggaggctgaggtgggaggatgggttgagcccgggaggtggaggttgcagtgagccaagatcgcgccattgcactctggcctgggcaacagccagaccctgtctcaaaaaaagaaagaaagaaagtgtttatatatgctaagacaaaaaaaagaaacaaaaagactggaggagcatacggcaaaatgttaacagtgaccattttcttgtgactgaattatgggtaactcttattttcttatttatttatttgtattttccaaattttctatagtaaatatgtgttacttttgtatttagaaaacataataaaatttatcatgtaaaaaactgccctccagtatcccagttggcagtatattgaagtctgaatgattaaaccgatttttctggaagagctgcttttcccactttcccactctgctcaagtttgtggagatagacgattgattgagcaacatggaagaagagaatttctgtctcattctgtgtatctgcctctcagtgagccagacatgggtgtctgcatgttgaatcactccttagtcacattgcctgagagtcaatagccacatagccaagggcacctgctccaggtactctgcaactgcagagcatcaggaggcatgcacttgctcatgcattcaatctggaaatttgttttaagtacctactgtgtgcaagacacggttacatgcactgaggacagagatgtgaacaagacaaaggctacttgccagcatgctctttacattctagcagaaaagaaagacagtgaacccaaatcaataaggtaattttagattgtgatgagtgctgtgaagaaaaaccaaacaggatcaagagagagtgaatggggcaggaagcacttttaaaggagtagtcagggaaggcttctctaaagatatttgaatagagtcctgaatgacgtgaaggggtgagaaatgggatgatcatgacattactggcctcttaaaaaatgacacatgacacagaagaaaaggaacaaggcagtgaggagagaagtagatggaaggaagaaagaatggtaaattcagttatgttgaaaagggaaaagagataaataaaattcactgataatccagccaaaagtttcattgtaacaagtgattgcagcctcctacaataacaaactaggaccaatattaaagatgtgagtttcatctctctcttccctttgctctggtagaggctgaccttgctttgcatatcaatggccacctacagggttgggtaagatgtccacttcctgaagattccccaactcacttctcacactgtcgtgccaaactcctattaacctcagtagggaaggcaccagatttaagaggccgaagaaaagatccagagccagcaaacaagacatggggttttattaggggctgacatacaggggagagagtccagtggaggtgggctggacaggagaaccaccttacatatagaaacagtccagtggcagcaggttgggcaggaaaactgcaaccacttgcaaacatcatgcagtttatatagcattttcactgaacactctccccttaacgacctggcaaccttcatctaacccaaaactcaaggcctctatcccctgtgcagccccagggatgagcctggggttcagatggtcctcacagacaaggaaataatctcccagttggccacgcctggattcccaagctcagaacacacattcagatacgtctgccatacagggtcattctaagggtacacttaagttattgctatcatgagcatttactgtacatacaaccacaataccatcccaataccttgaatttccataattacatactccttttaggttatggcattaaaagtccctattaagacttaaaagttgtcccagctggaataatacttctccttcattaccacttctgcaaggaattctggaaggctcaggatgggaacattctcttgggctgtggaaatggccagaaatgacatcaagcacattgtcttccccaaaagaaaatgagagtaggtgaactatagtgatcagaaagcaccttgaagtgcagagtgtgaaaaacggcggatgttgctaagtaggtagttctaaagacaaactttgcttttcttagcattttcaagtaccagccagagttaagtcaataatgagttttgttgtttgtagatcccttcggtcaagtaaattaagctcttgtagggaaggaggtagtggtgcaagatgactcttcaggctactggaagaacttttagcatattacaggtactgccagtgccatcatggatttcatgtcagctatagctgtagccaatattaagctggtgagcaaagtttgagaaatgaatttggctgtcattctaaaggtgataattgaatacacagaagtctctgtacactcagtgacctcttccctctctccaacccatttaaaaagtgctagcacgtggcccttaattacctatcaccaaaaagactggcccaccaagtaaataaatagctaaaaagaaggacaaaaggaggaaaacaaaaagcttgattccacaataatccacaaattgagtaattcagtctggaatcaagagaagactatggttttgtccttacaatgccaaatggtggtgggggtgggaaagctaatcaggttaccaagagacatacaatagcaatttgattacaacttctagtccaaatgtgtctgattggctaacagtgagtctccctaattagagtcacagatccaaagcactcaacactcagtggtttcatcctcaacaattcagatattcttacagatggcttctgttgttctgatttgagtgtatgctttaagtacgcagttcaagagagtactgattacaaggccagcaagcaaacttaactcactgataaccaacaagaagaaactttttaaaacaggggactgaggaaagaggagggagggtggagtgaaatgtagagcttgtgcctttatgcctgcgagctgaaattcaacagtttagtttacacattaaatgatccatcgctgagggacttgaccaattttttgtgtctcccaaccattcatttggcatagcatacatatggctaatctgacatctagattttggcactggtgctgatccggtattattgttccccttacaaacaaatcaaagagcattcagaaatgtcaagccaatttggatggatcctttgggcaagtatatgcacataaatgagtgtcatgaatgttttctaagtataccaaaatgatgtcaggggatgttaaccaaggccctttttcagcccattccctgggcctctcctggcaacactgagctggacagagcatgatcctgaccctgtatggaaattcctatgttctcttaagtgcctaggagatttgtacctggctacatttttcctcatgaaagtccacttctcagtgacagtagtaggggtctagtgttccgaagaactatggattctgtcaacacatggacttcaatcaaagttacgtgctcctttgtgatttgtggcttaatctgtggcttgttgcagtggcagcctaagctgggctaatgaagtatgggtggaatttctgtctctcgaagaatgttcttgttaattgtccacttttgataagtgtgagatgttatgaacaatgagatacataaatgcagaagttcacttctagctttagaaaaccatgacaaaattctacttgcttcctgattccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggtgagcaagacaacattaatttctcatctttgtaagggggcacagaaaaggatgagaggactcactttaattttgcttcaacctgttccctcatttggattaaaagttctttttgattgcttagaaactgacatatctaacactattgtcattatggcctttcaaatttaacgatggcctgtgctaaagatcaagtactgacccttgggtttccaaagctgcctatttcacaccaccaaaagctggagaagcggttctcaaccctggctgcccatcagaatcatcagggagagttttggtttcctttaaataccaaatatctgggccctacccccagagattctgattagttggtctggagtggggcatgggcatcagtgtttgttcataatgcttctcaggtgattgtaatatgtagccaggattacaaactgtcaaactgtagtctgtcattctttccagaataaagctcaacaaccatgaaaacccattcattcagggcaaagctaagtccctaatatcacgatgtgtcttctggggtaaaacaaatttaaaacatcatccctgccctcaagaaggttatagtcttactggagaaaccccagtcacaatgttcaattccttttctgattactcacagtgactaccacagcaagccacattctgttcattgtgatcctacagctcttctaactttttgtaggctcaagactagtgcttatttagtgtggtcaaggttcctcacaatccaagtggataagtgagatttcagctggaaaatatacacatctttttgctattggctctcacataaggctcaagagtactcgaacttctgtatgcatcaccattacacagggagctggttttaaatgcagatacctggccccatcccagagataggaattcagtagaccttgggtagagtccaaacatttgagtgtttaacaaatagccagatgattctaatgcaggtggcacttggaccatgctttgaaaaagactgctcagtatttatgaggctttttttctctccctttagacaacagcctttatctaaagaatgcatttctccctaaaaaaaagatgcttgaacatgtatatattcactcatgcttatttttggtctatgccttggagtgttgatttgccatctttaactccctagctcatccataacaggacacctaggactaggcactggtttgttgcgtttccccagcagtgggcccactattcgtcatcccacatctttcgcctctcagaggtgtgcagatgaatttcaacttgctaatgtagcgtctaaatatcctcttgttcacagttctgggttatcaaggtctatgcttggtggacacagaaaaagaggcttaatctacttcgcccatttaagtgggctggtaatatgttgctccttcagtataaggcagttgtcagttgtctacctgttattgtgataaaagctattcaggcaaggttgagactgtggagagcactctattttaactctccccatttatgaataaggaaggctaaaggatctgtgaatatttcccaaaggaaaatatgcttttcagtgagttcaagaacaagggtggcttctccatttacaaaaccaacctgcctgcaatcccactgcaggctctcagtgcttagccaggagggcagcccagcggtttggcatggacacagtctatccaggttgggggcaagtgcagaatttctaatactgcctatggctgcagaagctccagtaagcacttatgctagattccatgtggctttccctaggagagagtcccatggtcagcagcactatctcccttatctccatccactggagaagccgaggggaagccagtaagccaaggaaacaaatggagtcaattataacccttgagccatccaagttcctggttaagcacattacacagcccaactcgatactcttaagccctagtaatgaaatgatatgctgagcctgagcagaaaaaaaggagttgatggttccagattgagtgcctgaccatttgctccactttttgcttggccctaggcattctccagcacttccatattgagaagatctccaagaggatgtttgaggagcttcctcacttcaagctggtgaccagaacaaccctgagtaagtagtacttctcttgactgctccctgaaaaacacattcagttttcaatttagcatagccacagctaaagtccctccgcaatctcagtgaacattagcactgctcagtatcaacactaaaggatgttccatctctcttctgggtgacttagcagtgaatggggtgtctgaatgtaatctgaagagcttggacatggtgaatacaaacccagatgtagtctgagcataggatacctcaggtcaaggcttcctgaatgtctttaatgaaactgctaagcacagagtctcaagagggttggagaaagctcataagattccaggtctggtatatttatggagacttcacatctggaagggtgtatcctctggtggtgggtatgagaggcaaagagaaattaaaggcatatcaattcctgtgttatatgaaagcacttttactcctggggaactgcccctgggtggtcatgtttccttaaaagcattcaggcactcaaaaacacttgcagctctcccactttccacactagatggagcctagggactaagatacttctaggcattggggcgggtgttgagcacttctaatgggataaaaggcacacagtttctatccacagggaattataatggatgagacagaacatgaaaatgacttcagtatgaattagtatagttctgaggagttaaatatcaaagtgctcaggggaatctgcaaagaacaatgagatgagagccaggtgggcttagtcggggaaggcttcggggaggaggtgtgttttgaaagagaagggtatgactgggcaatgggtcaggaaatcagtccaggaaaagagtgcagcctaagagaagactcagacaggagcaaacaggaaatgtgggtaggggagaggaatgatcacaaaggccacagaaggtgcactaaaagattagaagatttggaggtagaaagtagtcatagggcctgaaaaaaagccagtaaaatgttcaaatgtaaggcaagtagcatctgtagttgctgcaaatagcatagagatatcaacatggtgctttggaaagatgtctttcggctatcagatgcatatattacattaagcacacactttgacgaagccagattatgaagtgcccaatttatcatgctaggacattggacttgatctccaggccagagaatgccagtggaggtttttaagcaagtgaatggtgcattcagatctgctttatttatttttttatttttttagaaagaggtcctcgctgtgtggagtgaaaggtggacccttattaagagaagtgggatagtctgaattaggaactaattatactatattaaatcaatgagacgggaggagacgtcactgtgagaaacatttctgaggttaaatcaacaagatcagcatcaaagagagaaacgagtttggaatgggtccgatattaataactcgactgggtgaatagtaataccattcaccaacagggaaactgtgaagaataagcaggtattggtgaaaaagagtttcacttggaacatgtttaaattaatatgcttaagagccatctgagcagagttagggtccaataggcagctagaaaaagagccaaggcagtcagttgcttgtctttggcaggactcatagaaaataacaggacagtatgagaattcaaatggaaaagttgggagtccttacatgtgagtaagaaaggaggcagagtgtaagatcctaggatcaattatgggacttctgaagttacatgttttagttcatactgtgaacaaggctttgttctaggttccaggggacttaaaagatgatttagatatactctgtgcccatggcaggatttggggtatataatggagtagaaggtatgtgcctcaaactgtgtgtagctgaaagaagttggtatgatcctacagggtcacctaggagcaaagaagaacaaacccaactcttttatataatgtgcctagcagagcccagcacattatagggcttcagtaatagctggttccttgcccaaatcctcttcttgtttttttgtttttccttctatcttcccattgagtcatagagaatggggaaaagggagaaatccaagggagaaaggagcagagaaatcaggcccatagggaaggtgggtcattattctcttgtggctaaggaaaagaaaaagaggttcaagacaggtttgggcttaagaggagttggcttaacttggactaggagttctccaggttgcagtaccatgagcacaggaataaaaagaagacaaaacacagtatccagggtgggcagagacaacaggggatggaagggctacagccaagtttactctgcgtggaaagggattccatggggtatatgagaatggatgaggaaccatgggaagggatttagggtgctaagggggtataaggacagcatgtggacgtaggagaaagcaacgtcgagaagtttttaacaaaagatagcaggaatagaggaaagagtgatatataatcaaatagtaatcaagtaacccaaaccaatatttggggaccctaagggtaagcaaagccccagtaatacagtaggtgccgttttccaaagtgcctttttgacctggtgccaagtaagctgcctaaatagctaacaagcagatattgaagcattttgtaaatgctaaatatactgtaaaaattccaagaataacacttaggttttgctcttgaggaggggcagttctatattattcttgggattcttacaaatgctatgtgttgaaatgaaaacttcatttcccattttccatatctgctactagaaaagtgttttggggccattttttgaaaccaagtgatatttgtattccaaattccctggtaggtccatgagtaagtgggtaagcatggggtatattggttctattcctaatttgctctgctttcctcttacacactcccggccactttgcgtttgtttgccttttaggccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaatttt

SEQ ID NO: 3633 - DNA, 121909 bp, human
gacggagaaggccagtgcccaggttagtgagcagtgcccggcgcccgcttccctcacctccttttccagcctttgcacaggtgggttgccttctcttggccggagccgtccctggaagtttccccagggtgccccaaattcccctgccaccccaacctgttctgtgctccagcagttagcaacctggatggaggtggggcccaaggcttctgaccaaagcaagttgggggtctctgaattcgaactcacagctcgtccctccccactcggcctgcatttctttatgctctggcgctttgagaggtcacttaggtactccaccctgagctacccaagggactctgcagtccccttaatcactgcctgtattcctgagcctgttttctcattttgctgatgaatacatggtaaagttaatgtagcagggtagatgggcgaaaggctccctatcctatcctctggccatctgcctcattttttgtccctgactacgggggtcagaatttgagacactaggctctggaagcaacgtggtatattgccagaacatagggcccggaaagcctgctttccagtccctcccagccctgccactaaagttatttgagttctctgggtccccccagtgcccattttgaaggtggagttgtgtggaatgaaatgaaatgatagaaaggtgttttgcaagccaaatgcgaggcattgtttgtcagtcataagcagcaatgaaagcatttcctccaacaagagataccctgggttaaaactgccattttcagtggcaacacaccaccagttaactgaacttttcttgctgggtggtagagtggggagaggatttcagctgatggacaagggcctgggactccagtgtctttcttattgtttgtcggaaagaaaattgctaccctaggggctgtcccacagatgatagtcaatgtgagattacaaggtcagtcaagcctctcaggaggattaaagagacactgtggggcgtgaagaactggctgacatgtgttcatcccttagccttcctgtggggatgtctctttgcttctgttctacccaggagacctgttctgaaagtgggctcctgacacttgatggcccagattgccttgcagtcacagctgggcaaggagcagttggtccctttgcttaacgcagatgaacaatgtgaatgcttgtttcatggaagcaccttaataaatacctttcttttggtacttgatacatttctctttctcttgtaaaacacaggaactctcccatcccacctccactacctgtgttagttgcagggttttgtttttttgttgttgttgttgctttcttgttgggtcctggatcccctgaagcatgtcaatggctacatgtctaagtaacctgtaaaagagccagtgcaagttcaatggcacaacagcctgtgtgaagcagacagagagttaatgcagaaataactccagttaactgggtcaaagtataatttgaaaaattaaggacagtttggctctttgcaagaataagagtcggctaagttcgctgagcaatgcttgctagtgtttactgctgcagtcccaacacatgttttgaaccacccccttccctaaaagaaaaagctgaagagataaagagaaattgaacagtgaggagatctggggagggaactcttcttggttcatatttctgcacagaatacaaaggcaggacttcaggatcttgtaaatcaaaagtgaatatttataaagcgattcattttctgatgttctccatcacagcctgggaggccacacagatgacaggaacgccaaaggagattaattgctctctagttaccaacttttttatttgctcataatattagttgggacctaagaaaggcaaaaaaatctatgagctgttttcttgccaacttgagttatgaagcaatgctacagttcaccgaatcgcccaaccattatacaagaaaagcagccctgttgattctcgcatggggagaccctaaaaccatggtttcagaaacacccgttgaaatccatatatgaatgtgataaattggatttcagtggttaaaaatctttctcttttggaggcttggggaataaacttattagaataggctcaggaagaacctcactgaggtgggtagctgtgttaaattgttaatgaaaatgatttgtttcgaataaacgtggtagccctcaagggacagtaacattctgagtgattgtaagtgggccacaaactcacagaggggaccaagacatcagaactcaggtctttagatgggtaggaacatgtcctgagagaatttggttctttaaggagcagggaggaggtaaagaaggaaggcagacggtgctgcaaatcttgtttgatagcacagattactctatcatcagttcttccttggttatgcattcataattgaaacagtggattttgaatgacccaggcaacttcatagcatttaagtaggagctgtagcatctacttcagagcccaaagatattcaactctccaaaatgatcgttttgcattccttcaagttctttatgtgcaatatttaggttggactttctggaaagatcaatgagttcatttcccattcagattgaatctggtgtttttagaacatttcaatattttcagatcacccattggaggaattttgcaaactctaacatctgtggaaatgatccgtgactagatgtgagctacagcaaactttctgtgttccaaggttcaaaaggtttaagatttctaccccttatactgggaatgccaatctcatgttttgaagaactgtagttgttttaatggtcttttgcatggtggtgcaaggtgaacaaattatctatttaatttgcccaatttcccctaaaaatggcccatttaaaatttccattttacaatggacttcttgggggaggaatatgttggaaccattttaagcagtaaaacttttcaggtgtttaattgcatccatttgctaattacatctatcttttgcaatattagttgccaaaccaaagatccttgtagatctcatagaggacacaggagaaactgatcaatttgtacttcattccaaaaggattaaaagtagtcttgaagctaagattagttaactttcatttcagaaattgcttggtctcatgcttgttacttttaccttgtttgctaaaataaccgtttttgcaagctaaagtttcccttttctcccaaaaaaatctcttgagaaatcaactttaattcccttagaaaggaagatttcaaaatttattttcattttcctataacttgcctgtaaggacttagcctcagctttggataggaatgcaccctcattcacttgaattttcacccacaagccttgcaagacaggagaggcaagtcctttatcttgtgcaggcagacaatacttacacttatgtaaattctaggacattttttttttattctagcaggttagaagcctgagcatcagtgacctctatcatttccagaagatctgtgttaagtcttttttctgctttcttcccaacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacgtaagtgtcttgcatttggaaaataatacactttttataatttctttgaaaatgtggctataatctgtagcaattatgatttagcccaaatgtggccgtgccattattctaagagaagaaagtgaatgttactggtttatgcatgaattgataaaagaatgagagctttgaatcaggccaactaaatttggggctgtttttctgattatcatgtagtctttgtctcatagaacatatgacacattagcttattttctcttccctgttctaaactatacaaatctcattacattttacgtaactctagaaatatctgacagatgagctggaattttcccaaatttcagactcttcagcaaaggctttcagtttatgaaaaataatgacacagaaaagaaaaaaaaagaaaaagaaaagcaggctctgcctattcccttatgccgaaaaacgaggaaggacgaaaccttcctatgaactgggctcagatgaaaaatgttttgaggaaattgagattccagggaccgttagcaaattggatgccatttattgaaaagaacatccccgcaaagccagggaatatttctagaaagtcagcgatccgtgtaatgggctaacacattggagaaagcagagagtggcaggaagtgggggcgggggggataattaaccctccttgctgccacgtttaggagatttatgagtaacggtcgacatatccgttcttgctgcctttgcacaatgtgggtcttaccttctttgggccacttgcagccatctctgaggtagatgcttgctctaaatttgaaggaaaagcctaagctctagttcccctttttgacagcatcaaaaaaagcacaaaatggaattggtccaagaggggcattctctgcttcactgaacttattcatgagaaggagctgtgaaaatattcttggtaggaactgaagcagcatctgaagcccttcacttaaacctttatctcttttatcacataagttaaatagatcaggcagaaggcttgctgacaaggagaacagtgccaagcctattccatccttaagtgtgtttctgtcccactacaattttcatagtaagtgtagtcttcttcctgggagaaacagtgtttaatagtgtttttgattatgcttttgagcatgagcggtgtatggtgatatctagtatgattgggacacaaaaggaagtttagtggggcatgatctcagcaaggaagcttggatcagcctctactcttgtatccctcaaattgcttccttcttcttccacttgaatatagttcatctcagaatcctcctcttccagaagccttccttgatttaagtggatgtgacagaagcatccatgcattctcagctcagctcacaattagctgggcttagggatgaaatattactcaataagtacaatgtacattatttgggtgatggttacacttaaagtccacactttatgcgatatatccatgtaacaaaactgcacctgtaccccttaaatttatacaaaaaaatcttcctgtcttagagagaaacttcccttatagcctgttaatgatgacctcatggggaaagcttgtaactctcagaagaccatctcttatggaaagcctttcatatttatgaagaattgaatattgtccatgaaacttagacaaagaaagatgtgacttaaaaaaattacaaacccaaatctactactttctaatatttccttgtgctgatgaatttgtcccaagcccttttgatattcaattggtgccaaagtgattatgtaacagatggcctagggcaccagatctggtccagtgtttcaggcttattgtcagatgatgacgctaaggtcatggtccttcccttagtgagccactgagcatcattatgtgtgtccatgcccaagctaactgttctgaagacatgcaaaatcatctctgctaaagggaaaacctcaaagcatatgtcctatatatgctgtcttgatatatgcatgcacatacacaaacacacacaatatgcatgcacagagatttatattgcagctctaacagtgagaagtcagaagcagtggaaatgtcagttcatagataaatagttacaaaaatgatccaggtaatgcaatataatgctactattaaaaacactgtttattgaaaatttggtggccctgggaaatgcttgttaacttatttttaagtttcttaaattataaaattaatatatatgcttattatacaaaacaacatgaaagcatctgagcttcatatggaacatgtgtccctaaactctcattccactctcctgggataaccattattagtggtttgctgtgtgatcttccaaactactttctttgttttataaaattatatatacatgcctgtatgatattttattttacaaaaataggatattatatacacttttctgtgatttgcttttgctcaataatgtgtgtaggacatccttccatgtcaatacattgcaatgtaatagtgccatattctttctaatgcttgcatggtttgcagttgcataagtttgcattggtttatttaaccagtctatatttgtagatattgaggttgtttccggtttttgctattaaaagtaagacatttatgaacatctttaggcacttattcaagtatttgtgagaaatagtcgaagtgcatgttcagttttaatcttcataagtactgtcaaattgcccttcatataagttgtattaatttatgctcccaccatctatgtatgaaagtccatttctaattccttcaccaagattataatcaatctttgtattttggggccattttaataggagaaataatctgtaagttttgcttggtatttttctctttctgcagcatcttttcgattatgtactagttcaattttatttcttcagtgaattgtctatttttagtttggttgcttgtgatatttatttgttaaaaacttacttattaaccttttatattttaaatattatttttgatatgccacttgttttaatctttaagttgtatttttcccatatagaagttttaaaattttacgtagtcagatctgtcattcattttctgtatggcttctggatttcttattcctaggaaggtctttctcaccctatatttttatattttcttctactgctgccataattttatgttttacccatagttctctattccatctgaaatttatattcctgtatggtatgcaatggggaactaattttttttaaatctccggatggtaggtttatgaatgttatttttgctcacttttatgcttctgtctattccaaaatttccacaattggcaagtttcacttttaaaacaggagaaaagctctttttaaagtaaaagtacatcttatttcccatatttttactgtgcaactctagagacaagttggtatgtgagtagatgaagaaacagaggggttttctaaaattaaaaaggaaagcaactggaaaaacttcagaaaatgggtaagagtaggcctgggtcataaacccttcacgtctctccttgtctgacaccattttaccaaaagaaggcaaagttttttatcttgcaggggctggttagaatataagcttttaggtcaaggaatgtgttttgtagcctgtttgctctcctatttggggcatcacaggggaatgacgggggatgccattatggtcaaagatgctcactcaattgattcagaaatctgaagaggtgtggaaaaaacgctttgtttgtggaaagctcatcacaaggaatggtgaagatgggtgctgccacttgctggtagctaattagccatagttacaatttctcttataagagagaagacaggctcaggaaacccgaaaatactgatagtgcattgcaatggatgaatgagccatttgttgcttacataaaagtttgttactgtttagcatcagcaaggtttgagttctttagctgggaaaaggtccttgtgtataactccattatgctctgttgttaaagttgtagtcaatgaggccaggaaactcttttgaagttcaaaggagcgtaacattcacagcataatattcatgcaaatatgggataaatgggctgaagagtttgcccatttggcagatctaacttaggtaatgaactattgatcaaagtgaggttgaagaattgaattgttaagaatattcaattatgtatttctaatagaccagcctgtgccaagtctggcaaaggttctggagagagaaattgttcatgtatttcatgcagtccactcctgctttacaaggtagttaactggatcttcaaggagctagattgtcacttatttttctcctcaagagaaaagcttccaatattcagatttggctaaaagtgggcctctggacttctcaggaaaggcaagccaccaaaagattgaagggaaggaagaagatacttagaaagtttgaaacatgtgaagcccacttagaacttctctattgtgagagccagccaggaaggcatgggttttcctcctccagattctcccttggtcatttgaggtgattattgagcaagcaaatgcgtggacctgttcacatcttagaagtttaattaagtggaattagacgaaaggaatacctaaaattagatagcttaatgcttttcaaagtatattcttaattgttttttattttggtgagggggcagtaggttttgtcatggaggctctgtagttagcctagatccaatccccagctccttgacttacttatgtaccttgggaatgttacctaacctctccagctttcgttttcttatcagtacagtgggggaaataatagcataatgagcgtgagcattgtcatttgaagaagaaacgagattgtgtacaccaagtgctttgcatagtggctggcacatagtaagtttttcataagtagttgctattagagcaactctcttacaagccaaagatattatccccttaattttaaggtgagaaacttgaaactcaatgaaatcaagtgactttgtacaaggacaagcagcaagtcccagccagagctagaaccaaaacccaggtctccgaattaagtgttctgttcactatacccatctgcctcttggaattctttgaggaagtcagttcattgtcttgaatagaagcccagtcctttatacatggcagccacttaacacataagagatgatccaagtaaatgaataaaaattttctaacccaaattcctaagagggatagtatactatttgggagttaaaagactgagacaaggactaaaaatttttcaggaacctacatttgctaagccaaaggaaagtagtgaggaaggttaaaagtatgtgcgtctatgtctatgcttcttatatttccctgacttctcagtaggattggaatgtcttcatagtttaatggaaagaggactgtgcttaaagtcaagagacctggtttccggtcagtcttcccttgtttgccgtgtggtattggttgaatcattcgtgttctatgaagtaaagattcactacttacaaattgaaaagaattcttgccttctggactgaaaactaaaggagaatagtataggggctggggaggtggaacaagggaaacgaaggccctggttttgtgtacttggagcaaaccacatggatatttaatattgtcacaaggtaattgcaaagaatattttatccatttaagatttatagcctgtctgcttctagaaaggttagatacacattagagatgaaagaataggggcaagataatgtttttaaagatgaaataaaatagagatcatctgaagaaaatagaaggaatagatgtttttaacatttggtttagtagattatagcatttataatgtaaatctggcttatgcctcccaaaaggatgaaaagagaaactttgggtttgttgtcaagagaaaatttacagtttcatctacagagattattcccacctctaacccactcaagcagtattgatcctgggatgtttgaataaggcacattctgggtaaccttggtttcatagaaaaaagaattgtctggcatttctttactgatgctttgtaaaggaagaaggcaaatattaaattataattcaataaaggactttctataagcagtaaggaaatgcattccaggtactttccctttgaatgatctaaattggagaatagaacatggaaatgttaaatagatgtttaatatgtctactagactggattgtcaactatcagatgccctaagcaagctttctattaacatgatttgtttctgattttaaaaatagatgctcattgttaaacattcaaaaggtacataaaagtatagggaaaacaaaaatgaacagtaatcacaacgtgtatggataaccatagttaattgatatatatatatacttgtagtctttttttctaagctcagttatacaaacatattagtttacaaaactgaagcactttttaaacagtatggatcagggtttgtttatttatttatataaacttaggggagacaagtgcggttttgttacaaggatattctgcatagtggcgaagtctgagcttttagtgtagccatcacccgaattgtgtacattgtatccaataggtaattcctcattccccatacttcttctaccctcccacctttccacatctcctgtgtctgtttttccaaaatgtatgtccatatatacacattatttagcttccacttgtaagtgagaacatgcagtatttggctttttgtttttgagttgtttcacttaagatcaattcacaattggagtctctaaaatgcacttgtagtaaagacaacatcccatgttgtctgtaagtgaaagctgggcggtttagacacgagttgcaggatatgcaaatttgattctattgtgagaagttcaagagctcaacttttattctctaccaaagggaacaaaagtattcctgatcaaacagaaagcctcccttcacagagatttgcaccgctaaagtgctgataggaagaacagtttggttttttgaacaggcatttttatttttgcccaaagttctatgccatatgacatggaagagatgatattagcctgaaaaaatattcaggtcaggtttcatcagcttagcagcctttctgtaaaaggatctcctcatggcctcatagtagacactaatgagaatatcatcaactcccagttatttatgctaatgaaagatagaagggcacaataaattgaaatttcatggaaaatctccagttctcatcttaatggtgtcaccttgcttgactgccaaacttctttgaattatggacccttttcttttcgatgggtttgcccacctgctaataggaaagtaaaataaccacaaaacaagtagtgagagggccatgctgtgggaggcccaggcaggtgaatcacgaggtcaggagttggagaccagcctggccaacatggtgaaaccccatccctactaaaaatacaaaaaatttaggtgggcgtagtggcgggtgcctgtaatctcagctactcgggaggctgaggcaggagaatcacttgaacccaggaggcggaggttgcagtgagccgagattgtgccactgcactccagcctgggtgacagagcaagactccatctcaaacaaaaaacactcagtatataattttgggcaggtgatccagcaagtaggaaaaagctaattaacttctgaatgaaggaaaaagctgcatacacaggacggagaatgttgcttcttcatgactttctttttttctctggcgtctgcaggctggaaatgaagtcttaaagtcctgagaaaacatgaaacagagtcttcaactctagaaacccaattgtcagtgaaataagaaacgttttccccttaactactacatcttgcccttcctacattctgcttcaagtttgataaatgacagaagagacgtacttatgcctttattttttcttcactcttctagtagccttttaaagaaaaaaataattaaaaaggaatttgtttacttgatgtgtccactcatataatgaatagcagagattcatctttttttccactgaccatgtgttataatagaataaatattattgtaatactgacatgacaatgtgtctacagtaatagcgcttatcaaaaacagttcttgggaatgttttcttgattttggactggtgatgaagttactgacctttgcctaatcctgggagctagtcagtaatgattggcaaaacattgatggcatagtgacacgtatctgttgttgtttactttttgtcatcattgttcctattaacaggggcccctaaagtagcagagatagccacctctaatgagggcaagctgatacatttgaaaaatagctgtgatgttgcaggttgaaggtccatctcacaagttagttggaattcctttgggaccaaattctactctcagacaccattagttagcagtaagtcatgcatctgatttgtgctttttgtccaagatgatatactgggattttatgtgttattgattatactgcataactcattaaattctctccttggtaatgtcaacaatttttaaaatttcaaacttataagcatatactgaaattggctttatcatagtttctcaaatttggtgattgtccaatgtgttcatggtgaaattagtataattgtgctaaccactcaatattggacaaccatgctcaaacacgtcttaaaaattatggtgttccagcacttttggaggtgaggtgggtggatcacctgaggttgggcacagtggcaggtgcctgtaaccccagctactcgggatgctgaggcaggagaatcccttgaacccaggaggcagaggttgcagtgagtcaagattgtgccattgcactccagcctggacaacaagagcaaatctccatctcaaaagaaaaaaaaattataatgtttacttttttgatatgctataaaaatatcagtgtcagtaattgcagaaacattgtttaatagcactaatggcgtgaccattcagctccttgtctgccttcagttcctaaatttgctccttccaggagttgtaggtttctgtctgggtcataattagccaaatcccatgttgctgagataataagaccaatacacttgatgaaataccattatgttttcattttagatcaggtttctatcagcagttagtgtttgagtaagatatttgcatcctcaagaagcatagtttggaagacactggtacgtgggataaatgccacgtgaacaaatgaggaaagtgctgttaggtttaaagagaatgaaaaataacttttagctggggtaatcttgtcttcccatcaagatttcaaagcccttaaaagcatgagcactattttatacattatgtgttgtcactgatgtaaatacaaaaatgcaaaatagtctctgccagctgcactattttatatagtctttgttgagtattacttgacttcactacaaacaacattgatttttaaaaggtgattaaagttgtgttaaaaaggtatagtggaaaggtaatttgagaaaaggttagtaaagaatatgtggaagctctttactttccaagttctaaaaacagtgacctgcaccttaccaactacgtagcaggagaggcagaattctgtaaaggttatagtctttggttctaaagctacaagatataggtttgaattctatttccataccttgattagtcatgtcaacttgggcaagttaccaaacctctctgtgccattgattcctcagtggtaaaatggggccaataatgagacctaccttgtagggttgttgtaagaatttagtgaattcagatatgtacaacccttagagcagatcctgcctcataggaaatgctcaacaaatataacttgttgtttttgttattgttatcaccgttctcatctggctctatatttttcttgcagttggttccctggctgctttttacacttatcatctacctcctagcctttgagctaaattcggggcagaaaattcagatggctcagctttcaaactttgtctaataatactccttagaggctgaatttgggggaaaatgtaatctattggctgaaatcagttagttgggttatctgtggttttcaagaataatggtgaactcacatatactgaagcgatccatttaatagtgtcagtgaaataatctatcttaaatattttttagagaatagatagcaacttgcctgaaagttatatattaagaataccttcctcatcacatcaatatatactgtccttttggaaacagactttcctgcaagtcagaatcttaaacagtttggaagagagttttagaaatgtgcaaatgaacttgaaacccacatttgtatagcttgttttatttcagtgcttgagtagtcttttcggtggtctttatcttttattatcccctttcttctttatcaagtaagaaaagggtaggtcattcaaccatgcagaacatatagctgataggaaaacatattcagtttcatattttaaataggtaaatattatgtcaacctctgattgagctaatctaagcaagaaaaataattcagaatcaaacacataatatacagttatagcttactctgcaatgtggatttaaacctacaaagtaacttttagcttacctccattcaagttttagtggccccagactcatataagtatgaatatttatgctaacctagtaatgccatttgaaggagccaccttgtaggatttgcttccacatgtatactcagattctttctgaaatgttgaaataagttgtatatgtgaaatgcaaatcacttaagtgtttgtcagtgagactatacatttattgtacagaaacagtaactctcatcccaccgaaatggtagagaaagatgccttatttagatgttagtcttgggaaattcataatcatctctcatcagttaaatatactgggattattaaaatatttaaaatatttcttaccatgtccttgaatgttgtggagcagaagtttaatttgtatctataccaaaaaaaaatgtattgctaagatttggctgaaaaacactaacattctgccttaaaagtatgttctgttttctttcaattaataaatattttgagcacctacttttagctcacaaatagagattaatataacaatgttgacgatgatagtatcataaaaggggaaataaaaattgttactaaaatgaatatatattcaaccttgccgataagaaaaagaaagaaatattggttccattttcccttacttaaccaagttgccaaaactttaaacagtccattgctgggcattctcactcactgctaatgggaaagtaaattactgtggcttttctggaaggttgtctggtaatgtaaatcaagaatttgaaagtactcaaaacatttgacccaagaaatctacttctaagattttgcattaagaaaatacctaatgttgcaaacagaactttatatgtaaggatctttgtcataatttatttaatggaaagaaatggaaacaacctaatatcccaagataggggattggttaataaattatggttcagctgtgtattggtgtagaactatgtaattagtcatgaggtatgggtaaactatttaatggcacaggaatgttctgatatgttaatttataatgtagtttataaaatgtatataatatatgctgttaattttgtaataaaaccttaatacacataacccatggaaaaaaaagatcagaaagagcttccagtttccagtctgataaatagtgatcttggaggttgtcattcctgttgtcaaaagaaaaaaaactgaatgaactgaaaatcaacaatagatgcagtaagatgggaaatggaaataaaaggtatacatattgggaaggaaaaaacagtattacctttgttcatagatgacatgtttttctgcatagaaaatcccaagggatcaacaacaatgacaaacacactcctgttactaataagtgattattgcaaggttgaagtatacaaagttaatataaaagtcaattgcttttctgtctaccagcaattaacaagtggaatttgaaataaaaaatacaatattatttatataagcagtcattaaaatgaaacaggtgtaaattcaacaaaatatgtacagtatctatatgatgaaagctataaaattctgatgaaagaaataaaaaactaagtagaatggagagatactccatgtttgtgtttaggaaaactcgatattgtcaagatatcagtttttcccaacttgatgaatagatgcaatacaatatcagtaaaatcccagcaagttattttgtggatgtcaacaaactgactctaaagtgtatatggtaaggcaaaacccagaacagccaacacaatattaaaggagaacaaactcactacccaacttcaagacttactattaagctatggtaatcaaagttatgagatattggcaaagtaatagaaaaatagatcaagggaatgtaatagagagcccagaaatagacccaaataaacatcatcaactgatctttaacaaagtaattcaatggagaaaaaatagtcttttgaataaatgggtgctggaacaactgggcatccatatccaaaatgtaaataaatctagacatagatttcacacccttcaccaacatttactcaaaatggaacacagacatgagtgtcaaatgcaaagctaaagaacccttagaggataatataagagaaaaatttaggtaaccttggatttggcaatgacttgcttttttaacttttagtttaggttcagggatacatgtgcaggtttgttaatacaggcaaatgtgtgtcacggggggttggtgtacagataattttgtccccaaatactaagcatagtactcaataggtattttatctgatcctctctctcctcccaccttcatgcctcgagtaggccctagtgtctgttgttatcctctttttgcccattggttctcattatttagctctcacttataagtcagaacatgcagtatttggttttgtgttcctgcattagtttgctaaggataatggccttcagctccatccatgttcttgcaaaggacatgacctcattcttttttatagccgcatagtattccatggtgtatatgtgcacattttatttatccagtctactgttgatggacatttagattgattctgtcttttgtattgtgaatagtgctgcagtgaacatatgcacacatgtgtctttatggtagagtgatttatattcctttgggtgtatacccaataatgggattgtttggtcaaatggaagttctgtttttaggtctttgaggaatcaccacactgctttccacaatggttgaactattttacatcctctccagcagtgtataaccttcccttttctccataacttgccagcatctgttattttttgactttttagtaatagccattctgatgggtgtgagatgatatctaatggtgagtttgatttgcatttctctaatgatcagtgatactgagcacattttcatgtgcttgttgactacatgcgtgtcttttgaaaagtgtctattcatgtcctttatctgctttttaatgaggttatttgttttttgcttataagtttgtttaagttccttacagattcttgatattagaccttcgtcagatgcatagtttgcaaatattttctcccattctgtaggctatctgtttactctgtggatgctttcttttgctgtgcagaagctctttagtttgattagattccacttgctaatttttatttttgttgcagttgcttctggcatctttgtaatgaaatctttgccagttcctttttctagaatggcatttcctaggttatcttccagggtttttatagttttaggttttacatttaagtctttaacccatcttgagttgactttttgtacatggtttaaggaaggggtctagtttcagtcttctgcatatggcgagccagttatcctaacactacgtattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctctttgatactataatagtggatacatgtcattatatatttgtccaaacccacagaatgtgcaataccaagagtgaaccttaatgtgaattttggactttgagtgataatgatgtgtcagtgtagattcatcagtggaaacaattgtacctctctggcaggggatattgataactggggacactatgcatgtgtggcagtggtaacagggggtatatgggaaatctctgtaccttcctcccaattttactgtaaacataagactgctctaaaaaattaagtattaatttaacatataaaaatacataaatactttaaagtatttatataatactttccctccccccacagtttatgggtacatcaaatttctcttcagcaactgcaagcaaagaaagaaaggagtgaaatatttaagttgttgaaagaaaaaggctaccaatctggaattctgtatttagagaatttatttttcaaaaataaatgataagtaaagactttctcagacaaaaagtgagagaatttgtcaccagtagaccttccttgcaggaacttttaacaaaaattcttcataaaaagggctaccaatctggaattctgtattcagagaatttatctttcaaaaataaatgataaataaagactttctcagacaaaaattgagggaatttgtcaccagtagaccttccttgcaggaactattaacaaaaattcttcataaagaagaaaaatgacataggtcagaaacttggatctacataaagaaaggaagaacattagcaaaataataagtgaagtaaaatatttttctttttcttaattgacataataaaggacagtttgttcaaaataaaaatagcagtgatatcttacatgtctgtagcttatgggaaagtggaatgagtaacaggtgtaataaggaatggaagggagggattgggaaaattctgttagaacatatctgttctacacatgcagtggtatagtgttatctaaaagtaaaagtggacttggattaatgtaaatgtatattgtaaactctagggcagccactaaaaactttcttaaacgaagtataattgatatgctcagagaagagagaaaatggaataatataaaatgttcagttaaaaccagagaagacagaaaaagaaaggaagacaaaaaaaaaagtaacaaaaaaactagggcaatgaatagaaagtcattgcaaatacggtcaatattaaactagcaaatcaatagtcactttaaatgtgaatggtctatataaaccaattaaaagacagagactgtcaggggattaaaaatccccaaaatccaactatgtgttatctataagaaaccactttattttaaaaaatatttctaataagttctattgtgtacatttaaggtatacaacatgatgttatgagatacatataaaaattgtaactgtactgaaacaaattagtatatttattcatcttacatggttatccattttcccccacaagagcagttataatcatattaattgaacaatttgtcccttcaagtcaaattcctcagttgtgatgggtcagattcctcaattgtgaccaaccattgcaggtgaaattcaaattttatttttttagtggttttatttttgagaaaaattttatttcacctctcccaatggatagacatttatttcaagatacactgcatcctcttattgtcaacacttcaaacctaccagctactgacatcttgaaacagcataatttgttatccatgactcctgaaagttcctcatgtcaccaacccttatatgatacaaatgtaaagatggctattcgtggaaatgtgttcaccacattgccaagtgtcttgggtctccttttgaaaagaatgttttttcacaaaagtcaacatttccctgaaaatgcagctccatcttctattggtatggtctgtggaagtcacagagactgaaatttcggtccatattatggttgataactacaatttctgttgcaaagtatgcaagcattactttgaactgcatctgatgcaacttggtggtctaggccattacttgcaaattgccaaggcctattttgggaacaatgctttcaattcccttttattgcatgtatcagaacaatatcctgttaactaatatgatggttcattttactgcatatatgagaagaatgtcctgttaaccaatatattttgacttttggttttagtatgttttagtacaaatatccagggacaaattcttcagttgaatacatccaagagacaatttgttcaattgatctgctataatctaatcatttagcaaaaattctgactacaatacactatcattagctatggttctcatgctgcatattagatctttagacttgttcatcctatatatctgctgcattgtattttttgacctgtatctcccatttccacacccctacaccaatcatagtcaccactgttttattctgtatctctgtgaagttgacctttaaaaaaaaaaagataccacatataagtgggatcatgtgatatttttctttgtgtgtgtggcttatttcacttattgtaatgcataccaaagaatattttcagctatacaaaaggaagagatcctgtcattgccataagatggattgacttggaggacattatgctaaatgaaagaaacctagtttaaatataaagacacagatgggttaaaagtaaaggaatggaacaatatatactgtgctagctctaatcaagagaaagctggagttgttatattaatttcagacaaagaagactttaggacaaggaaaattatccgggaaaaatggggggcattacatattaataaaggggtatattctccaagaaaacataacagtccttaatgtgtttgcacttaacaaagcatcaaaatatgtgaggcaaaaactgatagaaatgcaaggagaaatacaaactattagagctggaggcttctatacccctttattagtaatttatagatccatcaggcagaaaatcagtaaggacatagttcaatttaatcatcagtcaactggatttaactgatgtctgtagaatactccatccaacaacatgagaatatacattcttctcaagatcacatggaacattcgccaaaatagaccatattctgggtcataaaacataccttaggaaacacaaaataatagaaatcatactatacttttttttttttttttttttttgaggcagtctcactgtcgcccagggtggagtgcagtggcgcgatctcggctcactgcaagctccacctcctgggttcacaccattctcctgcctcagcctccctagtagctgggactacaggcgcctgccaccacgcccagctaattttttgtgtttttagtagagacgggatttcaccgtgttagccaggatggtctagatctccttaactcgtgattcgcccgcctcggcctcccaaagtgctgggattacaggcgtgagccaccgtgcccggccctacaatatatacttctacaccatactggaattaaactagaaatcagtaacagaaagctgtacaattccaaactatttagagattaaaaaccacacttctaaatcgcacatgggtcaaagaagaagtctcaagagaaattttaaaatattttgagctaaaagaaaatggaaataccacttatcaaaatttgcaggctgcagcaaatgcagtgcttagaaggaaatatatagcaaggaattaatatattaaaagtggaaagatttaaactgaataatacagactaccaccctgggaagctagaaaaagaagagtaaatcaaatccaaactaatcaatagaaaataaattttaatggctacaaaaatacagttagatagaatgaataagatgtagtatttggtagcaaaatagagtgcttttatggattgtgacattggtcatttctaaactttttgcctaaaccagaatcacaaagatattctcctgtttgttcttttagaagttttaaaaaattaggttttaaagtctataacccatcttgagtttatttttatatatagtatgtgatatggattaaggttcattttagtttatgttttgtatattactatccaaatatttaggcagcatttgttgaaagtactatcccttttccattgaattccctttgcacctttgttgaaaatcaattgaccacatatgtgggtagattttgaatctattttattctgttgatctatttgtctaacatttcgccaacaccacattgtcttgaaaacgtcagtctgttgttgttctttttgcttttgagacagagtcttgctctatcgctcaggctggagtgcagtggcacaatcttggctcactgcaacctccgcctctcaggttcaaacgattctcgtgcctcagcctcctgagtagctatgattacaggcgtgtgccgccatgcctggctaatttttgtatttttagtagaaacagggtttcaccaggttggccaggctagtctcgaactccttgcctcaagcgatttgcctgcctcagcctcccaacgtgctgggattacaggcatgagccaccacacccggccaaaaagtgtaattttatattaagtctctgacatgtttcttttgcaaaattgttttggctattctactttctttgcctttccatataaatttttcattagattaccaatttttataaaagatcatgctggtaattcgatttagattgtatggaatctataaatcatattggagagaactgatatcttaacaattttgtatctttcaatccataaataaagtgtatctctccattttttaggccttcattgattttttcatcagcgttttttagctttctaagcgaagatcttacacatattttgttagatttatacttcagtattttcaagttttgggagagctattgaaaatagtacactttcaatattcaatttctaattgttcattataaaatatataaatatgatttataaattctctatagtaactttttaatatattcttatagattttctatgtagaaaattatgtctatttgtgaatagaaagttttatttttttactttccagcatataggccttttatttgttcttcttacccaatttcactgactaatatctccaggagtagtgaagcagacatccttgtataattcctgatcttaggggtaaagcagtctcttgccattaagtgtaatattagctataggttttttgtagatgccctttatcaggttgaggaagtactcattctagtttgcagagactgtctgtcatgaatggatgtagaattttgtcaaatgatttttctgcatctgtggcaatgattacatgattttccttctttggtttgttgatatggtgaattacattgattggattttgaatgttgaactagccttgaatttccaggataagccccacttgctcataaaagtattatctttctacatattgttagatttagtttgttaaaattttgttgagaatttttgcatctatgttcttaagggatatttgtctgtagtttctgttcttgtaatatctttatctggttttggtatcagtgtaaagcttgcattaaatattcagttgggaagtattccctcctcttcagttttctggaagggtttggtagaatgtttgatagaattcaccggtggagccatctgattctggaattttctttgtaagaaagttttcaactacaatttaaattcctttaaaatatataggactattcaggttagatatcttttttttttttttttgagacagagtcttgctctgttacccaggctggagtgcaatggtgccatctcagctcactgcaacctctacctcccatgttcaagtgattctcctgcctcagcctcccgagtatgggattataggcactcaccaccatgcctggctaatttttgtatttttaatagagacagggttttaccatgtaggccaggctggtcttgaactcctgacctcaggtgatccacccacttcggcctcccaaagtgctgggagtacaggtgtgagccaccacgcccagtctcaggttaattatctctttttgattgagctttggtaatgtgtgtctttcaaagaattaatccattttatgttgtttcaagaattaatcattctatgttgttaaactaactggcatacagttattcacattgttccctttttacccttacccttttaatgtctgtagtcaatgcaatgaaaccctcttttttgtctctagtcttagtagtttttgtcttctctctttttatctataggggtttatcaattttattgatcttcctaaagatccagttttgatctcattggtttttccttattgactttctgtcttcaatttcattgatttctgctctttattattctattttttttcttattttgtcctactttttctagtttaagatattgatttgagacttttctccttttccaatatagatatttagtgatacgaatttccttctaagtgcttttttagctgaatccctaaatgatgtgctgtgttttcatttagtacaaaatactttctaatttcctattgatttcttcttcaacccacagactatttatatgctaccagcttcttaaaagtggttatcttcctgtactgggattatgtataatgtttataaaataacactctatattttatagcactttataatttacaaagtgcttcatttaatcctctaacatccacttgagaaacataatatttcacagatgttgaaaaggttatcagggtttgagtgacttactcaatgtcacacagagtaggttaggactcaaacctagattttctgtctcccagtttattattctgaagaaattgtaaagaaaggtttgaaaaataaattggaattcaccttgtgggtatttggaaagattcatagaggttctttgaagcaatcattgatatgaggcatctctctcagtttagttttaatttagatttctgattactagtgaggttgaacatcttttaatatttattctctggtatcgtttggctatgtctccacccaaatccatcttgaattgtaactcccacaattaccacatgtcgtgggagaaacccggcgggaggtcagttatgggggcgggtctttcttgctctgttctaatgatagtgaatgagtcttacaagatctgatggttttaaaaaagggagtttccctgcacaagctctcttctcttgaatgctgccatgtgagatgtgcctttcaccttccaccatgattgtgagacctccccagccacatagaactataagtccaataaacctctttcttttgtaaattgcccagttgcaggtatgactttatcagcagcatgaaaatggactaatacgttgtctgttccaatttcttcttttctgacttgcctatttctgtacttagattgtttttctattggattggttggtcctaattgatttgcatgattaaaatattccaatactaatattttgtttactatttgttcacaatatcttctcttagcttcatgcttatctgtctttattacttcaattttgatcgtcaggaaaatctgcactggactgaagaaaatttgtgtgtttattataagaggagtattgctttattttgagctagtatgatgaaaagtgggagatagaagaggatgggattagaagataaaccacttgatttggaaattcaatttaccaatcatttgtcagttgcttatgcttgcatattgcctataattgcttattgcccacagtgtactaggccatgtgatgaatagagagtaaagaataaatgttacctactttcagggactctgatggagaaatatatcatgtacaataaggcagttaacatggtatgtgctcaagtgaactgtggtataagataagctgtggctaccaaaatttctgttccagcaaaggagagtgagtggtttgagttagttgggagttgtattagtcagggttctctagagggacagaactaataggatatatgtatacatgaaagggagtttattaaggagaactgactcacacgatcacaaggtgaagtcctgtaataggccgtttgcaagttgaggagcaaagaagccattagtggctcagtctgagccccaaaacctcaaaagtagggaagccaacagtgcagccttcagtatgtgactgaaggcccgagagcccctggcaaaccactggtataagtccaagtgtccaaaagccaaagaacttggagtctgatgttcgagggcaggaagcatccagcatggaagaaatatgaaggccagaagactcagcaagtcagcttcttccaccttcttctacctgctttttctggccttgctggcagcaaattggatggtgcccatccaaattgtgggtaggtcttcctctcccagtctactgactcaaatgttaatctcctctggccacatccaaaaacacccagagacacccagatacacccagataggatacacccagaaggatgctttgcatccttcaatccaatcaagttgacacttaatattaaccatcacaggagttgtttaagcaagaattctgtaagttgaatgggagcagggactttgtataaaaattttagttcttttcgtctgcaacacttagcatattgcctgacagtgctcaaatatttgttaaatgattgagtgatgttaacatgtgtaggcaaagccaatcatagagacctaacacaatgcatcatctatcattcctataccaccaacagctctgagaatgttctgatacatccacatttcagacattagcttgcatttccaaagaaagggaacacaaccttttcaagaaaaagaacacatgatatgctccctttatcattgtaacggagtagtagttaaaattttgtattgctgactatggccttatagtatagtttgaaatcaggtagcgtgatgcttccagatttgttctttttgcttagtcctgctttggctatgcaggctcttttttggttccatatgaattttagaattgttttttctaactctgtgaagaatgactgtggtattttgatggggattgtattgaatttgctgattgcttttgtcagtatggtcattttcacaatattaattctacctgtctatgaacatggggtgtgtttccatgtgtttgtgtcatctatgatgtctctcagcagtgtttttagttttccttgtaaaggtctttctactcctttgttagatgtattcctaagtattttattttattttattttattttattttattttattttattttattttattgcatcctttgtaaaaggggttgagttcttgatttgattctccacttgattgcttttggtgtatagaagagctactgatttgtgtacattaatcttgtatccagaaactttgctgaattcttttatcagttttaggagctttctggaagactccttatggttttcaaggtaaacgatcatattgtcagcaaactgggacagtttgacttcctctttactgatctggatggcctttatttctttctcttgtctgattgctctggctaggacttccattactttgttgaagaggagtggtgagagtgggcatccttgtcttgctccagttctcagagggaatgctttcaacttttccccattcagtattatgttagctgtgagtttgtcatagatggcttttattacattaaggtatgtcctttgtatgccgattttgctgagggttttaatcataaagggatactggattttatcgagtgctttttctgcatctattgagatgatcatgtgatttttgtttttaattctgtttatgtggtgtaccacatttattgacttacatatgttaaaccatccttgcatccctggtatgaaacctacttgatcgtggtggattgtctttttgataggttgttggattcagttagatagtattttgttaatgattttagcatctatgttcatcaaagatattggtctgtagtttccttttttggttgtggcctttcctggttttggtgttagggtgatgctggcttcatagaatgaattaaggagggttccttcttgctctgtcttatggagtagtgtcaaaaggattggtaccaattcttctttgaatgtctggcagaattctgctgtgaatccacctggtcctggacttttttttgttggtaatttttaaattaccatttcaatctctctgcttgttattggtttgttcagggtatctaattcttcttgatttaagctaggagggttgtatttttccaggaatttatccatctcttctaggtttcctagtttatgtgtgtaaaggtgttcatagtagtcttgaatgatctttcgtatttcagtatttgaagatactcctgttttgtttctcagtgaggttatttgaattttctctcttttcttggttaatcttgctaatggtctatcgattttatttatcttttcaaagaaccagctttttgtttcacttatcttttgtgtcttttttttgtttcaatttcatttagttctactctgatcttggttatttcctttcttctgctgggtttgggtttggtttgttcttgtttctctagttccttgaggtgtgaccttagattgtctatttgtgctctttcagacttttcgatgtaggtgtttagggttatgcactttcctcttagcactgccttagccttatcccagagattttgataaggttctgtcattattatcattcagtttgaagaatttttaaatttctatcttgattttgtttttcacccaatgctcattcgggagcaggttatttaatttccatttatttgtgtggttttgaaggttccttttggagttgatttccagttttattccactgtggtctgagagagtgcttgatacaatttcgattttcttaaatttattgaggcttgttttatgacctatcatatggtctattttgcagaaagttccatgctctgttgaatagaatgtgtattctgtggttgttggatgaaatattctatatatatcttgtaagtccatttgttccaaggtatagtttaaatccattgtttctttgttgactttgtgtcttgatgatctgtctagtgctgtcagtggaatattgaagtcccctactattactgtgttgctgtctatttcatttcttaggtctgttagtaattgttttataaatttgggatcatggtactggtataaaaataggcatatagaccaatggaacagaatagagaacccagaaataaacccaaatacttacagccaactgatcttcagcaaagcaaacaaaaacataaatgtgggggtccttttcaacaaatagtgctgggataactggcaagccacatgtaagagaatgaaactggatcctcgtctctcaccttatacaaaaatcaactcaagatggattaaggacttaaacctaagacctgaaactataaaaactctagaagataacattggaaaaacccttctagacatttactggggaaacatgccaccaatatttcaacgtaggttctttctattttccataaatgtcaaccggctaagaaataaagagaaagagtacaaagagaggaattttacagctgggccgctgggggtgaaatcacatatcggtaggatggtgatgcccacctgagccacaaaaccagcaagttttattaaggatttcaaaaggggagggggtgcaagaacagggagtaggtcacaagatcacatgcttcaaaggacaaaaaagagaacaaagatcacatgcttctgaggaaacaggacaagggcaaaatcagaaactcctgataagggtccaacaaagatcacaactcaaagggcaaaagcagaattactgataagggtctatgttcagcggtgcacttattgtcttgataaacatcttaaacaacagaaaacagggttcgagagcagagaaccagtgtgacctcaaatttcccagagcggggtttttccccaccctagtaagcctgagggtactgcaggagaccagggtgcatttcagtccttatctcaaccacataagacagacactcccagagcagccatttatagacctccccccaggaatgcattcctttcccagagtaatccttgctaggaaaataatttagagatatcttccctacttgcatgtccatttataggctctctgcaagaagaaaaatatggctctttttgcctgaccctacaggcagtcagacattatggtcgtcttcccttgttccctaaaattgctgttattctgttctttttcaagatgcactgatttcatattgttcaaacccacatgttttacagtcaatttgtacagttaacacaattatcatagtggcactgaggtgatgtacatccttagcttacgaagataacaggattaagagatcaaagtaagacaagtgtaagaaattatgaaagtattgtttgggaactggttaatgtccatgaaatcttcacaatttatgttcctctgccacggctccagccagtccctctgttcggggtccctgacttcccgcaacagacattggcttagacaaggatttcatgaccaaaaacccaaaagcaaatgcaataaaaacaaagataaatagctgtgacctaattaaactaaagagcttttgcatggcaaaaggaacagtcaacagagtaaacaaacaacccacagagtgggagaaaatcttcacaatctatacatctgacaaaggactaatatccagaatttacaatgaacaaatcagtaagaaaaaaaaatcctatcaaaaagtgggccaaggacatgaatagacaattctcaaaagaagatatacaaatgcccaacaaacatatgaaaaaatgatcaacatcactaaagatcagggaaatgcaaatcaaaaccagaatgcaataccaccttactccttcaagaatgaccataatcaaatgcaataccaccatactccttcaagaatgaccataatcaaaaaacgaaaaaacagtagatgttggtgtggatgcagggaatgtaaactagtacatccgctatggaaaacagtgtggagattccttaaataattaaaagtagaactaccatttgatccagaaatcccagtgttgggtatctatgcagaggaaaagaagtcattattcgaaaaagatacttgcacacgcatgtttatagcagcacaatgcacaattgcataattgtagaaccaacccaaatgcccatcaatcaatgagtggataaagaaacatatagataaatagatagatagatagagagacagagacagagagtcagtatgtgtgtgtatatatatatatatatatatgtttctattgattatatatatgtgtgtatatatatatgtgtgtgtgtatatatatgaatactactcagccacaaaaaggaatgaattaacagcatttgcaatgacctagatgagattggagactattattctaagtgaagtaactcagaaatggaaaccgaacatcgtatgatctcactgatatgtgggagctaagctatgaggatgtaaaggcataagaatgatacagtggactttgggcacttggggggaagagtgggagggggacaagagataaaagacaacaaatatggtgcagtgtatactgctagggtgatggatgcaccagggtctcacaaatcaccactaaagaacttactcatgtaaccaaataccacctgtaccccaataacttatggaaaaataaaattaaatttaaaaagattttgtacatcattgtcagacaaacctgggtttgagttccatctcagcttcttactggttatatgactcttgattttccttatctataaaatgagactaataataatatctaccttatgggtcattgtggtgaggatccagtgagcaaagtatgtataacactaatcccctaataggaattctataaatacttgctatgccacttctcttgatgtataataaaatggatggaacttgtgattgcttttgaattttgtgacttggttgatgtttcctaacaggcatattctccatctccttcttcacagattcagagacatattgcatgtttcaagacaagaagtacagagtgggtgagagatggcatccttacctggaaccttatgggttggtttactgcgtgaactgcatctgctcagaggtacaatctctcatgacatgtgatttcccagtttgctcctcagcatgccgagaggctttcagtgcccaaatggccagggaccatggatgataaaatccttaaagaaagtaaagaagcagaccgatcgcactgtctcacgcctataatcccagcactttgtgaggctgaggcatgtggatcacttcagcccgggagttctagaccagcatgggtaacatggcaaaaccccatctctacaaaaagtacaaaaattagctgggcatggtggcacatgcctgttgtctcagctagttgggaggctgaggtgggaggatcacttgagctggggacttctaggctgaagtgaaccgagattataccactgcactccagcatggttgacagaacaagaccctatctcataaaataaaagaagaaagtaagaagacgattgcaagaaaaataaacattttctgtcttctgtcctctcttgctttttggcttgattttcatgggttctctgaatatttactatggacagatatttatgatctcttagcctaatgatatagggcatggttagagaaggcagaagagcctgatagtgggagtggaggcaaaagctcaatagaatgtttagattgtaagacaaagtagtttttgaaaattattttaaggctgacctttagggagaatattaggacaaattataaactggttcattgggagagtggattctatgttgtctcagccaataactgtaattaagactgagtttgtgaaacgttggcctgtacctcttaaggattagagctcccttggcttagccttggctcttgtccagtcatttagaaaggattttggttggcataaatgccatctttgcaatagataaagcaggttgttccatcttcttcccatggtcttgacccaggagcacagctgtggtccatctttctcaacaaacctctgccattatatgttaggctagagtttcttgtttgcactatagatatttgtttgggggctgtcctgcgcattgtgggatgttaagcagtatccctggcctctacccattagacaacaagagcaccaaccccaatcctaataaccaaaaatgtctccagacatggccaagttgcctggggagcaaaaatcacccctggtagagaagtggtgcactaggctaattggaaagggaggccttgtactaggcattgagaattctgaacttacacaaagaattttcaagaccagcttcttacctgagaccttttgtaaggactgcacctcttccctcatgcccagctagagcaggaacaatcacttgcaagcctgatccatttaccatttgaacataattttgggctgtcagaattttgagcatgtggaaacataattatcaggtaacatcaggcagtattaagaggctatgaggttctagaataaagacagaccaagtttccagccctgcctctgccacttatgagccactggacaagttacctgacctctgtgatattcattcatcttcctctttttataaatgggataatgatattaccatttcatatggttctgataaggattaaatttacaaatccatttaaatcatttaaaacaatacttagtcttggtaaacattcaagaaatgttaacagctgttattgtcatcattgttgtccttatcattgtggttatcatcatcatcgttattattattaatctattagctctagaacagaattcagtatatagcattaatgaggattcactttagacctcagctgggaggtgtggtttctgatgtgcttcagtgatctcaattcaagattataccacctgcctctgaggagtgtgatacctgaggagcttctgtggtgttgccaaatgcaacactccaaaaaaaattattctagaaagtacacaagaaaaggaaaaggttgggataaggcaattccaatttggataaaagaagcccgcctctttaaatggttagggcatgtattaaatagatcatttggggattgattaactgcctgggatggcctgattttgtcggattcttgacgcgacacatttcgacacgttggagatggacagctaaccattgggagctgaggctttgatgtctgcaacgcagtcaaaatgttaaaatgatcccaatgccaacagctcaagcacaaggcattttctatttctatatcctcttcactactttcttcccccacaacagcctgacaaatacaagtagcccttgctgcaaatgatttatggatggaaaatgtaaatgaaaaatttatttccagactatgtctttgttctagaaatggttgtgagctgtcagagcgaggggtcttgtaattgtaaatcaggcagggacccagtcgccccacccaggcatactacctaatcagctaaattccaaactctagctcgtcctcagaagaattttggctaaaaaggaaatgagaagaatcacttggcccactgggccaaggcagatttatatggaatccaggatccacctgctagggatgcctccttgcccagggctgggtagcagctcaggggacccattgctcattgtgtctttcatgttattggacaggtgattatgaaatcagagtaggttcttggaaaagacatgcagctagagctggggaatggtagaaatgccatggagccaggccagaagaagcctcccacaattaatgggaagctttgaaaattggaggagtggtgatctcagccttagaaaaatatgccaataaactatcaaccaacccagcagaggtgctggtgatgagaaaaggaaagaaaatgttgaatgcattcagcttcttgggaatgcattattcactgcctgggtgagtccctgcatgactgtttcccaaactggcttgatcccagcgacctttgaaagacatttattttttctcattgccttctctttttcagaatgggaatgtgctttgcagccgagtcagatgtccaaatgttcattgcctttctcctgtgcatattcctcatctgtgctgccctcgctgcccaggtaaagcaatttgtctctttctttcctagctgtggttctccatttccctcttcacccaactcaactcatctccataattccccagaagggaaacttccagacagataacaataggaacctttaggcagtccaaactggcctctaaatactttttatagcccaaatggggtacattctaggctctaataagttattgggtacccagtaacagatttttattgggcttttaatcatttgaaggtgggtgtcaatcggagatggaaattgtggcccagagattttctgctataagcagcctcttcctgccatgggcagcaggcaccaggagagttgcagcatggcggcatgtgtcttatacaattagtgctggaattgcatccgagcatagcttctaaattatgagggggccattcataaatcaaaggagctgacccagtgaggtttatgacagtataaagctgcctgcctgctgaatagtcacctcctccagactgcagttattatgtacacattgttaagtgtaattctaaggggcagccaggcagagaatttttcacacaactgttaggacatctactttcacgatttgcagctacggtatttgtctgaggcaggggctccctcaatgacactttgttcatgtctgactggggcccgattcccaccccaaaagcgtgtggagtgattcagagaatgcctgtgggcccagtggcaatcctagaaaaagctacttgacactcttgggctttgtgaagtagaagccttatcatcctgtaagttgattccatttccctttagggtagaaattcttgaactagggttcctggatgggcttttgagggtcagagaaccctttaaaattgcttgcagtttttggtgtaactatgtatatttgtaaattcctttagagaacatccgcagctttattgtcagtcccaaaggggtgtacaggaagaaccactaccccagctaaggtatagacggtgctttttaagtggtgaggaacttccagaacttataagagagaaaccaaatgtatccaggcaaaaatgttaggaataaggctgggaatggggttcaatgaaaacccagtcaactgaaatgttccaagagtggagaatttttttttaatggagaagaaacacccaaactctttttgtcactacctttataaaatatattttcctgcatcagtaaatacaccctaatgaacacaggtgattcatttccagatggcagaatatcatgccatatcacaggtttttaaattctgagtgttggtgctgatagtatatgctttgagatgtcagagattgacttggcatatgaccaacctaaaagttgttgggttttttttggaataagtccctaagccaggcttactgtttctgtatgtgtttatttgcttcttcttcctaaactggattgcaagaatgtggtatgggtgggggtgggggcgctctggtaaatgggaacaatgtttctgataaagttgccactctggagagcttctttgttttttttttttttgtttttttgttttttgttttttgtttttgttttttggttaacctgccaggtagcctgtcagacagccttataaaagctttttattcctcagaagtctccaaaagtggtctaatgtcataggaacttatctaaacttctgtgtaaagattgttcttccctgggaagaaggttgaggcatgacccagacccagagcatggggcaaaacaacatagaatagaatatggctgcacctaccccagctgcctaacaggaagcaagtattgagaaaaagggaaagtataagctagcagttattttgagagaaaaataaagtgttaaaagaactgagctcaaaaattccagaggtgaaagcgttgaaagaaataaacaccattatggttaagacttaaaaagctcattttatggtatggaggatagaaataaactattccttttcttttccttcttgctcttgcagctcacttctccatgagttcatttttcttcttgttaactataacctttaacagctctttctgtgggtagtagttctaaaattccttagtccttatatacaaaaaagtgtatttattttacaaccattcttgaatgataatttggctgggtatgaaattataggtgcatgttcatctcccctcagcactttgaagatattactaaatggtttgttggctttatgtttgtttatttgtttgtggttaagaattctgctatttgtagttcttttgcgggttcttcgttttttttttcttctagcttttaaaactttcttcttttcattgatgcacacaatgagatgtgtaagtttgattattctcttcagcctgctcagcacatgattttttcagccaaaggagtcaaatttctcttcaatttttagtcagttttttttttgaaaattatctcttcaccttcttattttttctcattctcaaaattgtctttggtgtatattattgcatctcatttaatttatcctttatgtctcctaatgtctcctttatttttccctcctgatattctccctaaaatgatatattacttcaactctgttctccaattcatgaattctttccatgcatactatttaggccatgtgttgggttttgtttgtttctttgtttattttcaataaccttgtttcccctcaggttttcaagttatttaaaaagacatctacatgatgctaatttataacctgttattgttttggggaatcttattctcttttttacttctttaaagtatttaaaagtttatttgaagtccatttcagattgttcaaatatctaaatatttttagatgtgaattgtcacctttgttgggtttcttgacagcttttcttagttctgaattttccttggttttctactttttctttcaaagctcattatccatgggtgttttgggtttgttttgtttgtttgtttttgtttttgttttttcttacatgagcccttctttgtgggatggttgttgcaggctttatagttcactttgctctaaaccaggtcatatattaatgactcggtttgggctgcctcatgcctgaatggtctatttctacctctgttttcttgtgcactactagtctctgataatgatcatggactgatctacaactgcctcatctacaactgcctaacttggacaatcagtgttttttagggaacactgagtggggagagctatgtcagcccctgtttacatgcgagtagtgtgaccctagtccccaacttcacatgggaagccacttgcaagctgtagtttctcctcagccatttggatccaaactatccatattcagtcccagctgctgatggaccatatggctttggctcccatttattgctgtactttccttctatattttattccacgaagagtttttttgtgtttctgaatataattttgcagttttcacgttttatttatttatttttctagttccacatttcatctctctttgttttgaaaataacagggagatttctcatgtgttctctttgccatattgaaccagaatgcaaccagctattctttctttctactgaagataaaacaagagtaaatagctttaaatcatagcagagaggagtggagcttgacaaaaggaagaactttgaacaccgtggctgttaaatcctagaataaatgactaaggataattttagtctctttacttaatatttctagaaataaaaaggtacccacccatctgagatagagttggcacagtcctgctttgagacagggcaatggatgtgatgactcctctgtgttccttccaccccagtgattattaggcatgaggaaactcatgccttcagggccacagaaatgtttggtcaaagaaaagggctctggttttccatcttaacccaatggaaggcactgtgatgaaaatgtcctcatttaagaagaaaatatttaaagccaagatgatgaataagctccgtataaaaagacgacaaataagcaaactgtataccccagatactggctttacatactgtcctatagcagtattgatttagagaagcttttgcctaggtggtaacagactcagtggaagtgtcctacctatcatgcttagagcttagtttccattgaaggagacagaggagccatctcatttcatttgtttatgtatttcccatggctcttgctttctaaactcgttacccctaaaatttccaaggagcccacctgtatttgaaattgtctcctacagctcctgctaaaccgtggaaatcagagtatgcaggcagctcttccagaaataccagagagaaatctatactgattcccacaaagagcaaataaattttttttcatcagcacttgtccaagtcttggcagaggtcaagtcttagtcacataccacagtgctctactgggcccaaagaggctacatggaggctggaacattcttaatggaaaagtcaagactgcataggactcatgaacgtcattaaattcatcctggtctctaagcaagactctgtggagtccctgataattaagagattttagtgatttgaaggaattaaattccctatcttctcttttgggggaatgaagtggtaatgctggaagggaaagtaaaacaacatgacttattttcataatatgtgtatgtatatatttcataatatatatattttattttatatatatgcacagagagagaattttatcacaaaaagaagaattttatagtgatcaggagtctaaatcatgatattatctaagagggctttttaaaatggtcattccactgagaatttgctattcagaattaataaatttgggttttcctggaggtattccagcattcctgggttattaaagagctcttataaaattgccaaaataactgatttgatctggttaacagagacctaatccacagtgtttccttttggctaggtgtgaaaaagtttggcactatgaatggttttaataggaatagtgacagtgtggtttgccaagagagacaccccagtcttagatattcaaggtaggttagggaaaagaccttaccagtgttgcactatagtatgtgttcccataaggagaatgtgggaagccctgtgtcatttctctttcaacaatagttgggttgtgagtgagctagcaaacacaggcatttctgccacaatacaatatgcacatatctgaaaatcctcacattctacaaaattgtacactgaaaaatcacagggcttaaggaaaaagtagcattagagaaaaccactcaaaacttaggcaactttgtaaccagaatattaacaaagcaactatactaatgaaatactaacacagtttaaaaaggcatcttacatttctaataaaatattacagtaaatatagacttctagacttcaccttttaaaatggtaacattagcttgaaggaacagtgtttaaggaaggattgaagctgctaagttatagagacaacagtaaattgcacaaagatcacggagaatcatgtaataagcacttacaagacagagcatgtggcccaactgaggcaagaggaagaatgtagggcaaatggcttcctgatttcagttgagttagtgtacttggcttttagctgctgtcacttggtagtgcaaaatattaatttgctgggtaatcatgtatgaactaatgcaatttctattttataccaacttcattcccttatttagcactcacatatgaaccacttgtgttacacaaatccacactatagcacagactgtgtaagatgaggtgggtacatggcatttgactgtagacaagtttagagtaagagttgaaaatcacttgtttactctgaatctgcttttttttgtctttaatcactgacctatctgcccttgtgttccccttttctcccatcccatgtatttatattaaaaaggagtctagagtctaggtctatgactatgtctgtctatatctgtgacttccacagttacagtaatcaagtagacaggccttttgtgtttcctccagtttttttctagggaaggttcaaaagagagatttatttatttattattgtggtaaaagatgcataacataaaatgtatcattttagtgtataattcagtggcattaagaacatttacaatattgtacaagtggtaagaacatttaccactaatctagtttctgaaatttttcaccaccccaaaaggaaacctattacacagtcactctccattccccttttcccctagcccctggtaaccatgaatctacttctctatggatttgcctattctggacatttcacataagtggaatcatacaatttgtggccttttgcatctagtttcattcacttagcatagtgttttcaaggttcacccatgttgtagcatgtatcagtatgacatttctttttagggctgaataatcttccattattatgcatagaccactttcgttatccattcatctgttggtagtcatttgggttgtttccaccttttggccattgtgaataacgctgctacggacatttatatacaagtttttgtgtggcatatgttttcaattattttgtatatacctaggagtggaaattctgggtcttatggtaattttatttttaatttattgaggaatctctcttaaattttaaggttgccccatcttcttttagttcatttctttgagtacctactgccagccatcctcatggttgctgctgatttgctgcttttgccaccatccatatctgatctccattgctctcttctctcttctattctcttctgaattctatattcgtttgtctcttggattttatcaaaacagatcaattcctttttaacagtaacagccaattagcatattgttttccctagtaaggtgactacaatagctgtagtgtgcaagatgatcaaccaggagccactcctttgcctgcaaaagattggtatatatattacacataataattacatatatatatatatgggtccagagttatccaaaagcctgaggattctgaaatgttggtgtctgaatagcagatattttgctttattattattattactattttaggttacagaggggctgccaaaggagatgttcacttttgatcactagaccctccatgtccatactgactgttctcttagacccctttaaccatcttccatgccttatttccactatttttctcatactgttggtccttggacacttgacacagtacaaggggttaaaaccttcttcaagaaagtagcatttgctgggtgcactggctcacgcctgtaatcccagcactttgggaggccgaggcaggcagatcacgaagtcaagagattgagaccatcctggtcaacatggtgaaactctgtctctatttaaaatacaaaaaaattagctgggtgtggtggtgcatgcctgtagtcccagctactcagaaggctgaggcaggaggatcgcttgaacccaggaggtggaggttgcagtgagacaagatcgtgcctacccttcccagcctctagtaaccactattctactttctgtttctatgagatcaacttttttagcttccacatatgagtgagaacacacggtgtttatcttactgttcctgacttattttgcttaacttagtattttcaagtctcattcatgttgctgtgaatgacaggatttctttattttttatggctgaataatactccattgtgtatatataccacattttctttatccattcttccgttgatggaaacttacgttgattccatatcttgctgttgtgtgtggtcctgcgataaacatagggatgtagctatccctttaatacactgatttccctttttttggatatatacccagtagtaggattgctggatcatatagtagttttatttgtagcttttttaagaagcctccatactgttttccatagtagctgtactgatttacattcccaccaacagcatatgagttcccttttctccacatcctcactagaatctattacattttgtctttttgaacataaccattctaactgggctgagatgatacctcattgtggctttgatttgtatttttctgatgattagtgatgttgagcatttttatatacttgttgtctatttatatgacagagccttgatacattagtacccattatgaatctaccagagaggtatatgggatgtaacattgtctaaatttattcagccataatacccattttttggaggcactttgcagaattagggttctttgttatgtgcttcaagaagtgttgtattttgccattcaatttctaggagcaatgtatgttatagcaataagctattggtatatacagtatcttagtttggagaagtttgttagggtagtaggcaattttagcacaagaccctaaactagtactactcaaattttaacatgcttaaggatcaccttgggagatttgataaaatgcagactcccagaccctacaccaaaaatcctgaatcatttaggctgcagtgggtgtcatgcatttcacacaagcatcccagttaattctgatgcagtcggattgaggactgcactacagtaatagggcccaggggagattttgagaaaggaggtcaagagaactgcccacagaaagccgttctgggtaagatcttgcagcagtgggatctccagagggctgtgggcaacatgacaacattgtttcgctgataatggagcacatagacactctggaaacacattttccttgtgtgacatttccccaggactaaccctgcagtaacatgtgcacaatgtgccatctggcctgcccctctgctttcccagagctcccacccaaaggctgcctcttctgccatcttccacattcagagtccttggctgtcatgtccagaaagcaagaccctccgtggggagcttccccctctaccccgcccattgttcatgacttgttgttggcgagaaatgaatggcatttctcggaattagcccaggaatttctgctgataaacaaatgaaactctcaaagggaaaagcaatcaacatagtttgaaataaaatcagtgttttcagcttagtctgtttttaacttagtttgaaataagagtcacatctagggtattttaaggaaaggattagcaaaatgtcctgtagtgggcttttcatctgagttgccagactgacccttgaaccagggcctgttttcttcttgagtaagcagaagaggcaattattaccttgatttcctgtgacctgtgattctgagacctgtccagccatcggatcagctttgcccaagcccacccccacttccctgccaagttgcctgacacctgaaattgtcattacagcttaatcttttaaatttaggccttgtcctgataaattcaccaatctttgaaggtagtaaattaactcttattaatcatttttactttcgtctgaacacaggatttagaaagcagattttgattgtagaaagaggagacaggtgttgcggggggaagatcccgaggccactaagctcagctgggcacctgaagagttacaaagggagaggggcctgttgaaggaagggcctaaggagtcaagctttacctaccccaaagtcctgcagaacaccagtagtatttaggataagttctttatttgtagcagaggacacagtggtttctagaatgagttgccagctctcaagtttttcactttagtgttgttaatttaaaaccaatatgttctcaaagtaaccagatatccttgctatctgttgcctagagccaaagagttttacttcagggttttggacttaaaatgactgtaacccaaaaggtttgccagattatttgcagccactaagataagcaattgtctttattagaatgatttttgtctgatttttgtgtttagaattttataccatcagctattccctaaaagtgattttaggaactggcagacttagggtgtcagttattgaaatctgttccaaaatccgcctcctcacaggactccatttttggccatcaaagtagtctattttataaatgtcttgatgtgttgtcttttgtctttgccacatatactctaagacacagagactgggaagtggttcagcaaatatatgtatggctacttacaaagtgttttctagagttatgctcccagaattggagataggctaagaaatatatgtactgtatctctcagtaaagggctaaatcaaagctgtctgcaggagggggaggaagagggctgcttggattttagtttaattgagaagacagagaaatacgtcaaacttgggagttgaggttattttttggaacatgaagataatgtaagtgtccccacaagctctttttcttttcttcaataaattcatcctgttttgatttcttcacattcacaagattgtgccctcagggatctaaggccaaatcagagtccacactcactatcataccttttatataatatattcttttattattttaatagagaaatggatattgagaaggagaggacaaggaaatgtggcatgctttcttccttgttttctttctttgtttcccttctttccttccctcattccttcctttttattttcattctcttttttgtttaatttgtgattattttcttgtgctaaaaatccataacataaaatttaccattttaaccatttttatgtgtacagttcagtaacattaagtgcattcacactgttgcacaaccatctccaccatccatctccagaacattttcatctccccaaactgaatctctatacccattaaacactaactcctcactttctacttcctgtctctatgaatttgactactctcagtacctcatatgaatggcattatgccgtatttatccttttgtgatgggctttttttgcttagcataatgtctttaaggttcatccaggatgtagtgtgtctctttttcaaatggggaagagagagaagaaatttgagaagaggctggtggtagaaatgaggaagtgaagtcaggagacaaccaaagagtcttagaggaatctagcaaatgttgcttttcagaacacattttttctggaagactccagagaccacactgtctttgaaaatgacaggcctgacaagcagtaactagtattactgcctgtgtgaaatgctaggttttgaaagacgtgttccttattaatgttccccagggaacttcagagagtgtcatctattaggagctgattactggcaagttttgtcatctgcttttggagaaatccataggaatagaacagtacccctgtttctctttatctggagaagtacttttccaaaagggcctcttctgcgattgctttctgagggaaattgtgtctggagccattcaacatagctttattagaaagattattaaaggattagagtatgaaacctatgaggtgatgttgaaggaaaactgtaattactgaaactggtgaaagaaagacaggggccttcaccaagtttcagaaacataaatgggtcttagaggaggctgatcagctttctccttccacttccaaagggggagaaagagtagaagtgagcttcagtataaaaaacttaggcacaaaaaagtagttccaggcatagataagggaagctgaagtcattttacagtcaatatattatattaatagctcaggctcaatgctgagtaaacacaagacacacataaatgcacaaacgcatacaatatgattccattaatatcaagttcaaaatagggaaaagtaaactatattgattatggatgtgcataaatgtgataaaactacaatggaaagtgaagaaatgattatcacaatagtcagcatggtggtgagttgacctccattggggggtggtgcttctggggtgttggcaatgcactctttcttgatccacgtggtagtcacatgggtgtttgctttgaaagcatcagtacaactctacatttatgttgtacgtatgtaagttatatttcccagtataatataaagtgggattacattttcatttgttcttgatggttctgattggaggcaaaagtaccagaagaccttgcaagattacaaccaagcataggattctgtatgtgcatatggcaatttgggggactgttatatttgtctacttgtttgcattgttttggtcttcttgatgtttggttttgtgtgtgtgtgtgtgtgtgtgtgtgttttgttttgatttttttttttttggtttttggtttttgggtctttttgtcacaaagaatagcagtaccaaaacctagagaaaggtgtgctccttgtcctctaagtgggctcttggaattagtaagtaggcatttgaggcattgatttctaagctgtagagtgcacagtgtattggcatctggatgaagccatctggctccaggattttatcactgaccagagggccagagggcatgtttggcttccaggaagtcaggctggtcaggaacccctttgggaaggaagaagggctttggacctgtggagtatgcctgccttccctcaaagtgaggttttattgtgttatcatggggggaggaaggcagggggggccaataaagagatggggcctcgctctgctgtccttccagttcactgtgggacattcacagagctgattaacctctttgtacctattttctcagcttgtaaaatgagatgataattcctgccttctcttaaagtttgcattgacagtgaacaagaaagttgatatgggaaattgctttgaaaagtataaggaggtatatataatcaaggcagtgatcagcaatgaaaagaaggtatttaaatcctgggtccccagatttcatctgggcatatctcaatatgggcaaagcctgaaaccatagcattttggtacgtgttcctctagatcccaatgatagcagcctcataaccaggcattgaccatgtgtctccagcctcagggaaaagatgaggggagtctaaaggaaacaagtgacaggtttaatgactgtcaggcaaaaggcattaaattaatggcatcacctctgccttgcctttctatttccttctgattagattttcagaggtgcctgtgtgagtatgccgcacaataatgctgatgttctcaaagctgagtgagctcttaacagaaacataaggtagtgctgagaatgcactcagagacaaggtaaaaatctctagactgccttgagaaattgaaggggatttttctgggggagggctagaactgatacctcctccctcctaaatcataaaaagagagagcaagattcaccattatgtgttgattaggctgccttactcctgtttggttcctaccttctgctaatccgtggtcttgctagaggctgtcatctggcgcctcttgcaggagcacagtgtgtccgtactgcagggggcctctcagaccactgggatcagggaaatgagccattgctgtagtgttacttccaaaccagggaggatcagcacacacacacaccctttctgcccccaccaacttctccagggctttagaaatgtctgggaactgttttgttcgtcacagtaatgggaggatgtcattggcatttagtgggcagcaacaagagatgcaaaatgttccacaataagtaggaacacaacgcatggaagaagtgtcccacacaaaattccagtggtggctctattgagaaatactggacagcagccttagtcagagaagcctagtgaagggcgtctcttcctaaccagaagttggtggtatgagtccacacattcattaattcactcactcactcatattaatttcacaaacatttacagagtataagctttgagacatagcccatgtatggtgctgaggtttcagagttcctgcctcgacgagttcacaatctagtggaggagacacgcataacaagattattaaaatgtaatgtgatgagtactctggtagaagtgtggacaagggctgtgcaggcagagaggggagaagataggcactctccaagagccaggaatcaggcacagtcccagaggggagtggacatttgagctgggttctgacagatgaatggcactttgccagatgtagaagagggaggtggggagggcacgtgcagaggcatgtgtgggatccgtgactgcagttgagtatggtctgtgtaggagggaggaggctggaaatgtcagattgatggaggcccagtctcaaaggaccttgtacatcctgtgggtagacattattttgcagagccagcccactgcaaaagtagggaggaggtgcagtttgtctttagtgttcttggatgtctttttgcatcccctttcctctcttgcagtccctcatatcctcatctctctcccagccacttacaaaggcagctgatgagactccttccagcagaaaggtcaatgcttagcttaactgtaagaattcactaaggatagatttctggatgtcaaagggagagtctttgggcagagaacctggaagaactgagcactatggagatagggcagaggagctttgttcagtttacacacacttgatgtaagtgtaagtgtatgtaagcgtgtgggtgagcatgtatgttggagtgggtgacattgtgtggtatgtatgtgtgtgtgtgtgtgtgtgtgtgtgtgtgtgtgaatgagagagagggagaaatgggacaatgatagttcctatctcaaaggactgttgtgaggattaactgaattaaggtatctaaaggagttagcatagtgccctgcccatagtataccctcaataaatgcaaggtattgttggtattattttagaatgcagggccagaattcagtctggagaagggggaacatgcttactaccaagatggagatgaagattttacactaaggcttagtggctacgtctggctagtttcaaatatgtgcctaggacacattctatcactgggataatataatttttcagcatgttggcttatcagaatgtacatgttcccaagtggagccatagcattacactgtatatatttgggtactttctccatctctactcatggaacacatggcaggtagaaagctgttgttttacaaatgacgtggacctgtcttgaggcccagatcagctgatctgtcctcatgtatagcaacataaaatagaagaaccacagcactagggccagagccagggagatgcattagaaaggaattaacttgggaggatctgaattagggaacaaaagtactagccagagaaggaaggaagaagcaaaaagggggaaaaaaatcactaaaaggacaggatacataagatcatccagctgcccccaaactgaacttacaatgttttctgtgttctctttggaagaggagttggcttgtccagaattcaatggaaacttgttgattgacactgaattgggcacaagttcaatgtgagtgcgcctgcagctatttatttgattttttaaaaatgcaccctttgcagtaagactgtttagtttctactggcgccctggggcagtgagtttagattgttaaaatagcagccattaacactctctgtgttatgacactgtccttcctaccccactttagaggaatcaggcatgaggttgtttgacaaaagtttaattctcctctccccaccaaaagaaactgagattcctcctctgagtcagaggcacgtttgcccagccctaaccctgaaaacctccaagtctgcctacccgcctcaccaccatccccacaaacacacacacgtgactctcatgtacatctggaacacacacactttcacatacactctcacaggctcacacccacacccatcccacaagctagaggaaccctagggagcccttgtgcttgtcttgctgttcttttgttttgctttcctgtatttgctttgttttgatttgaaatcagtctttgggattacattggataattttttcatgttattaatagtgctgtgcagggagcatgtaaggacttcctcctcagtcctggccatgcttgcttccccaaatacaatgctgactctcattgatcaatcaaactgatctttgtcagactttgcatacaatacctcatgggcaaatagctcagggagctctaaaagatgcctgaattctgggattatctagattattcatgagtctgcttaaaaggaaattttttaaggcaggactggatagctatggctttcccaaaggccctggggaaaaatcaaaggagcagagacaatgtggaaagtgtggaactgctcagctcccagagcaaggcaataatctgaccaaacactaagcccccacccaaagtcagcattggtcaggctgaacagccatcatgagcacaagcctaggaggcatggaagggaagttctgtgttctctggacatctgtgatacatgttgtctataccagcactgtccaatagaactttttgcaatgatggaaacattctatatctgcactttccaatgtggcagccattagtataggtggctgttgaacatttgaaatgtgactggtgtgagactgagaagctgcattttaaattggatttaatgttaatcggtttaaatatgaatagacatatgtgactagtggttactgtggtgtatggcacagctttatcccattcgctggatacttctgtgcggcagtgaatttaattttgtacctcctctctgttcagtgtcttgcaactacatcataaactttttgagggcaggaatcatatattgtacaactacagaaagttataccttgaaaagatattttttttcagctgcctctccccatatttgacaaatagggagactgcgaaagactctgtaactttcttgaagtgacagcactcattagtaacattacctgagcctggaacccaggtctccttgcctcccggactgtgcttctaccacatctcccttgcagacaagttttcgaaagaggaagagttttcttcctctccactttcttcactgtttatatctgagattcagcccctgatacttggaaataatttggatctcaagtctacatttatctcctcatctgccaaggcacaaaataggctctggacaaatgtctgtggggtgaaaattctctgaggtctttctgttgtctgttatcttctatatttttaaagaaaatctttttctgcctcagtgtgtttgagacaaccattacttatgctgtttcagcccagggagatggggcctctgtagatgtggccctggcctgtgcaggtgctcaggtatacattagagaagcctgtgcaacagcctggcaggctgataaaaaagctgtagcagtttgggacctgggcccctctgtcttctaaattctctagacttgatggtagacaaggatgccatcagacatagcgccctcccttcaccacattttcatagtaacctagaactaaagatgcttcagggaggagtctagggccatatcttactggttactttagaaagtaagagaaaatacccagtagaaactaacctcagaatcacctgctaaaagaaagaataattcaacttgtaggtccaagtaaagtatcctttcatctctcttctcctttctctgttttccaccccaggcctttgccctcaacccagagccaacctatggtaacacagcaatagctgaattgaagcaaaacctgttaacagtcaccaaaggctgagtttcggccaagcagatagctcctccaggcagcccttcaaaagccaggcagaggcaagggggtaaatagcctgtggcctatctgcagtagaatggccagatggtttgctggtgccaccaaatgaaggagtgatctggtactaagatagaaggcttccagggaccctcccagccctaaaaatcttaagcccaagtgtagtcatcagatgccaaggacactggagaaagtctttggagcatgtagaacaccaagccaattggagtgcctgctaggacagcacaggattcctagaattccggccacaccatatacacccccacccccagagggcagccagtggccacagcagaggccttacccagcaggctgagaccctcatcagaccctccaagagcctacttccttacttagggcctgcctgcttgcactgtgctgagttcagggaggtggacaaactgtacctcccactttagcctaagaatctgacttgccatggactctccaggcagtgaatcattttgagcaagcacttaagcaactttccactgagtcattctgaggactgtcaggtttgctaatcctgatatatactgtgtataccctttgttcagatcctatacccatcctgatattggaggagaggggttataaacaacagaactttaaggatgtgctcattagaagtcatttgtattagggttccctttgccctactgactctaacagggcctgaagcactaagagaaatcctgctggtaccaacttttgatttgtgtatgcttttggttacatagctatcaagagtatgtactctttacctggagtggcagtgcacattggatttcttttccagaccctccatggatctgttttcctttggcttcttctagactaggggccagcatttctttttttctgtaaagggccaaatagtatatatgctagcattagcaggccttgaagtctctgctgtagcaactcttgcattgtaatgtgaaagcagtcataggcagtatgtaaataaatgggcatgaatatgttccaataaaactttatttacaaaaacaagttgcaggtcatatctggcctataacccctgttctagacacaataggctaagtcaaattagtagctgagacttagtttcagctgctagagtgcttaagcatatcacattggggaaaaaatcactcttatcctccattcttttggggaagagaggtagaaattgcaggaatattttcatctttcccattttgaatatcaaagcccattcctcatcaaatattacatactccatagtaatcagaattggctaaagtatgatgcagtagcaacctacaaagttcaggacttaaaacaacaaagatttatttcttactcatactacctctttgtcttaggttggtgcctgtcattatcaccaacagactctggctgacagtgccgcaccatcgggaatttagttccagcactatgggaagggaatataacacactgtggtctggctgtttaagacttttggccaggagtgatacagattacttctgctcatctggcattggccagagcaagtcacactaccatgacttgacttctacaggacagggaaatgcaatactaccatgtgcctggaaggaggagaatttgaatattgatggaaagccctaatgacaatcacacactctaagaactccttttcagtttcttcttcatgtcattccttgcctacctttaggttatctggcctagttgtatcttttgtccaaccctacctggccttcctcagacatgctggtcattgacattgatacatgggggagggacaacttagggactaaagcattgggacagtaattattccctaaaatgctgtgtagaccagcatgaacatgaagtcaggcctcagagccaggtcttacatgccgttggatccaagggttgattgccattgggcagcaagcctgagaaaaattggacctcccataactctggttttgatttcactttagtttacttttaatgagaatttgaatcagagaggaagttctaagcatattgactttaggcagtgccttcccttagtgctatggagagcagttatcaagagggaagaggaatatggaatgtgaaaggtagaaagtataggtgatattaatgcagtattatgggctaaagtgaaacatatggcccatgattttagaagaaggaatatatctgcaaagacaaaataattagttgggataagcccattgctctaacaatccccaaatcttagtgactaaagacaatgaatgtgggagtggaggggcctatggagagggagggcttttgctccatgcagtcattcagggacccaggcccctttcactctagtggtctttctttcctctagagtctcacagttcatcactggagcctctggtatgtggtccttagtttagggaaaagaaagcaaggagagttttgcaggacgttttataggtcagtcttctaaggcatgtttatcatttcttcccacattcaattgactggaactcattcacatggctccacctaactgcaggcgagactatggaatgtagtgtagctgggtgccaggagtggaggatggagatgggtttaatgagcacacaacattgtgtattccgctgcatacttgtcttgagcaagggtgattttttgtaggaagggttcagtctgactgagtcttaactgaagtcttcatcaacatactctcaatattgaaatgttttccccttacagagcactgtcggccttggttgaacagaagactagtcctgactgcagaggccttagataaatgcaattttgccagtccttacattttacttcataattcacatggcctctggacagatatgtaagagcacttgcattctcattggtacaggtttgggatatgtatcctggggcaggaacgtgaaatagatgacattcaatggtatcgtgagcaatgatcctaggaaattcattctgaatcctaaactgggcgtaaaccattcttaaaaagtaaaaggaaaccattaaaattggaactacataactaatctttgttccatttttggcctggctaccagggcattcagagtcctttaacacactcacatagaatacatagaataattatgttaatcctattcattgtttttttttttttttgaaggagtctcactctgtcacccaggctggagtgtagtggcgcagtgtcggctcactacaagctccacctcccgggttcacgccattctcctgcctcagcctcccacgtagctgggactacaggcgcccgccaccacgccgagctaattttttgtatttttaggagagatggggtttcaccgtgttagccaggatggtctcgatctcttgaccttgtgatccacccgcctcagcctcccaaagtgctgggattacaggtgtggtatttcttatagctacttctcggttcaggtgttttctattttcaattacttcatgatatatgttgtttgttgagaacaggagaaaaaaataaggcatggcttcttcttgttttatttaggctcggtttgaagactggcatttgtgaaaaagatttttctgtgtctatcgtgacttcctgagcagttggttttatatggtgtagttttggagatgaacttcagctgaaagaaaggctcaactctaagtttgatgtgagccaaaggagtgcatcacctcttcaaggacagctagatctttgctgtctaatctaaagctgttcaccagaatggagaaagcacttttatgttccttttctccctagctatatttcaaacatttagggattagatgatttgtatctattattttttctagtccagagcttcgcaaacactttggggccagataattctttgtcatatcgtctatcctgtgcattgtgggatgtttagcagcttctctgacctctacccactagatgccagagtacccttctcaactcgtgacaaccaaaaatgtctccagacattgccaaatgtcccctggggaaaagttggccccagttgagaactactgtagttgtaaatttttttttaattgggggtagataccctcactttcccagaatcctgttctgtatttgacatttcttgcagagatgggagttggaaacaaaggttatggatgtcagggagctcagttctaagattgcctgcatttatacctccctggggtgtggactcaggccatatggaacaaatatgacatatgtttgtccagtacgggcagtaaaaaggcttctcaatactcattaacctttgagaagctgacttgtttctacagcattattgaaggttctgaataagatgaactcttagaatctgaatcactgggaatcttcctgaagtgcagatgatgtttcagtaggtctggagtgtgggtgtgagattctgcatttctaactagctctcaggtggtattaatgctgctggttcccataccacactttgagtagagggttggtggtctctggagaagaggagctggctaactagacactatttttaggttctgcagaaggaattgttctttccaagattattccattggcccagtaagtagtgaagtaatctgcagttcttaaacattccctccttctcctctcaagaaggtacaacccacagtgatagtctccctgctctctctttcattctctgcagccatttaaggctaatatgaggtaagctagtcaagtacttccttttgattagctaccttatattttttggaccttctgtgtgtccgtgtgtaagagagagagtagtttcctttccagaggaaatagtggggataacttcggaaaagccattacagtgtcagaaataggtggctattttatcctagctggagtttcagataatggaaaatccatctctagaacaatgtagtatagctccacttctgggatcacttctggttggccacttcctagcctttgtttcctcatctataattgtagataatagcaataatcaccttagagggtggacatagggagaaaagaactaatgaatatcaacctgaagccctgagcacagaaccagctcagtgtaagcatgagccagtaaatattagttcctaatcttattggtgtggttattgtcattattggaactgggatcctcagactctttttgcctctaaattgtttgcatatattgtactcctatcagtgacatctttcatcatgtgcagtgattctcaatcagggatgaggtggtatgtggagtttgaaaccactcccaccagacaccatggtctccttgttcctcttttgagggttattggtctaagcaatgactgaatctcatattgtttttccagccttggtaagtccaaagatgataatataccttatttatttgtttgatctctgacccctatcatcacttttcactctaatcactttaatatgagcatctggctgccaaaagaagcccagtttcaaactggaaatttttattaatatttgacatatttttacttttcacacctttctttcctaaggaattgtcaccatcccatggcaatcaatggtggagttctttagaatccagatttcctaacaccttccctttcctttctgtgtattgtgtagtcttaactaaataactctccccacatcaggaattttggtctgggttcttaaagaatttcctaggagaagcaaaatgatactttgtcttttcctctagtagttccatgacatggcagatgagctgcctccttggtcgtcaggaagaggtagactggattttcctaacagcgttcccactgctccagcagcctggagccttgtgtgccaccactttccttgcaccctctgccagtggcctccagggaccactttctgaagccagctgctaacagttttccaaacaaaataatatgtgcattgggggataacttttctcaattaatcttcaagtaccaaatgcctcttttcttcctttatgcctaatgtgatagcaatgggctctttcagtcacctcctgacatatcctgtccccgagctcattatctcttttccagtcatctcagaatagtttttcaaaaatgtaaatctcatcaaatcatttcactacttaaataacttccctggcttctcatcatatacaggaaaaataccaccccctggacttgacttctttgtgtctccaggtgcctgatgtcattgggctgttgttgcaagtggttctggttattagcactatacagtatttcacaggggagcattttctcttgatttatagggcttgctaatgaaagaaaagatactggagatgctatcagccatctaggagtaacgtgttaggtcttagctgaaggttgagtgtgactgaagttgggagtgcggttctggattcagcagataatagtgtccatgagatggcgaatatccagatcctcaaaatatctaggttttgatgtggtgcagggcagtgctttccaaggagtgtttctggggcattcatagttgttacctaggtgaaaaaaagagtctggtggataagtaaagtcagagaaaatgctgagttatcattaaacaggtttctttactatgggacttgtgagatccttttaacatattgaaagggacactgaatgttgaatgtggatcttttcccaactttatttaagcacagaattttgttttcacagagcatcttgtggactagtagtgctctgcagagcagacttgggaaatgctggtgtaggcaatacaaaggaatgcttgactgaactccccactgtctcatccagatgcctcacattgtttctgtaaatgctgcttgagggtaatgactaatttgtccatttcaaagggtcattgaccttcaaaaaaaaatctagttctcaaaggattagaactaaccaagtaatagtagaactcattcttaatttattcagggagaagaggaaggcagtgagtgacaacattaccacataacctgttattaacaatgaggcatcgtgaagaatcattgatttaacattacacctcctggtaattagaggtttttaaaacccatagtacagtagcaaaggaataatacaaatctatcagattcaccatggaagggattctttttgttgggctacataatccaagttcacatgaagatttgaggttgaggaattagcctctgaaaacagagggatttgtgttttatcttccgcaattattagactggattttagtgggcttctctagccctcacgttttgctgctctaggtaaaatgaagagacctaaatttgaatctttgctttggcactaaatagcagtgtccccttggcatctctgggcctcatttccacctgtcaaaagagaaggccatttccagtttcctcttggagatagaaccctaggaggcttatgtaatgagattggaatggtccatgagctgaataatggagctgatgataaagctgttcagtaaagtggaagaagaaattttgacaggaaagaacatagaggttgcctctgaagactggattatgagaaacttccacaagtaagtactctcagcacacagaaagctgaaaacaagtgtgcataaccttagagccacagaatctggacagagttgtttgcagagatctcatactgctgaagtgaaatcctcagcccccctgctttgtatggcaatagagagggtacttcttttgggtcatgaaatcctgagaatctgattgaacccacagacccttttcccagaagaaatcgattctgtaactcacttctgaatcacttttgaaaatcatacttatttctctccagctatctgcccttaaatgaagaatcaccttgcctctagatatgcatatttatatgttaatgaaattaataccagactcttaaaattagcatgtatcactatttgaatatttgttccttcttgccatgctctgttccttttttttttttttttttttttttttgagacagagttttgctcttgttgcccaggctgtgcgatctacagcacaggctgtgcactgcagcagtgcaatctcggctcaatgcaacctccgcctcctgggctcaaccaatgatcctgccttagcctcctgactagctgggattacaggcacctgccactacaccaggctaatttttatatttttagtagagacagggtttcaccatgttggccaggctggtctcgaactcctgacctcaggtgatccacccacctcagcctcccaaagtgctgggattacagtcatgagccactgcgcccagccagcatgctgtgttctaatgctagagccagcaggagatagagaagtagaaggcatagaccctgtctcctttgcacttattgatcacttaaaaagcggcacactttatattaggtgctagatggtaggatgcaaacaggcagaccatgagagttgctgcagaaaatcagagtgtgtttgatgggccctgggggctggatatgagtaagcaaagagtagtctgtgggggcagttggggctagcatgagtcagggcagaattggccaatcagaggtagagcattctttagccaagtggcacatcctcaggggatacatctttgacatgaacttcatgaccctggctgggccatgctgtggtgtgggtccgtacatggaactccagtctttggggtgtgcttactcacaagcagttgactgacactgcaagactagagttgctacctataaggcagcacatcacaagctgaagggacttttctaacttctatgggatgtagtaactctggacactggaccatcaaagcagacaaaattatacatctctttttgccttcaggtagaatgcatttggtaagcagggagataatcataatcagttgactttgttgtatgttgcttctttactccctgaatctttttgaaaaacataatcatttttgttctttataatatatccctgtgaaagagaagcaggtgaaatgattacctctgacacacacatacacatatccacacagaaagttctttagaaactgaagcctagagatgcaaagtgatagcagttccatcacacagcaaacaaatagtacaacttagctaagaatacatgggccctccccctgccccccaaaaaacccccaaatctatgccatttgcaagcactctttgcttcacagagacatggccctttcttgcacactctctcctcaagccatccttcctagccatctgtctgacaagacggcatattcaggcagggtcagctactgactgacagcagctgaaacactgacggaagtgggatgaaaaacagcctgcagatggggtccggatgaggagggggagagctgggattagactaggatgtgagctttcagcgccctcttccactctcttctcgccagctggagcagcagatgactgtttcctctcactcggcaccttcttggttgggacagagtgttgtgtctgtctgtttagctgcagagtgatctgttgaatctgctacaagaatttcctggcctgggacctcactgggggttgggccaagggtagaagtagggaggccactagtcttgttgaaggtgtggtcccacagagtctcctggaagctttcaagcaggaaaatcttccccccatcaccccctcctttagctgagctgtctggctgacccactccatctcccaaagtggatacaccacggctggggacactaggcaaaattatgacttgagattgactccctctacccatttgtgattctccctttctttttaatttacctttctcttcttcaactgcctatcacctacaaaacaccttcatttttttcaggcccgctccgctctgatacccagtctttgtgtttgtattgtataacgtttggaggttattttttttttttggtaacgctttattgaggtatacatacctcatactgaggtttacatactgtaaaattcacccttttatgttgtaaagttggttttagtatatttacaagatgttgcatccatcaccactatctaactccagaatattttcgtcatctctaaaagaatcccatacctactagtagtcactcccattctccccttcccccagctcctggcatccagtgttcttctttctctctctatggatttgcctattttggacatttaatgtaaatggaattatacagtatgtggtgttttgtcactggccttttttttcacttagcagaatttttcaagtttcatccattatagcaataatattacattttatggatataccatattttgttcatccattcatctactgatggacatttgcattgtttccatcttttaactattatgaataatgctgctataaactttcatatacacatatctgtttcagttccttctttcaatttttttgtgtatatacctgggagtggaattggtggcttatattggtaactctatgctcaactttttgagagactgctagattatcttccaaagcagctgtactattattatttttttttacattctcaccagcactgtataagggttccaatttctccacctacttgctaacccttgttattattgtcttttttattatagccatcctagtggatgtgaaatggtatctcattgtaggattccccccaatagcgcctttctctttactggggaatagttccagtcttgtgtattcatcactgtgaagatattaaacctctgggaaagatagggcccttctctaactaatgattgaatctgggggcatatcaggcattctggcagggtggagaggaagagagtttagggacatggtgaacttgccacctttggaagctctaccatcgcagaagcaatctgctctattgattgctttcccttcccacaaagagaccatcaagtgcagaagtaatcaagtgaagttttcttgaaaaggcaagacaagagctgggcaacgaagggtgggaggccaaaggatgtatgaagggggaaatggagaggcttcctaaactaaaaaatattaaatcctttctgaaaagcaccttcagtagtgacctaaaacaaagatgaaagtcaaaccaatcaacaattacttttgtttagcaattctggaaaacatgttgcaggagaggacactggaaatgatggttaaaatacggtgggagccatggcagttcaagcctgtaatcctagcacctcaggaggctgaggcaagaagatcagttgatcccaggactttgaggctgcagtgagccatgatcacaccactgcactccagcctgggcaacagagtgagaccccaactctaaaaataataataataaaataaaatacaatgggagtgttggccaaggagttcactttttctctctattccatgccctttaggactactcataatcacaaatacatttgtgacccttctgagcgtaaatccacctgtctggggtgctcaataagtccaaagtagagtctatgtgcttggtaaatggctctggctagaaagcaactgcttggctaaatcacacctgacggtcttcccactgagatgggaaaatggggcagatagtgtttgcccaggagctggggcataaaaggattcttagtggatgtgatggctcagaagtgaatctctagttaccacttgggatctgacagtttttgagaagttctacagggctgtgaaagactgcacaggggtaaaaacaaaccttgtcattacattacaggtgttgagaatttctaaaatttacagtatataatactgattgaaaagtaaatgtcactgctactttggagttcagcataagccttatacagaggcagggtctgccagtgtggtaagaggatggccactgtaagggttaagtagccccacatctctttccctaccagcctgctttctgccctccagaaaccctatcatttatagctagtagtaaaagaacaacaattgcatttattgggcattaatatgttcctggtactatgctgaacagattatgtcttaccttgtttgatcatcccaacaacctatggggtaggtaccattatcatcccaattttatagatggagaaactgagactcagagatgctaagaatttgctcagctaataagcaataattagcaatggagctttaatttgaatccaaatgggacactctgaagtaaggcttctcctctccctaggacaggtcttggaagctgcatttttagcaagttccctcattcaggtcttaagttctagaaagtttcacactctttacccggtgctctacagcctcattatgaataaaacatcaaaggcctatgttacaatataattatctagaaaaggaccctgttttaaaacattatctaccattttcatttcagtatgaattacttaacgggattagtattaaggcctgccagcatgacctcaatgtgatgggccacaggagagttaagttcttatgggggaggagagtttggggaaaatctagaaatcgttggactctacccgaggaaagcagatctagttaagtcatcacatcaagaggcccaggggaaaaagaagtgatggcagttgaagtgctgaaaaaaaaaaagaaatctaaaggtaggcatcattgattcaactgatgggcccatttgaagcagtacctctgatctcagggagcatcccaaggaaaatgtcgtctgaatccacatagcctcagaatatgagcattgttactttttggaggtggggggaggctgcagacacccactcttctttgtttttgtttttgttttgagatagagatttgctcttgttgcccaggctggagtgcagtggcgcaagctcagctcactgcaacttccacctcccaggttcaagcgattctcctgcctcagcctccagagtagctgggataacaggctcccgccaccacgcctggctaattttttgtagaaacggggtttcaccatgttgactaggctggacttggactcctgacctcaggtgatccactgccgtcgcctcccaaagtgctgggattagaggtgtgagccactgtgcccagcccactgtttttgatacattcatcctgcaagatgtgttgcatcctggatgtatgctcttactttgcctgactgagatgcagctagctcccagctgctcctccctccattacagcagtgctctggtagaaggccatgggtgatttcccactagcaaccttatttgtctatgttccttccatttgggccaaggactaaaagccagctcagatttacacaattactttaacattgtttaagaaagcaatgtaacaacctccactttgcccagatggacgggctcaatgatgtcggtggagagaacccattattggaataagactgggaacacaaagtcatagctaggatctctcccactagtaggaatacagccgggcttctgatgaccagctttgtaggattgattttctatggttggaatggacccaaaatgttcacctagtctagtctacggccttcaagtagaagttttttcaaacgtagtcttcaaatttaatgaggaatacatttatatcattcaagaatatgaatgcatatgtatatgtacatgtatatatgattatatatctaggtatacatataaaagaatgcaatagaatatcttattcaccccgtcccacactcacccaattcttatcttctccctacaacatgtagttcccccccataacttttagtggttatatatctttccagatttttatgaaaatgtaagcaaatatgaatatatatatatattttaaaaatattttttcatttacataaaaggtagtctattgtgcacatcattttaccccttgttttcatcatttaataatatatctttctgtattagtgcacagagaacttattcttttatagaactacataatattttgttataataatgagccatcatttatttaaccagatttctatcaatggacatagaagttgtttccatattcagccattacaaacaatgctgcaatgaataatttttatatgtttcacacatgtgcaagtatatctgtagaatgaattcttaaaaataggattgttgggtcaaatatatatgtatttttaaatgaacagatattgctaaattgcccttcatcatgttttaatcaagtcttcacagacttaccaagagagtgttttattcaaacttttggatttttctaaatctgctaagaaaaatggtatttcattgcagttttaatttatatttctctaatgaatgaggttgattttttcatgtctaagggccacttgtagttccatttctgtcaactgtctatttatatcctttttccatttttaccattgggttatgaatctgtttcttgtcaatttatagaagctctttatatattagggacaaataggattttaatccccaaacagcaaatatgtgaagagattctattccagtgttttacagtgtcttatggcagcaaactctttcttcaaatgaaatttaaaaaagctaataaaaacacatttcactaacaaagtaagaggtattctgttgaagtagaaatggggaagggattttttttttcacatccctcaagtacctctgaagaatcctaaagcagcacagaacctagtttgaaaataatttccctacatgcctagttggcctgtggttccagtttctaataactctttcagcaaggaatcttttttagtatctaacctgaatccttattgatgcagttgatactcctccccacttaacattggcaatttgtgattatttgacctctcttccattatgaacctttatgtgttatttaaatacattatcatttaacacctttttgtgccttcccctccaatgaaagcaggattttacttgaagtcaggggaatgtcctatttatctttgtagctttaaggtaacataatgccaggtattgtcaatgtatagtcaaggatctattagtgccaggtatagtcaaagacctccacaagtgcttgttgaatgaataagaaaacaagagagaaatagtgttttgactcatgtctccatagcacctaccatacacatcagtgcaaagcaaatgcctttcagttagttatcatctatggaaattgggaaaattccttcatattcttcaactttactgctttcctctctgtgacctctttctagagcaagatcatctaccatttattgtgaatgttatgtaccagatacctttgggctttttaaaattaattatcgctgaacctcacagccacgtaaagtagaaggcatactcaagccttcctaagatcacagaaccaagacatgccaaagctggtgtcttagtctgtttgaactggtataacaaaacaccacaaactgagtagcttataaacaacagaaatttatttctcacagttctggaaggtggaaatccaagatcaaggtaccatcagatttgttctctggtgagggcttggcttctggttcagtgatgataccttctccctgtgagcctatatagtagaaggggcgaacaagctcccacaggcctcttctattaaaagcactaatctcattcatgaggatgttgcccttataacttaatcacctcccaaaggccccatctcctaaaagccatcaccttgggggttacgatttcaacatatgaatttcagaggcacacaaatattcagatcatagcagctgggaccccagagaccaatgtttgcagaccccagagaccaggctcagttatcttctcttgcatcactgtgagatacgcacatagaaacagcatcctattctaggggtttctttcaaggcctttttgtcattctctcttcccatatatttctgagacttggggtaaagccctttagatgatgtagttttactttgttggatgtgtatgtctctctgtgtgtcatgggcaattaaagggactataacctcttctttctagtctttaccttcatttccatgtcccttctccagccacctcccaatagcctgcaaatgttctaggactctatcagtagaatgacagagaaccaaagaaatgctagcatcaggctcagccatcagaagaaaagtaggaaccaaagtaatggcagcaatggcaaaagaaaagatggcttggcgtcaaggagattagcaactgatctctgaaagctctggggaggtttgtatttataacactgggagcagatttgtctcctgacatacaagctgcttttctgactatccaagaactgtcctactatggaaatgatcattttatagggtggggagagtggggaagagagcagtcagcatgaggacttggttccagagtgtgggaagaagggtaacaccaggagaggagggaaggcgtacaaaaagaagtgaagtggaaccacaggcttcttggtaaaatttgccagttgctctgaaggacaaaaaaaaaaaggcctgtggcagttattcagactgaggtgttagttagtgacaaggtgtaagtgtaccctctcatataattcttgggattacaaaatctgattgcaaaaggtagccatttaacctagaggaatggacttccaatagtggcattttaagcatcagtgtgagaaaaggtggtaagagacatttgggataagggggtattttctgagcatcccggaaatcatagttctgcttacatatgagatcatccctcacttggggagaagaaacctcctctttcccaacacatctgtggtcacatgacttagtgcttgtctgctcaccctacaatggttttttctccagtcctcctcttagtgctaggtgggaatttgactggaaacagaagagatgggggaggttagaagccacgcagcctggtcattcctattgtagcattccctgaggggccctgtagccagctttgctttgaactgattttctgctagttttcagtcaggaacactgaatgtgttccaaggatatttgtttactagcccagccaccttggaaaatctgggagaggagaaggtaaaatatgaggtggtttttcttccttctgcagttaggaagcatgctgtgttggccctctaaagatgcaaggggagatttgagtccatatcgcattcctagaaatattgaagcttaaagaggtaaagtgccttgtacaagattgtggggagtcagtaccattgagttgggattgtgactcagtgatcctgctctgaagctttaacacccattctgtgaagagcacaaatttgaaagcaggaaagctatatttctgagttggctctcttgttaaacagctgtgtgacatgggacaaatcttttggagtactagtagcctcattttcagtaattcgccccccacccccgagatacacaccattaagggtgttgcaagaatgaaataagaatgagatgttaagaattttattgcataaaactagccttaagcatgaccataattggtttctttttctttgattctactgtgtcttcctctctttctctttctccctatctcctgttgagtagaataatagactccagtgccaggttactcagaagactattgcaaggaagattctcaagatcattcttccactggaaaatctcaccctgcagttgccttgccattgattccttggtagaaggcccggttcaaaaatcaagccacattcttttgaggcaaaataattccaaacttcttttttgttgttgttgtttgtttggtattccaaacatctgccagctcccataagagccgtgacaaatattattttgtaggtcactgtagatttccttcaccacaaaatgctgagatttggaataattagagcccagggggcaaatgggcctgcttctgtcctttctctgatgggtttcactcatgtctgccagctgcagctgtctgattgtatacgcttgtgggcaggggcagggcctcttagcccagacagagttaattagtatgagttaaactctttctaggagctaaggctgtctttataaggcaaaagtaaggaactttctttatatcctctaaagggtcattaataagtagttaacaccctgagagtgaattactcagaaattgatgttagatcgacttatatagcaaagtatagaattgagttagttacccaaatcgctgaagccaaaagaagtgcattgtctgttttctgggtattttaggccacaacattagggacagcatagccttcatgttctagtggtttgggttttggtttttaattaaatggtcccttccttattataggtttgaagtgattggcactttttttgatagtggttatgagggaaggttctagaatcagtcagacatcaagttatatcttagtgctgccacttgcaagttgtgtcaccttgggcaagtcaatctcttaagccttagtttcttcatctgcaaaatgggcataatcatgtctacatcagaacattattagtaagagccaatgagattatgtatgtaaaagcactcattcctgcctggcacatagctagggcttgataaatggtatctattcgtgtattattattattattatggatgttattattgttagccttatcattttcactacatactgagaataatttcattctttttgcttgtttgtttgtttgtctgtttgtttgttttttgagatggagtctcgctctgtcgcccaggctggagtgcagtggcgtgatcacggctcactgcaagctctgtctcccgagttcacgccattctcctgcctcagcctcccgattagctgggactgcaggcactcgccaccatgcctggctaattttttgtattttttagtagagacggggtttcactgtgttagccaggatggtctcaatctcctgacctcgtgatccgcccgcctcggcctcccaaagtgctgggattacaggcatgagccaccgcgcctggcccattctgtttttttttaaacagttgtattgaggtataacttacccaccacaaaatagactcatattcattacagttttgactgatggaaaagaaaggatggttcaactctctaagcctctccctaatgaaacacacagctcccctgatttctctccttccactgtcttatggcaggcactttccaagctctggttgtatcttttgttggtttcaattccttttttcaccactcactagctttgtgacttcaaataattcacataacctcagcaatcctatttccctcaaatgaaaatgaaggtaagaatttaccctacttgattcacagggttgttatgaagctccattgtaataatatatgtgaaatctctttgtaaatggtctgctgggttactataattcacaaatatgagtttcaataatattcaaatgtcatattgtgtgcttcagacattagatgccttgagagatccagattgtggctggagttatttagagaatgcttcgtggaggaaaggcggcataagctgaaccttcaagatcagataggacctcaatgggtggaaaagagtcagggagtgggcagtctcggtggagggattaaaaaaaagcaaaaccacagaggctggaacaaacagataagcacaaaagtgatttaaaatgtaggcggtggccgggcgccatggctcacgcctgtaatcccagcactttgggaagatggggcaggcggatcaattgaggtcaggagtttgagagcagcctggtcaacatggtgaaaccccatctctacttaaaaaaaaaaaatagccaggcgtggtggcaggcgcctgtagtcccagctacttgggaggctgaggcacgagaattgcttgaacccaggaggcagaggttgcagtgagcagagctcgcaccatgcactccagcctgggcaacagagtgagactcagtctctaaataaataaatgtgggagggaataaagttaccagggcagtataatagatgggtccccttctgaagcaactgggggaaaagattaaatgagatagcatggactccttcctttcaggaaagataatatcttattcatctaggaatattagctccatctaggcagggaccttgtccatgttctctgatccctctctaacacatattacaattcctggcacatagtaggtgctcagtaaatggtcaacaaataaaagaatggatggatggatggatggacggatggatggatggatggatggatagatcataatgtcagctgctgtacttgtctggctgttttaacattattcaaaatcattggtcactggagcggggactgtcttaaaactccctctatgtagtacagccccgtctgctgttgggatttatgaaattcttgtcaatgatgccaatactcagtgtggtttttctccaccctgttctagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggtaagaccctacatcttaacattcctgctaggccctactcaaatacaagagcttcctctgtacttgtactttcatttgtgcctgcactgtaaggtgtttgaataaaacatgacttgcattaaatcataagcctccttgacaatccaaactccctgatcttcacccaccctgaacaactctgttgaagggctcaggcccaatcatatcccagtcttaaagctgtaggactgcttaaatgggcaaaggtgagctgtttgtgttgatcggcgctccttttcataataattataccaccaaagcctccatctgaaggactcacaattatttgaagctttgggaatgctatgggtggaaaagtcactttgactatctagggccactcactccaattaacaagaaaatgagttgtctgttagttcccatatctgaagtattttactaaccagttaattcctagtgccctgcaatgagaaaactctctataaatgcttggtcatgatgactaccaggacattacttgtcagaagaactgcatttactttacaaacaacgtatactaattacatcttatctaatatgcagtccggagaatataatcaatagaactagaaaatggagtaaaatgagtgtttaaactgaagcaggaaggaatgaagttagatgtagtaacaacttttctgcctgcaagtggcattaagcactggattgtcaagggaagctatagaatctcttccctttaggacttttagtaagaatatagtatctcagtagtttaggagaattttcgtgtggccttgctttcttaatggccttccaggaatcattctagccccaaaagaatgtgcttctaagaactaagaacaaggtttaaggaataacatttgaaagatagaaatttaggaaatcaggattattgcaaagacagatgtaaccagcaagtaaattttatcctctcccttgccttgtgctagactgagctgtggccatcagatcatcttgtatagttttgtattaccccagagagcttgttcctttggtttggaagggagagtctagtgaatattacaaatggaagctatgaaataaatcttcattcctttaaacccccaatccagctgggggaccaagggtaccatgaacagagaagaaagaaacaagactataattcatggttcagaggctcatggcatccctgacagactactttgtaccaccttagaccatgatgctcgactaggattgctaacttttctgtggcttagtctctggcatggaggaattgtaggagaaaaaaaataatgcgtaataaaatgtaggaagtaccgagaactgacgatgggagagctggggggaaggacatgccgtgttttgagtccctgctctatttcaggtattaagtgaagcctttacacttatcctagatgcttctaatcttaattctgtttctccttggcaggagggaaacgtgtattgtggtctcaagacttgccccaaattaacctgtgccttcccagtctctgttccagattcctgctgccgggtatgcagaggtaggtgtgttatatcccaagacccctgggtgctgctatcctgtgtagtagaatttagaaaggaggaaaatacctgtctaatgtcctagggaaaggtaatttttatggtagccttagtttttaaaggtggtttaattaacaaagggaaaaataaataaagcattgattttaaaggccacagcctttaaaaaaaaaaaaaaaactacaggatggagtgctgtgcttcaggggaggatgggaaagagtcatcaaatgtgaaagtgaatatatttatttctccatccttaatcccttctagcttggcccttaaattattgtatcataaaacacagactattttcattcatagccttagaaggaagaatggaccttgcaaggaattgatgtggccattttgaagactgtgcagggcaaatttaggtatactttttaaaccccataataagatggtgacaaactcaataaaagcaaaacagaaagcattttctcaaattatattcaaaattgaattgtcttctcacattagtctttttttctttaggttttattttttttataatggcaccagttttttcgctaggttcctgggatcaagtgtaatcccctttaatttctcctttgttacctcttctcagattaccaaatctttcagcagttatctgtatctctcccttttcccactttcccactggcaatatccttattttgtcctttttccttctatccagtcaacatattttttgaccatctactgtatgctcagcattgtgctagaattggggtatttatattgataaatacagtagatatatagggtggtgctagaccatatggcatctttatgtgagttacaaaaaggattcccttacataagatactttattgccatttttcagaaaatcccagggaaagcacctttgtagctgtggcatccttttgcagcacacaacctacacaacaatatatatagcatacatagcagccaagatatgttctttgctcttatggaactcaccagaaaagacaaataataagcaaacgtggaaatacagataatgcaagtactatgcagaaaataaacataggactgagattaaaaataagtagtttatttaggttgagttgtcaggaaggcctctctgagaaggtgacatttaagctgagacctgaaagataaaaagaagtcacccatgcaaagatcccaaagaagaacattctaagtagagagaaaagaaagttcaaaggccccaggcagggaagagcttaaagcattcaaagagcctaaggaccagtgtagctgaaatgtagtgattgtggttgaaactgacatgggatgaggctgaagaggtaactaggaattagaccatgcaggattctgaaggccatgggaaggattttggatttccatttttaatacattgggaagctattggaaggttgtgagaaagagtatgaagtgatccaattaacatattaaaagatctcactggctattatttccagactagactggagggaggcaataatgcaagtggagagactagcaagatggttagggtagtactctttccagtgtgagaaaaagggtgcttggactgagaacacagtagtggttcagagtggagcctttggagccaaactgccttggttctaatcccagccttgctactttgtagttgaatgaccttattcaacctttctaccaatctttaaagtgaggataatgttagctcctaccttcaagatgtttgtgagatttcaatgagataatataagagaaggacctggcacagtgtcttgtatatactgaggacccaataattaaaagtggacaaatttgaaatacatttggagccgtggttctcaactatgggtgcatattggaattaccttggtagatttataccagatcagaaggaggaggatgtgattccaatatgcagctaaggttgtgaaccactgagttagaggaaaaaaattataggatttgctggtgggggatgtgtaggtgacttctatacattactgccattttaatcttccaaaaagcaatccatcaccgtgttacacccctgttcaaaaatttttatgccaacatgtatttggacttactatatgtcagtcccagttctaactaagcattttacagatatgaactcacttaatctcatgacaaccctatgtgaggagtactattgttctccctgttttatggatgaggaaactgaggcagagagcggttaagaatcttatccaaggtcaggtagctagtgagttgaggagctaagatttgaatcctggcagcctggctccatatttcaggctctaaccacagtgttctgccactgaaagggatgactccctgtcgccactcaaatacatgtcaacccccgactctgatagtgaaggcctttcatggtctaacctcaagttacctttataggtcaatattcttccattcatgcacctcagggcccactgcattgttcctgtgctctcttacctttttacctttgctcagtcctcttcctgtcagtgtttctcacactttagtgtgcttcagaattgctcagagaacttgttgaagttcagattcctggatcacacctgcagagattctgatttagtggccttggagtgggacccaggaatctgcatttaagcagaccccatcgttcattctgatgcagaatggtggtctgtggactgtcactttgagaaaccattcctgagaccatgtagataacctggaaccaaggatttgttttaaaaaatctgagtttagtgcacttaaattgagcacattaaaattctgaaacctgagtgaaccagtggaaaagcaaccaatttcagttcctgattggttaaagcatctaagtccgaccatatggcaaccaatttgagatgaatgagtggtggccatttcatgataaggaactgggatgaaaaggagacaaaagggctgtctaagtaacaactgcacatgtacaggttggatggagaaaatgtttcctctttctggaaaattctttttctccatccctgcctgtggaagtcctgctagtccttcaagacctagcacaaatgcagcttcctcagattctattgcaggccgtcctcaggtcgcattttgataagtagtagttggaaggcctttcttttctgccttcccacttccatccctaatttctccacccataaatcctgcttatccttcaaaatccagcctaattgccacttcttccatgaaatgtttttaaatcctgcaaactagaagtaaacctgtctctactctaggactcctcagcacttaacctgtgcttcttctggagcatttatcaccttgtcaacttctgttttttattatttgtgcccatgtattatcatccctattaatgcataagctcttcaagacagatactctttttcatttatctttatttctcccactgtgccaggcagagtaggtgctctttaaatgaatgcacactagattggaatgattactagaaatttagtcaggatttgaattaggtgctaccaaaaaagaatatggttgttgtgcatttttccccctgaattactgattgactgtggtagatggtgttgactatacattgattcctcgtcaataggaaattacttggtctcattcctgatctccaagttgttttcttcccctataccactttaggaaactacagttaacattgctttttggaaggactgagcttgtttggactaccagtgtatgctcatcccttttaatatgctatttgcatcagccctcataagtcaatatggatttagttacagcctaatttgatttatgctttggtaaggccctggatctttccatacatgtttctcacaatgtgtgtgtgtatatgtctgtactacagtgtagctgttacatttcagtcaagaaagatggatattttgttcctcacctcctttcttgtcttggccccaacttaatttcagtgtggctcaaaagaaagtccatactgagcagaggtgtacatgtggttgctaatataaccagttggtcactataatccagctgttaggctgatattattccctttggggaaaaggatatgtgaaatctaaactggaaaacaattgataatagaaaggaaaggcaacagtgaaaagacatgtcactgcaacctaggggcaatacggtataatgcaaaggacagaggctctgaagccagaaggtcatagatttgacattgcagggctaccacctacgagtgctgttatcttggacaaactatttaaccactcaaaaccttggttttctcaggtgtaaaaatggagattatgcttactacgtatgaaatgggttgtgtagattaactgagatggcgtagagtgctaggagatggcctaatacagagttattggtttataagtaacaattactatattttatatagtaattactatatttattacccccgagttaagtatcattgcaccttctcctctatctttgatagttttgcctttttaaaatgtaatctccatagacagaactttagttctagttcttcttgtggtaacagatcctggaactagctattttatgtactgttctatcgttacaatttaaatttcttttcttttttatgtcctcagaagcaacagataaaagctagttattactggccatgtattgtccctttatatacttgataattcattaagttctttctttgcaacctctcatccagcctaaatgcacaattttctttcatcttcctttataaagactaaatcctacacttttgtaaaaattgttgttctttcattgcctccagtttctttgcatctttcagctgtatataatgtggttgaaactcctttgaagttctaacttttgaagcacctagttattttttcccatggaaatgacgtttttacaatactgtatcttatataagcgtattactcatacagcagggaacccagaaacctctcccctatgctggccaccctgactgcaggccaaatactgaagaagaaataatcttttgactgctgaacttgcaaaccttcatataaagggcattgaaatagcctctctgcactgtccccaaacactaatgtgtgtctttcttcctgggtcagacagcaatcctagacgcggattgaatctcagacctagccttcattggctagacgtgtctttgaggctgggacagtcaaggagagcgttggcagaatgtgtgtcattgctagcacttcagcaaacctcattaggactggaagcatagtgcaaacagccactggaaccttaagggaaattttatcagaagaaaaaatctcttcagatcctgtgttagtttgctaaggatgatagcctccaactccatctatcttcctgcaaaagacatgctctcattcatttttatggctgcatagtattccatggtgtatatataccacattttctttatccagtctgtcattgatgggcatttaggttgattctgtgtcttcagaattgtgaatactgctgcaatgaacatttgcgtgcatgtgtctttttttttccccaaatactgcatgttctcacttataagtgggagctaaatgatgagaacttacgaacacaaagaaggaagtaacagacactggggtcttcttgaggatggagggtgagaggagggagagaagcaggaaagaatctgtacaacaaaccctcatgacaggagtttacctatgtaacagactttcataggtatcctcaaacctaaaataaaagtttttttttttttaaatctcttcagagattatactactgccacattctgggaaggcaggcttcaaacccaaacccacacccagcttccctccaccattgatcatttccacttcctgtcccctgctcatcttgccaaaacaacagggaaggctatgtacttggactctagacaagggaaaggtatttggggtaggtattaactgtattgaaagccaagtatgcatttagtaaatggtgtctaaatgtagcacgtacaatgtgccagacaatgttctaagcacttatgtgtggaatagctcatttgatcctggcaaaaatagtagcaactatttatatccccattctacagatgcggaagctaaggcagaaaagttgagtgatttgtccaaggacaaatggtagtaagtggcagagctagaattttaacctggtcagtctggcttcagagtttcaagctcttaacttctatactacctgttgggacccattcataggagtatgacaaggatatctcctagtacaggggagtaaaggggaagacgggacatgcatggcacattgttgtgtgcagatactcctaagagagtatcttaccacactgcccatgttttcccatcaaggccttaacttacccttctctcactctaggcttaaagtgtcttgagtgtaaatgtctactttctttcattcagcaaacattgttaagcaatcactaagagcctggcactgcaccagtgctagagatacaatggtgaacaaaaatggacatggaacctgccttcatggagttttagtagggaagatagacaccacgtcatgatataagtaattataaaattgcaactgtgccacatgccacaaaggaaagttgttataaaagccaataattgagaggggttgacctagtcagggaggtgaaggaagacttctgagactgtctctccagcctcaactcgcaccacatccctccttgttctctgcactccagggtgaggaaagattggctcaaaaattagggagataactggtggcagtcatacactcctgggatccccaacttctgatcccaccatgaatccagtccctccccaggctgtaggggtctataatgttctttctacattatacatgctacataataccctaatctaggaattttcttttactcttctttcttttggctgtttcctgtttttcagagacagggtctcactctgtcatccaggctgtagtgcactggcacaattatagctcactgcagcctcaaactacaagctacccttctgtctcagcctcctgagtagctgggactacaggcgtgcaccaccgtgcccaaccaatttttttttttttttagagacatggtctcgctatgttgcccaggttggtctcaaactcctggtcacaaatgattctcctgcctcggcctcccaaagtgctgggattacagacatgagcccagcctaggaattttctttttgagaaactacttgatcatgctaccatttcttaccatattatccaatctgaatttttcagcttgtttttaaagaccctctgtgaaacagtctgatccttccttaacctactttccagcctcatttctctgacaccaacacacacatctcctttaggctggctggctgatctctttgttctgttacatgctatgtttcttcctaccttccctcctgttatgtgcttcacttaaactgttatttttcacaagcttggaatagcccccgctcctcttctacctattcgcatcctactcatctttcaagggtccagttgaagttgcacctcttctaatagttttgcccaatcactctagttctcattgatcttctttgaccaccttcaggacttaatctggttcaaaaataagcattcagaaatatattcttgcactgttattgctttgtgtcttcctgtttcccctggcataacataatattaatcatatatcatgctgactggtttatttaatacaaaaagagccacagtcacaaaaagctcttgacagcattccaagtacagatgcagtagggaggcaggagaaatggtggaacttacaatttgctcaacccaagcccgttcatccaacatatctcaaatgagcccagggagaaaatggaagtcactttttatgaaattttgatatttctgctaactccttcaaggtaaatgaaactggaagcaattgtttaaaagtatattagtcagtgttcaagataagtgccattttacctaagacacttgatttctctttccgaaagagcagcaaaattgcacctcagatcccatctcagctagaatccgggatcttcagggaagtggtatgtgagatacttcattgattttaaacatcataaaaattgaccagtttttcaaagttttcaaaatcaaagaaaactgaagaaaataacagcaaatccaaatatagattctcacaaattagtctcaagttgtttatgttttggcccacattttctgcagaaacaccaccatctcctggtcatgatgataggaaagaaacattgttaatgagaaacactactttaaaaaatgaaaattcatcttgtataactgaaaccttatgcctgttgattagcagctccccacttccccctccaaggtgaacaagttctaaagatctgcagtacaacattgtgtgtgtatagttaaccatatagtattgtatacttaagtttgttaaaagggtaaatctcgttaagtgtccttaccacaataaaataaaaaaaattaaaattaactcagtaatttttgagtttatacattctcacctaaacttcaaaatacagtccgccctctatattcactggttgcacatccatggattcaaccaactgcagatagaaaataatttttaaaaacacgttaaaagtaacagtacaacaatctaaaaattacaaattttagaaaccaatatagtaaaatgactatttacatagcatttacattgtattaagttttataagtaatctagagattatttaaagtatatgggagtatgtgtgtaagttatatgcaaacactatgccattttttatcagggacttgagcatctgtggattttggcatctgtggggggtcgtggaaccaattccgcatagatactgagggacgactgtgtattgatatactctgatattttcatagctatagaagagtctcgctgtcattaataataccttttcaaaagtgaatcatttatgttcatgtgtatgggaccattttagagatttgccatcctcacctacctctcctcatctaaatcccaactggatctccttccatggaaatgttccagattgtttttgctttctctccatctcttgtgctcaaaattcatccccacgtacttgctgactgtcccaggaccccgtccctctaaggtcatcatgttccttcttggcatgtttcttacgtctagaatatttcttcttgaatagaaagtcattcagacagtggatgggacagcgttgactttcacattgagtttaacaaattaatagcactgattcctaatcggccatctgggttgtcctgtcagggtcagtaataccccattctgtttctgggattggaggacttttttgtgtgtatatgaatctgtttctataataaaaataaggaattcccagtgaagcatttcagagcaattatttcttcatgggtggttaaagccactctttcttcaaccttattctttctaactccttcaaggaattccatagctgcccagaaacaccattggatgtgcccattactcacattataatagtctttatgagcttagactccaacaatttatagaaatcaacctggtttgttgactgacagtgcaaacagaggtaaaagatacatgagaaggaagagcagtgtatacaactgactgcttttcattttcaggttgaccagacagtcagcatgggtaggtcattgagtttctcctctctgtcctgctttttattttcagttcatggatgtggtagcacagaactctactttatttggatacttggatttttttttttaagacagagtctctgttgcccaggctggagtgcagtggcatgacctcagctcactgcaacctctgcctcctgggttcaagtgatcctcccgcctcagcctcccaagtagctcagactacaggcgctcaccacatctggctaacttttgtatttttagtagagacggggtttcccgatgttgtctaggctggtctcaaactccttacctcagatgatctacccgcctcagcctcccaaagtgctgagattacaggcatgagtcaccgcgctcagtgggcacttggatttttaagacttcactttataactttgtaaattgtactcctaccaatgaagcagatatctttcctgtcaagcctcatttttagccaagagagaaaagagattttaattaagatgcaaactcttttttaaaaaattggaaatagaggactagcataattatgagaaattctaagccagtttagaaggtgtgagccgaagaaatctctctagccatttttaaaaatatctccaggaccctgtcttccaatgatttagagatgaaatgattccttttcaatgtgcaggcatgcagttatctttgctaggctttgtttgcttgtttgtttgtttgtttgtttgatccaagcccttttctttgttaaatacacagcacacttgtgggagtcccttaagccgggtattcccccatgtgtaagctacccttgaggagaaggaggaaaaagaagtggaggcaaagaatgggaagaaaggggattaggaatagcagctaacatttagctgacacagtgtgccaagcacaattctaaatgctttgcatatactaattcatttaatcttcacaaccctataaggtaggcattattgtctccattttagcaataaggaaactgaggcacagagaagttaattcatttgcccaaagtcacataagtaggaaggagcagagccagaatttgaatccaaactgtttggctccaatctgttctcttagccattatattatactgcctctcaacttggggaagcaaagcaaatttgggaactcttatttctgaggctaccgggaggaacagactgtgtgatgaccatctttccaggggccagatatggtaacaatccagcagatgcattgggactgctctgagaagcaaagattctgtttctcaccataaacttggatctgtttagccacatctccattgaaagagcagagtgtggatggtgggtaccatccagctcgtagtttctgtattcactctcttctgatttcctcctggaaacgcatgcattctcacaatgcactttttaaaaagtaagtatttatgatttttctggacaaataattttgtactcttcttcagatttggcttgctactgttggcaggaattccccccgttgtgtgtgttttggtatttctcaaggagctattttgttaaaaatactaagatcttatattgacagcccaaacaataaagtacttcatttgacaaagaagtattttttaagaaaataactgtctgatcctttttatggctgtatagtattccatggtgtatatgtgtcacattttctttatcccatctatcattgatgggcatttgggttggttccaagtcttgctattgtgaatggtgctgcaataaacataccggtgcatgtgtctttatagtagcatgatttataatcctttgggtatatactcagtaatgggattgctaggtcaaatggtatttctggttctagatccttgagaaatcaccgcactgtcttccacaatggttgaactaatttacactcccaccaagagtgtaaaagtgttccaatttctcatcctttccagcatctgttgtttcctgactttttaaggatcaccattctaactggcatgagatggtatctcattgtggttttgatttgcacttctctaatgaccagtgatgatgagctctttttcatatgtttgtgggccatataaatgtcttcttttgagaagtgtctgttcatatcctttgctcactttttgatggggttggtttttttttcttgtaaatttgtttaagttctttgtaggttctggatattagctctttgtcagatagatagattgcacaaattttctcccattctgtaggttgcctgtgcactctgatgatagtttcttttgctgtgaagaagctcgttagtttaattagatcccatttgtctagtttggcttttgttgccattgcttttggtgttttagtcatggagtctttgcccatgcctatgccctgaatggtgttgcctaggttttcttctagggtttttatggttttaggtcttacgtttaagcctttaatccatcttgagttaattcttgcatgaggtgtaaggaaggggtccagtttcatttttctgcatatggctagccaggttttcccaacaccatttattaaatagggaatcttttcctccattgcttgtttttctcaggtttgtcaaagatcagatggttacagataagtggcattatttctgaggcctctgttctgttccattggtctatatatctgttttggtaccagtaccatgctgttttggttactgtagccttgtagtatagtttgaagtcagatagtgtgatgcctccagctttgttccttttgcttaggattgtcctggctatatgggctcttttttggttccatttgaaatttaaagtagttttttctaattttgtgctttataaaacttgcagatttcttgtattgttgtatatcatcattggaagctcaaatgcctatcagtggagaatccttatactagtttccttttaaagcttctctcaaatttcagcacacttgctccctcccagcagaatttatagaattagatgtttggcagaggctccctaaagtcatctgcttctactcacttcttcatctctagcttcggtatggagcactggcattaaagtgctcccccatggaacccagctcatggtaaggagagacttcacaatgggtttattcctccctgctctcttccactttgccctgattctgctcatttcaacttctgcctcaaaaaatacagagaacatttcccctgtctcagggatttgtctcatgtccctttgccttatgattagagtgactatgtaatttactatctcaaccgaggcacattttgaaagcaagagctgcaatcttaataattatgcctgccagaaaaacaggcaataaaactgagttgtctgagataaatctgctctatggctaccctatttatgatgtatggttcaaaagtggccacatgctggcatagttttgctctctgaggcttatcttcatgggtatctcggaatctcattgtacacttagtccttttgagaggacagtttacctctctgacctgctcaagccaccagagattaatggaagccacaggagttataaacagtctgaatttcagcctagcttttggccatttttcaaatacttgttctccctttctcccactactagaaagccaacccattacagcttcatagggtaccactcagagagagtatgactgaggtttgaataaacaatacatgtggcttttagggttaaatgaatattgtttgacatacagtacactacacttgtttttatttcagttcaaaaaattggttaaaattatatcttgttgcttctcaaaattaattagaatccatctgaatccattagaatctctgttttttgttttgttttgttttttacaaaaagacttggctgaatgaaaaagcctccatctcattcagataatctttccagtgatcagacaaaaagagcaaagaaacaggttttttagggtattggtgcctactttttttcaaagtatgatatctaaggttgcaaatggacatacctattttcagctatccagacagactgtacccaggtctagagaaccacttatagccttataaaatgtcaacatctaagaagataattccagtttaattatgggttaaattaaatagaataattcaaatgttaaaacgtttagcagctacttaatagacttaatagaacattgaagtttagagaatgcaattttgatgactttgaaagctcagaggcaccagaaatgctaacagttcctagtatttatatatttaatgtatataatttataatgtacatagtatatcttatatataaatatagtgtatatatacatatatgtgtgtatttatatacaggttaaatatcccttgtccaaaatgcttgggactggaagtatttcagatttccgatgtttttggattttggaatatttgcattgtacttaccagttgagcatctctaatccaaaaaccccaaatccaaaaatgctccagtgagaatttcctttgagcatcatcagcactcaaaaacttctggagcattttagactaggaatactaaaacctgtatgatatatataacatacagttttagtatgatatagatgatatatatatatatatcatacagttttagtatgatatagatgatatatatatgtaatacaggtttagtattcccccattacttgtttttgtcaggtttgtcaaagatcagatggtatatatatgtgtctgtgtgtatatatatatgtgtgtgtgtatatatatatatgtgtatatatatgtgtgtatatatatatgtgtgtgtgtatatatatatatatatatatatagtctccattactttttaatgaagtgctgaaatttaggtatgcattcttgtctgcaaatgctcatcaaatacacatcacgacacactcatctgatttgtgttacagggtattagtattcttctcctatgcctgatagtgacttgcctccttgattttccatcttacctctctgctcatttgtaagaggcgctatgtgcttctataatgctttgagattctgactggactataagtatttaatgacactctttaattaaaatccttttaaaaactctagggtataaattaaataaactgaacttttcagaaggccagctaagtaaacattttatgtcaataccaatcattaaatctacattttaaaaggacatttgatgaagagaactagtctatcatttttcttttgcaacttgttttctcccttttgactacttaaattaggcttgaaaccacattatatagcttttacattttgttttgccatttgctggtaaatctttactggtttctattcgtctctctagtcccatattttatttggcccagacccactactgcccactgaaacaagggggacaagtaaatctaagctcatccctgctcaatcactgtccccagctctccagatttgcaacccaagagttgtcagatactgatttcccctttgccttccttccccatcatcaaatcttccttcagggtcttatcagtttcttttcatctgtaggagtctcattcaatccttcttgtgtgttattgcacagatgctcatggcctattacatattactatagcagcttcctgtatggcctcctgcattcgagttactccccaactagtctataccccattgccagaataggcttccacaaatatcagttttatcataggaacccctacagaaaaattggcaacataatcaaatgtgaattcttcagccttttacaaaattttatatttttttgaatttttactgtttactttttacaatttaattattttcttaaaattgtgtgggtacataataggcatatatatttatgaggtacatgatatgttttgatacaggcatgcaatatgaaatgaacacatcatggagaatagggtatcgatcccctcaagcatttatcttttaagttacaaatgatccaattacactctttaagttattttaaaatgtacaagtaagttattattgactatagtcaccctattgtgctatcaaatagtagcacattatttactacccctatttacctcaacaacacaccccactgtcattctccctccctccttcgctctccctctcctccctttctctctacaagttcaattaccagcgtaatttctcttgttttcatatctgaagtttctactcaagccacaccttgcttgctgtctccagtatgtgacttgctgtttacaaagctctggtcctttgccaatgtcactccctttggttgaggtactctctgcccttatcactgtcggtttatgctgtgcagtatctacttctaaaaatgtgacttaatggttctttcaggaagctttctacgattacatctgactgctcactcatcccattcagtgtctcctaagcatgtgtatttcatttgtatttgctttttttgtgtgtttttaggctgtttcctatattgatttcccatcacctccaacctgggtgtaaatatcctgagggcaagagcccagcctgattttctcctctttctgctgtagtatcaggctcttcacccaagaagtgttcaaagcatgttaactgactcttgggcataattttctagttataaacatagttgaaatcatctttgttttacagtagtcagtcagggtttccacagagttcagcttgcagtctacaatctttactcagacatggaataaaacaggcagaaaagagtatatatactattgaccaagcacttaattctgtatgttttactgcagttcaattcaatacatatattgagcacctgatgtgtacgcagcaatatgctaagtgctccagcctggttattcacaaactcctgcatccatcagaatcccctggaaggcttgtcaaaacccaggatcaccagcccccatcctgagtttctgacttagtaggtatgggttgggatctgaaatttggcatttctaacaagtttccaggtaatgctgatactgctagtccaggaagcacattttgagaagcagtggtctaggagatacagaggtggtctaagacataatctctcattccaaggaatttacagactctctagggagacaaggaaggcccagaaaacatttaacagtaataaatattgtacagtgttttagtatttattgattcgacaaatattgaataagtactatgtgcccagcactgccccagatgctggagttacatcagtaaacacaatagacaaaaatccctgctgtcatggggggattctaatatgggaaagcagacaataaacaaaataaataaaatataagaaatataagatagtaataactgctaaggagaaaaagcaaagagcaggcataaatatcagatgggggttggaactatagatagggtggtcagagaaggcctcccagttccatcatttgacaagtatttattgagcgactactatgtatcaggcactgttatagatgatggtgatatagtaacacaggtaatgaacccttttcttatggaatggacatacctatttgggagccaggtaacctagagttttggtgttaattctcacaaactcattattagactctgaatggctacttcccctctcagccatggtttcttcatctgttaaatggagcagttggacaaagttatgcttgacgtcctctatacttctaaaacttcaggatgcttagtcttttaggcaatcagaaatatgtaagagtgtttgaagaagactttgcagaggagagaaaacttaaatggttttcacaggcatgggggagctatggggtgtgggagatggaaggtaatttcagaagaagaataacatgagctacagcacggaagcaacaatgggagtccagtattcagtgaagagcaagtagctcaaagggttcccattgaagagtagctgagatcattgggtaggcagtagggggtgattgtagagagtcttggttgggaacccactgagggttttgatcagggaatgacacgattatacaatcaaagtggtgttttactgttttatgaagattaacctagcaaatagttaaatcctcaaaattcattatttttcatcagataatatttgaattatgaagatttacagtcatactctgttataagtcactgcctgattctaatattgctatcaaactaatttttaggtcgttttcaagcccttaaaagcctatgatactacctaatttcccctaacactactactacatgcttgaactggtaacatgttactctttttgtgtgtgtgtgtgacagggtctggctctgttgcccaggctggaatgcagtagcatcatctcggctcactgcaacctccacctgccaagctcaagcagttcttctacctcagcctcccaagtagctgggactacaggtgcacaccaccatgcccagctagttttcgtattttctgtagagacagggtctccctgtgttgcccaggctggtctcaaactcctgagctcaagtgatctgcctacttcggcctcccagagtgctgggattaaaggcatgacccactgcacccggcgtgttactcttatgaaggcttgagagagtaatcagaatagaaaattcttagtacttacacttttttgtgtttctggttatcttataaaatatatgttgaatattaggtttatcttcagccatatatataatttaaatagtactcatttcaagtgatgcaaacatctctaagacaaggctcttcccattcgcttgcttggtcagaggtaacacaagggcaatattcttggaaatgatcctcttgttttttaatcagttgaggtatatccacagctcttgtgtgtttgttgctctagaggctgaaagtagaatattcttcctataagcagttactttagaagataatgataaggagttctctgtccaaagagtgggtcatgtagacctagagaaaggtgtgtcataagaaattatgacagatcaaatcctcaaaactcattattttaatggtagtttaaacagaagtgaattatgacctgcaaaacacttaactgtcacgaagtaaaatgagcaaaagtgacagtgatggttaaattaggtggaaagtgattattttccttttattttccaaattctgcataatgttgctaggacatctatttagaaagtggcaactttcttcagagttgttttgaaaaatgaggcacacccagagaaatctttcacagccgctttttgaaggacagccacaaaagcaaaaacacttcaagaactttgggatcatagtaccaaaaatgttgctgggtcacaagggtgataactttcccttttatgaatgtatgattttctccttatttctttttaataaacaggagatggagaactgtcatgggaacattctgatggtgatatcttccggcaacctgccaacagagaagcagtaagtgtgaatagctcaaataattcaacactccacagcatcaggccaagctttcctctcctcgtggctactattctagcaaatccaaaaaaaaggcccgatttctaacaccatttttcttcccttttctcaaagtttttaatgtcatcaccaactggaaaccatttaagtacactgtaaaattggtaactggaggcaggaaatgtgcacaaagaaaccatagccccagccctttgtctaggtcagaagttggtactctttcaggatgacttgccaagtctttatgtgttctctaaggaagctaggtcactcctatcctcaacagtgaggaccttctgtagggttgtaggatacaaccatctttttggtgggatttggtaggtacttcagacatgtccacataaactctttcccaagccttaggctctcagtcatacagttggaaaagaggaaaggtagcagtctggattctcctctcttcagcctggtgatgtctcccttctgttctctgcactaatctcagaataagcctcacaagtaggcatctgtctatgtaagtaatagcatcttttgttcttttgtattttgaaggaatttataaaatagcattcctctctaaaaatatatgtctaagaagctttacactacaaatttcttaaaatctgaaaaggagatgttccgattcaaagaatctatcatacaaaatgcacagtggtgaccattgcacataaataggtgttcatcacatccttgtacaaaaaaagtatgcaaggacattcactgcgttgttgttttcataaaaacaaaacaaatggagacaacctaaatgtctactagggacttggtgtgtacatccaattaatgggacactgtgcagttgttaaaagaatacggtacatctaaatgtagtaaagtgaattgagctccaagatatgttaagtaacaaaacaaggtgcagaatgaaattgtacactatcacttctttatgtaaaaattgtatgtgcatgtatataaatgcatataaaccaatctggaaggtcacataccaacatgtcaggtgtgctaatcttaaaggagtagaagtgggcaggaggaaaggtagattttgactttttactttatattttctgtataatttgatgttttcctataagcatcaattagttttgtaataaaatatatttgattttctaaaaccctagaaaaatctcagcaaggattgaatatgaggcaggagtccagggaattacagggcaagcctgaggatattgagcatgtgaggaagatgttgataggggatgcagtagaatgactcatacaaacatcacagtgctgctgaggctgggcttcctggtcatcacatgggccacttctaacttgcatgctcccagcttgccaacacccaacccaaagcttcagcagtgagatggaaccatttctatttgtcttactctctatcagtattattttctgaacactgctgtttctgaatagttgcagaagaattggggaaaggggtttggagaacagtactctggacatctcaaaaaatcagcatcctgcaagagagggtaggcttccctgtttgctggttaatataaaccctgaggaaagattttctccacccaactctatctgctttatagtaagtgagattccttccagagcctgacaggagatgatgtcagtctcagttttctgtgttgtctgttcctctttttctcagcccctattttttattgtggtaggtagttgagagtggctgaattagtggctgtcaaccagatgtcattctaaaccaaatttagagtttagtcaccttaagctatgtgacttattccctgagaggcccccacactaagcactatggccaccttagcagtcttgctggtaatgccatgaattagcctttcttcttgacttcattttacactgccctcaattccagcccttatctttcagcttcattgacaggcctagtgataggcctggacttaatccagtacttcctgtagcaaaaaaggtcgggtacagaatgtgggcccttgaaatagttattgattttcaaaggagttcaagacctatctttagaaacaaacatttgtgcctggtagaccaaaatggccatatggtttcactttattataaataaatatttccctttgttctaaaagggatagatattgtgggatatgatttgaataataaatagcatctgtagtaatggaaaaatatatacctggcacatagtagtcacccaataaataaacattgaatgaatgggtgtgggaggtggcgtaaaatgtgtgtgatggtggagtggggagggggttcctcattaattttaatgcacaggaatttgtctcaaatcagagataaactcttcaaatttgttgtttgctcttgaccagcctaaaatgagaaaataggagaatcccttctgaatatcctttgcaggcccaacttcctcagggcaagaagaaaaggcagccctaacaacagatttcttatccaggagactgtccttttcgtaaactgttcctatttaccgggaaccagcaaaacctctgttcaacagaaatacagctgactggtttcttttgccaggtggtctgaaaaccatcggcttagcaagttttatgaagtgcacaggaagaggaaccagtggttcaaatatgactcctttgtaaaaacctgaaacagtttttgtttgatttctaagttgtaatttctcatgaattggtcctcgtgccattggtggggagtgtgtctgcgtgtgtgtgtgtgtgtgtgtgtgtgtgtgtgtgtgtgtgtgtgtgtgtgtgtgtgtgtgtgtgtggagtggtgtggtatgtggggaggaagaagtaggtgcagactagaaagccaaaacatgaaagcatgcataattttgttttggacaacagccaagccctgatttttgccccctgtagattacgttgaaatttaccattaaaaaaagtgaaagcgtttgggatagaaacgacatgaaacagataaaaatccatgtctcatttgtactgtcagaacaatggtttgggaaggaaattggcctaagtgtcttccagccagagatagtcctaggttggtagtgattaagatacaatgttttaatggctgtatggattagaatatattctgaagccgctttttaaattaaactttttttattttgagataactatagattcacttgcagttgtagcagaaaatacagagagatcccatattccctttgcccagtttccccaaatggtaacatcttgaaaatctatagtacagtatcacaaacatgagggccctttctggaccctgatgttttcttgtctacaccaataaaactcttatattttagactttagaacatgaaattcttgggggtcctctacaatagtggggatttttcaacactggaaaagaactgttttagagccacctctaaagcctgaaatatttttcagtctttcaagtaagtaaatcaaaaaataccaaaatactgagcaaaataaaagatcatagctatatggtcatttctaactggttttgacccgctctctcaagcaggctagttgcagctaatttttaagataagctccaatttcacttacaacttcagggcgttaataacctttttctcctttgctctgagttacaaggtcagaatggcccctcataagtctctttcatttgtttaggggaggaactctaaaagaaccattacccttaaatcaaaatcacacaccaccaccacccactccagcccccaaacagaaaatcctttatgtcagtgattcccaaccttggcttcaaaccagagtctcttggggagtatataaaatcctaatgcccaggccttcccccaaaccacttacataaggatacctcagagcgggacccaggtatgagtattttttacagctcaccgggtgattttagtgtatagccaaagtggagtatgtggtatatgtggttgtgaacattgtagctgaatgaacttttgtatctgaaagaacttctctttgcaccagcttttagtcaaatggttatagaccactgagtttgattggacattctttcttccactttctccttcttctccttctcttcctccttctattcatcttccccctactcctacactcctaccatctccaaaaactcaatcttcattatcaccatgagtaaactgcctctcctccttggcctcagtttctctgtctgtaaaacaaaagacttcaacaagattaggttctgggggactgactggtctacaatagggcctgtgatcaaaattcttgaggattttgttttttcatcatgatcattttcctaccattattatatgtcccaggtctgagacgttggtgctaaagaatggcttttcattttgtgttcaccatcatgagtcagagaacttctcgtacttgcagcttatcctgggtcaacaaccttccctctctaattctatcccagtccaactgcttctttttaggatcagtgggacaccaaccagccaaactgtcctctatgtgttcctttggcaaaactttgccaaacttcaaaaaggacagagcaacctataatggcctttgtggaatgtgagtgattatggcagaaaaggacatatgagccattgtgggaatgagaaatatttgaactgagaatcctatccatgtgcatgaaaacaaactgatgcaaatttttatttgtgtgaattttgatagcaatgcaccaacataggctcttcttagatagaataacattgtctttcaaaaggctaaaaaaggtcctcttacttcagctcctgtttactctccctttcccctaccagtggccccttcctgccaagagggcaataatacttcccaaagtgaaatttgcaacatgcctgtctgtggcccataactttaaacagtgttttatgggatatggtcaggggaccccataactatcttcccaaggttcctcactatttctgtcactgaatataaagaccttccttttcaattgcctgtgaaagagttttttaatgggttccccctccttcacccctaacaattgcctataaaatacaattaatcttacttggctttaagccttaaggttccattcttcattcatttcatcttcttgtacccccagcctactttagctcctgggagaggggtgggtagcacaatagtctggtcatcacgtgtgttgaacccttgctgaaagattacttgtatgacaagactctaagcttttcttaggtaccagagttttgttcactcaacaagtatttgatgaacaccttctagatgcctgacactaaaatctaggcactggagatatagcagtgaacaaaaagtccttgatttcgtagagcttacatgccaatactgtcatgtactatcaattcttctacctataaaatacctagggtatttgtactgcattgtatgatcttatgccattacctgtctttagagtctaagtacatcttatcaagactatactcgaatctcatcttttcctcctatccagttcaccctatgcatgatcaggattcaatgctttgaaacagttctgattacattatttctctaactttaaaaaaaaaaatccctcaaagccttctatgccctcacctctattgcttaccaaataaagtcttcaccccttagcctgtcatttaaagtcttccatgatctggcttcaacccacttttggaatgttattctgcaactgttcccttttatggactcgatgttctcttcttcaccttctcaacttgtaaacctctgcctggactattccacttaacttctgcctgtaaaaaagtctacccatccttcgtggcccaggtcacaagccctccccaactagaagctctctctttctccttctgatttgcacaggactgcttacttcttctgcagcctctattcacattctgccttgcgtgcagactactgtcttaactcttaaactgaaatgtgagagtcttggcagcaggaaggacgctttagcctttttggctcttttctccctgagaagtttgcctgtaaatctagtcctatcttttagaagaagagagataaaccttggcaagttgtcattaaaaaaaaattttaatgaaaaaaatgtcagctgcttgtacatgaccacatccctatttctattggtgtaggtaagcatgcagctgaaatcagagctcaccactataaatcaaaattattgaatgacttctagtatataacttaatctctgtgatctcattggtggcttttggactaaatttgttcttgttattttacagagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaaggtaaggggcatccttcttttgtatacttccacaacaaggcttcagcagccctggtctttgcagggctggagctgggaaaggaccctttctcccaggaatagcccatattcacttgtggctcacttagcatcaagtctgtgggtatagtcaggtgactccaggagactctttggacttccttaaatgcagccaaaagagcatagtccggtcccttttgtaaacagcctcttgtattttctcaattatccctggggattgtaggtcatttgggaaaatttcttgggtctttaacagaatgagtgattgtctgtgttttagtaggggacccaacattcaaaggtactcagtgccaaacatcactgaagctcttatctataccttagaaatagcaattctcacacctcaatgcaccccagattaccctggggctctcgttaaagatacatattcctagccccacactcagattctggttaaatgtgtagcatatgagactatccttagaaacgagtaatccaggtgcagtggctcatgcctcacagcactttgggaggtcgaggcaggaggatcactcgaggccaggggttcaaaccaggctgggcaacataataagactctacaaaaaaaaatttaatgaaaaaatattagccaagtatggtagtgagtgcctgtagtcctagctacttgggaggctaagacaggaggatcacttgagcccaggagttcagggttacagtgagctatgattgtgccattacactccatcctgggggacaaagtaagaccctatctctaaattaaaaattttaaaaaggaaaaagagtaatccagtgagaaatcccaaaaccacctggctgagcaccaggaagactgatcaggttaagactgacatgctgtccacttagttgatcaactggctacagcaggcacccatagacttccatagcttccaatgtcttcttacacagcattttctggcctccacccgccccctgcccccacccccacacacaccagtagcaggagtcagggaggagaaactcaatcaaacaattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaaaaattaaattgcttttgaaatttgcaggcttaaaaaaacattcgaaataaaaccattaatggaaaatggtgatgtagtagaagaattggaaatacttactatcgatctgtgtttgatttgtattttattatttttaagttccaaggatttctgataaaagcttatgaaatcaggaagaaaggtaaagatagcttgattttcaattctaaattgcctccaatagattccatttgctgtgaaagtatttcaaagccttttaaaagtgtagggaaatggattttgaaaatcctaaatcccataatttccacaaggtctctttaatttcagggcagaggctcatcccttgattttctccatgtcctacaaaaaccccagctggtttacatttattcatttgcccccactgatttggatgcaacagttctgttctgacctttctaatatagctcactgaggaatcacttgtccccacccccaactcccaagctggatgattcaaaatcatctcgataatttttggggtaaggagagggctatgtttccctgtccagaattaacttcaccccattccactgcagagtctcatccagtctagactattcctttagtccaaatgttcaggggagatggagcctagctatataacactgggaatcctgcctgccctgctcatcatggatcgttcttttccttacatctcttgctaataatgtggtcctctgatatatctacttggctccttgttagcatcaaataagagaaatgataggaatccaccattttgaacttgaatccagcctaaattttcttgaagcatactgtgtgtccacttgatcacattgtctagaagggaacgttactgtttggggagaaaaaaaaaaaaagaggtaagggcaggagagtgaacagcacatctggcctgtcttgtgtgatcctgtccacagccctgacctcacagttgaggtgtcagctctccattttgtctcattgtaacattgtgagccactccagtttaggttattggaaatctttacgtgggttgaccagttagagtgtccagtattctagcagctcttgcaaaggacaggaaaaggcagctaacattattcttatttcttaatgtgactcagtggacttgatgagaaagaactagcccagtgattcatccttctgaggccattgtcttgcagccaaatcagccaattcctagaaatgcatcaagtgggactatttctccccaacagcccagcctgaagtgatacaacccaccctagagatgttgttgattgggatgccaacaggtttccctgggtgtgatgaggtgatgggaataataagaaacacacccagtcctagtcatgacttgaaatctccacaatgtctcagcactctcaaaaagggagataactcatcctcggacttccccatctgcagccttgtgcagttatcttggagcctagctccatgccttatagtaggagccagatatatttggtgttgatttgcatagaaagatactcctgtggccccttccctttataggcccctcagcctgcatcctagatgcttgctccttttttgggtgggtctggggagggaacagggtctcactctgtcacccaggctggggtgtaatggcgccatcacggcttactgcagcctcgacttcccgggcccaagtgatcctcccacctcagcctcccaagtagctaggactacaggcatgcactaccacacctggcgactttcgtattattatttttgtagagactggggtctccctttgtttgccagctggtcttgaactcttgggctcaaaggatcttcctgcctcggcctcccaaagtgttgggattacaggcaggagccaccacacccagccagatgcttgctcttttaaggtccttcagaagacatggggccaatgacttaacttcccacttaacaaatgtcagactgccaaaggatatctgtgaagcaagcagtgatcagctgtagccaaatatctatagccagtatgaggtgggagactgaggaaattgcctgaaattagaggcataaaaggctatcccttcacaagttacccaggagggcttggtcctttccctctcaatcttgacttatcactttccttcctacaccaaacagtgccgaacaccattaagctccatacttatatatgttggtggatcagacagactcatagcatttgacattctgaatggatttgcttcaggatccggaagaaactgtccctttgggaagagcagtaatttttgcatctagcctccatggaaagcaaatctcccaaggaaattttcatgcctggaagcacatccacttgaggcatacaaattttctatagaactgaaaatattaacattacattctactagagatagaactctgctttcatgcattcatttattctcatatatatatatgagaatatatatatatgtggctgggcgcagtggctcgcgcctgtaatccaagcactttgggaggccgaggcaggcggatcacgaggtcaggagatcgagaccatcctggctaacacagtgaaaccccgtctctactaaaaatccaaaaaaaagttagccgggcgtggtggcgggcacctgtagtcccagctactctggaggctgaggcaggagaatggcgtgaacttgggaggcggagcttgcagtgagccgagatagcgccactgcactccagtctgggcgacagagcgagactccatctcaaaaaaaaaatatatatatatatagatatatatagatatacagatatatagatatatatagatatatagatatatatagatatatagatatatatagatatatagatatatatagatatatagatatatatagatatatagatatatatagatatatagatatatatagatatatagatatatagatatatatagatatatagatatatatagatatatagatatatatagatatatagatatatagatatatatagatatatagatgtatagatatatatagatatatagatatatatagatatatagatatatagatatatatagatatatagatatatatagatatatatatagatatatagatatatagatatatagatatatagatatatagatatatagatgatatatagatatatatagatatatagatatatagatatatagatatatagatatatatagatatatagatatatagatatatagatatatatagatatatagatatatagagatatagagatatatagatagatatatagagatatagatatatagatatatagagatatagatatatagatatatagatatatatagatatatagatatatatagatatatagatatatagatatatatagatatatagatatatataggctgggtgcggtggctcatgcctgtaatctcagcactttaggaggctgaggcaagtggatctcttgagtcttagagtttcagaccagcctgggcaacatagggagaccccatctctacaaaaattaaaaaaaaaaaaaaaagcacggcatggtggtgcatgttagtcccagctactcgggtggctgatgtagaaggattgcctgagcccgggaagtcaaggctacagtgagccacaatcacaccactgcaacctgggtgacagagcaagatccggtcttaaaatatatatatatatatatatatatatatatatatatatatacatatatatatttatggactgcctactatgtctgaggccatttataagcatccagaagctgctgctgaagaatctggagaagctcctgagagtagaatatggcccaagctgttttttggtcacagatactactcggtaaacatagccccatggctatgacaagaacaaaggatgcttgatatgttaagtagttcagggcttgggttctgaatatagggttccattttagctccttagcttttaattgctaattctgcattctctttcagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaaggtgcgttggttggaggccctgcttttggttgactgagattctcacctagtctttctaaactttctttaggcatcagaaacataacctttcatataattgtaatgataatatttctaataataatgaatttcattctctcttctcttgaaagactgaaaaggcagttgcttggaagaaatttactacccagaaatatgcttgtgtctaccacacctctcatgtatccctgagtgttgaacttacctatgcttttctaaatagtagagaatttaggctatcatgatgataaggaagaatagtagcagctttcatttatatcactattaaacccatcaaagtacaatcacatccattgcccttttaagacaggacgagaggcaggtgagttatagtggaaggagaccaggttctgatccaagcctaagatgttgagtgatcttggaaatgtgccatatccattctgagcctcatcagccttatctgtacaattgaaagtttagaaaaattatctctaagctcccttctaacactataatcctataattatattattatttattttttaaagataagaaaattgaagtacaaaaatcaaaggacttgcccagattcattcaactaatcaatcataaaaccaaggcctataacccaagtcacttccagcccatcgttttttctatgccagtagaaaatattgactgataaaaaagacaagttaattatttaaatggtagtttttaaaacatgagctaaataaaaatatagtccctaatattggggttgacagaatataggatgggtaatcaagcattctatctctgtcttgccacaggtttcctgtgtgatctataacaagtcacttcacccctctgagcttcagtttccttctttgcagaatgagagggttagagtagattttttggggggcccttacagctccaacattcgaagagtcgatgatttagtcaatcccaggcacatgaatttatcatttcttatgcttctgcaaagcatttttataaacacagatgaaaattcaaacattttaaaaagtaggtagagagctaaattatatacttcttcaacttagtccctcatgactagtaggcaaacatgccctgaatcaatgtgtatttattgagcattttcctgcaggccagtggtactcaaacttgtctgaacattagaaccccttggcgagcttctacatatacctgtgtcccatccccagagactataatttaattgatttgaggtgtggcctgggctgtggcatttttaaaagatccccaggtgaacattgtgtgcagaaaagtttgagaactactgctgtaggcccagggtcatttatggtcttgctactcaaagtgtggtttatggactggcaacagctaggagctggttaaaaatgttgactctcaggcccccactcaagacctactgcatcataatctgcattttaacaagaacctcaggtgattctaatgcacattacagcttgagaagcactgatttatgacacaaaatcttcctcaatgtaacaacccccatcttccagagtacacagggggcagcgtgtggacaggaaggacaggagctatttgataaggtgtagagaactggggcattgaaatttatgagaaaatgtatttattacgaatacagagagaacacattctttttatttttttttttattttttgtttttttgagacagagtctagctctgtcgcccaggctggagtgcagtggcatgatctcggctcactgcaaccttgcaacctccacctcccggttcaagttattctcccgcctcagcctcccgagtagctgggactataggcacgcaccaccacacccagctattcaaactcctgagctcaagtgacccactcgcctcagcctcccaaagtgctgggattacaagcgtgagccactgtatccggccaatggagagagcacattctaaggatgatatggacatccgggccacccagcaacaatgacctattatgacttccaagtctgtggtctcactggatcctcaaaccttttagtatcacatagtggtagtttcatgaacacaattttctcttctgtcaggggtctaacacttaatagtttaaaaagtaatgcaacaagataatttcagacaaaaactaatatttacacaaattacccatgataacataaaccctctcattgtataatattccaatttgaatctcaggccttcagaccaagtcttatttcattgtgtgcttaaaattttattgatgcagatgattcaattaaaaaattaaataatcaaaaagctgtgagaacaagacaaacaacagtcattgcttttaaaacaattgtcctctcaggttggtaatgtttattaaaacatttggtggccgggtgcagtgactcacacctgtaataccagcattttgggtggccaaggcaggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctcaaaaaaaaaaaaaaaaaaaaaattggctaaaaaattccacttctaggaatcctaagaaagtaaccacagacatgcacaaagatatacaaataagaatttttgctgcaatgctgtttacaatactgaaaaattggaaataatctgaaagttcacgaatatgggaatgattaaacaaattatggtgtatctgtaccgtggaatattaatatagccattaaaactcattatagaccaagattgaatggcagagaaagatgtttgcaatgtatttgttaagtaaaaatagcaagctaaagaacaatatgtatattatgatccaactttttgtgttaaaaaagaaagcgttgaccaggtgcggtggcccatgcttgtaatcccagcactttgggagtccgaggcggacagattgcttgagcccaggagttcaagaccagcctggacaacatggcaaaaccatgtctctaccaaaaatacaaaaattagccaggtgtggtggcatgtgcccatagtcccaactactcctacttgggaggctgaggtgggaggatgggttgagcccgggaggtggaggttgcagtgagccaagatcgcgccattgcactctggcctgggcaacagccagaccctgtctcaaaaaaagaaagaaagaaagtgtttatatatgctaagacaaaaaaaagaaacaaaaagactggaggagcatacggcaaaatgttaacagtgaccattttcttgtgactgaattatgggtaactcttattttcttatttatttatttgtattttccaaattttctatagtaaatatgtgttacttttgtatttagaaaacataataaaatttatcatgtaaaaaactgccctccagtatcccagttggcagtatattgaagtctgaatgattaaaccgatttttctggaagagctgcttttcccactttcccactctgctcaagtttgtggagatagacgattgattgagcaacatggaagaagagaatttctgtctcattctgtgtatctgcctctcagtgagccagacatgggtgtctgcatgttgaatcactccttagtcacattgcctgagagtcaatagccacatagccaagggcacctgctccaggtactctgcaactgcagagcatcaggaggcatgcacttgctcatgcattcaatctggaaatttgttttaagtacctactgtgtgcaagacacggttacatgcactgaggacagagatgtgaacaagacaaaggctacttgccagcatgctctttacattctagcagaaaagaaagacagtgaacccaaatcaataaggtaattttagattgtgatgagtgctgtgaagaaaaaccaaacaggatcaagagagagtgaatggggcaggaagcacttttaaaggagtagtcagggaaggcttctctaaagatatttgaatagagtcctgaatgacgtgaaggggtgagaaatgggatgatcatgacattactggcctcttaaaaaatgacacatgacacagaagaaaaggaacaaggcagtgaggagagaagtagatggaaggaagaaagaatggtaaattcagttatgttgaaaagggaaaagagataaataaaattcactgataatccagccaaaagtttcattgtaacaagtgattgcagcctcctacaataacaaactaggaccaatattaaagatgtgagtttcatctctctcttccctttgctctggtagaggctgaccttgctttgcatatcaatggccacctacagggttgggtaagatgtccacttcctgaagattccccaactcacttctcacactgtcgtgccaaactcctattaacctcagtagggaaggcaccagatttaagaggccgaagaaaagatccagagccagcaaacaagacatggggttttattaggggctgacatacaggggagagagtccagtggaggtgggctggacaggagaaccaccttacatatagaaacagtccagtggcagcaggttgggcaggaaaactgcaaccacttgcaaacatcatgcagtttatatagcattttcactgaacactctccccttaacgacctggcaaccttcatctaacccaaaactcaaggcctctatcccctgtgcagccccagggatgagcctggggttcagatggtcctcacagacaaggaaataatctcccagttggccacgcctggattcccaagctcagaacacacattcagatacgtctgccatacagggtcattctaagggtacacttaagttattgctatcatgagcatttactgtacatacaaccacaataccatcccaataccttgaatttccataattacatactccttttaggttatggcattaaaagtccctattaagacttaaaagttgtcccagctggaataatacttctccttcattaccacttctgcaaggaattctggaaggctcaggatgggaacattctcttgggctgtggaaatggccagaaatgacatcaagcacattgtcttccccaaaagaaaatgagagtaggtgaactatagtgatcagaaagcaccttgaagtgcagagtgtgaaaaacggcggatgttgctaagtaggtagttctaaagacaaactttgcttttcttagcattttcaagtaccagccagagttaagtcaataatgagttttgttgtttgtagatcccttcggtcaagtaaattaagctcttgtagggaaggaggtagtggtgcaagatgactcttcaggctactggaagaacttttagcatattacaggtactgccagtgccatcatggatttcatgtcagctatagctgtagccaatattaagctggtgagcaaagtttgagaaatgaatttggctgtcattctaaaggtgataattgaatacacagaagtctctgtacactcagtgacctcttccctctctccaacccatttaaaaagtgctagcacgtggcccttaattacctatcaccaaaaagactggcccaccaagtaaataaatagctaaaaagaaggacaaaaggaggaaaacaaaaagcttgattccacaataatccacaaattgagtaattcagtctggaatcaagagaagactatggttttgtccttacaatgccaaatggtggtgggggtgggaaagctaatcaggttaccaagagacatacaatagcaatttgattacaacttctagtccaaatgtgtctgattggctaacagtgagtctccctaattagagtcacagatccaaagcactcaacactcagtggtttcatcctcaacaattcagatattcttacagatggcttctgttgttctgatttgagtgtatgctttaagtacgcagttcaagagagtactgattacaaggccagcaagcaaacttaactcactgataaccaacaagaagaaactttttaaaacaggggactgaggaaagaggagggagggtggagtgaaatgtagagcttgtgcctttatgcctgcgagctgaaattcaacagtttagtttacacattaaatgatccatcgctgagggacttgaccaattttttgtgtctcccaaccattcatttggcatagcatacatatggctaatctgacatctagattttggcactggtgctgatccggtattattgttccccttacaaacaaatcaaagagcattcagaaatgtcaagccaatttggatggatcctttgggcaagtatatgcacataaatgagtgtcatgaatgttttctaagtataccaaaatgatgtcaggggatgttaaccaaggccctttttcagcccattccctgggcctctcctggcaacactgagctggacagagcatgatcctgaccctgtatggaaattcctatgttctcttaagtgcctaggagatttgtacctggctacatttttcctcatgaaagtccacttctcagtgacagtagtaggggtctagtgttccgaagaactatggattctgtcaacacatggacttcaatcaaagttacgtgctcctttgtgatttgtggcttaatctgtggcttgttgcagtggcagcctaagctgggctaatgaagtatgggtggaatttctgtctctcgaagaatgttcttgttaattgtccacttttgataagtgtgagatgttatgaacaatgagatacataaatgcagaagttcacttctagctttagaaaaccatgacaaaattctacttgcttcctgattccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggtgagcaagacaacattaatttctcatctttgtaagggggcacagaaaaggatgagaggactcactttaattttgcttcaacctgttccctcatttggattaaaagttctttttgattgcttagaaactgacatatctaacactattgtcattatggcctttcaaatttaacgatggcctgtgctaaagatcaagtactgacccttgggtttccaaagctgcctatttcacaccaccaaaagctggagaagcggttctcaaccctggctgcccatcagaatcatcagggagagttttggtttcctttaaataccaaatatctgggccctacccccagagattctgattagttggtctggagtggggcatgggcatcagtgtttgttcataatgcttctcaggtgattgtaatatgtagccaggattacaaactgtcaaactgtagtctgtcattctttccagaataaagctcaacaaccatgaaaacccattcattcagggcaaagctaagtccctaatatcacgatgtgtcttctggggtaaaacaaatttaaaacatcatccctgccctcaagaaggttatagtcttactggagaaaccccagtcacaatgttcaattccttttctgattactcacagtgactaccacagcaagccacattctgttcattgtgatcctacagctcttctaactttttgtaggctcaagactagtgcttatttagtgtggtcaaggttcctcacaatccaagtggataagtgagatttcagctggaaaatatacacatctttttgctattggctctcacataaggctcaagagtactcgaacttctgtatgcatcaccattacacagggagctggttttaaatgcagatacctggccccatcccagagataggaattcagtagaccttgggtagagtccaaacatttgagtgtttaacaaatagccagatgattctaatgcaggtggcacttggaccatgctttgaaaaagactgctcagtatttatgaggctttttttctctccctttagacaacagcctttatctaaagaatgcatttctccctaaaaaaaagatgcttgaacatgtatatattcactcatgcttatttttggtctatgccttggagtgttgatttgccatctttaactccctagctcatccataacaggacacctaggactaggcactggtttgttgcgtttccccagcagtgggcccactattcgtcatcccacatctttcgcctctcagaggtgtgcagatgaatttcaacttgctaatgtagcgtctaaatatcctcttgttcacagttctgggttatcaaggtctatgcttggtggacacagaaaaagaggcttaatctacttcgcccatttaagtgggctggtaatatgttgctccttcagtataaggcagttgtcagttgtctacctgttattgtgataaaagctattcaggcaaggttgagactgtggagagcactctattttaactctccccatttatgaataaggaaggctaaaggatctgtgaatatttcccaaaggaaaatatgcttttcagtgagttcaagaacaagggtggcttctccatttacaaaaccaacctgcctgcaatcccactgcaggctctcagtgcttagccaggagggcagcccagcggtttggcatggacacagtctatccaggttgggggcaagtgcagaatttctaatactgcctatggctgcagaagctccagtaagcacttatgctagattccatgtggctttccctaggagagagtcccatggtcagcagcactatctcccttatctccatccactggagaagccgaggggaagccagtaagccaaggaaacaaatggagtcaattataacccttgagccatccaagttcctggttaagcacattacacagcccaactcgatactcttaagccctagtaatgaaatgatatgctgagcctgagcagaaaaaaaggagttgatggttccagattgagtgcctgaccatttgctccactttttgcttggccctaggcattctccagcacttccatattgagaagatctccaagaggatgtttgaggagcttcctcacttcaagctggtgaccagaacaaccctgagtaagtagtacttctcttgactgctccctgaaaaacacattcagttttcaatttagcatagccacagctaaagtccctccgcaatctcagtgaacattagcactgctcagtatcaacactaaaggatgttccatctctcttctgggtgacttagcagtgaatggggtgtctgaatgtaatctgaagagcttggacatggtgaatacaaacccagatgtagtctgagcataggatacctcaggtcaaggcttcctgaatgtctttaatgaaactgctaagcacagagtctcaagagggttggagaaagctcataagattccaggtctggtatatttatggagacttcacatctggaagggtgtatcctctggtggtgggtatgagaggcaaagagaaattaaaggcatatcaattcctgtgttatatgaaagcacttttactcctggggaactgcccctgggtggtcatgtttccttaaaagcattcaggcactcaaaaacacttgcagctctcccactttccacactagatggagcctagggactaagatacttctaggcattggggcgggtgttgagcacttctaatgggataaaaggcacacagtttctatccacagggaattataatggatgagacagaacatgaaaatgacttcagtatgaattagtatagttctgaggagttaaatatcaaagtgctcaggggaatctgcaaagaacaatgagatgagagccaggtgggcttagtcggggaaggcttcggggaggaggtgtgttttgaaagagaagggtatgactgggcaatgggtcaggaaatcagtccaggaaaagagtgcagcctaagagaagactcagacaggagcaaacaggaaatgtgggtaggggagaggaatgatcacaaaggccacagaaggtgcactaaaagattagaagatttggaggtagaaagtagtcatagggcctgaaaaaaagccagtaaaatgttcaaatgtaaggcaagtagcatctgtagttgctgcaaatagcatagagatatcaacatggtgctttggaaagatgtctttcggctatcagatgcatatattacattaagcacacactttgacgaagccagattatgaagtgcccaatttatcatgctaggacattggacttgatctccaggccagagaatgccagtggaggtttttaagcaagtgaatggtgcattcagatctgctttatttatttttttatttttttagaaagaggtcctcgctgtgtggagtgaaaggtggacccttattaagagaagtgggatagtctgaattaggaactaattatactatattaaatcaatgagacgggaggagacgtcactgtgagaaacatttctgaggttaaatcaacaagatcagcatcaaagagagaaacgagtttggaatgggtccgatattaataactcgactgggtgaatagtaataccattcaccaacagggaaactgtgaagaataagcaggtattggtgaaaaagagtttcacttggaacatgtttaaattaatatgcttaagagccatctgagcagagttagggtccaataggcagctagaaaaagagccaaggcagtcagttgcttgtctttggcaggactcatagaaaataacaggacagtatgagaattcaaatggaaaagttgggagtccttacatgtgagtaagaaaggaggcagagtgtaagatcctaggatcaattatgggacttctgaagttacatgttttagttcatactgtgaacaaggctttgttctaggttccaggggacttaaaagatgatttagatatactctgtgcccatggcaggatttggggtatataatggagtagaaggtatgtgcctcaaactgtgtgtagctgaaagaagttggtatgatcctacagggtcacctaggagcaaagaagaacaaacccaactcttttatataatgtgcctagcagagcccagcacattatagggcttcagtaatagctggttccttgcccaaatcctcttcttgtttttttgtttttccttctatcttcccattgagtcatagagaatggggaaaagggagaaatccaagggagaaaggagcagagaaatcaggcccatagggaaggtgggtcattattctcttgtggctaaggaaaagaaaaagaggttcaagacaggtttgggcttaagaggagttggcttaacttggactaggagttctccaggttgcagtaccatgagcacaggaataaaaagaagacaaaacacagtatccagggtgggcagagacaacaggggatggaagggctacagccaagtttactctgcgtggaaagggattccatggggtatatgagaatggatgaggaaccatgggaagggatttagggtgctaagggggtataaggacagcatgtggacgtaggagaaagcaacgtcgagaagtttttaacaaaagatagcaggaatagaggaaagagtgatatataatcaaatagtaatcaagtaacccaaaccaatatttggggaccctaagggtaagcaaagccccagtaatacagtaggtgccgttttccaaagtgcctttttgacctggtgccaagtaagctgcctaaatagctaacaagcagatattgaagcattttgtaaatgctaaatatactgtaaaaattccaagaataacacttaggttttgctcttgaggaggggcagttctatattattcttgggattcttacaaatgctatgtgttgaaatgaaaacttcatttcccattttccatatctgctactagaaaagtgttttggggccattttttgaaaccaagtgatatttgtattccaaattccctggtaggtccatgagtaagtgggtaagcatggggtatattggttctattcctaatttgctctgctttcctcttacacactcccggccactttgcgtttgtttgccttttaggccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatc

SEQ ID NO: 3634 - DNA, 119878 bp, human
ccagacctcggacgagagcgccccggggagctcggagcgcgtgcacgcgtggcagacggagaaggccagtgcccaggttagtgagcagtgcccggcgcccgcttccctcacctccttttccagcctttgcacaggtgggttgccttctcttggccggagccgtccctggaagtttccccagggtgccccaaattcccctgccaccccaacctgttctgtgctccagcagttagcaacctggatggaggtggggcccaaggcttctgaccaaagcaagttgggggtctctgaattcgaactcacagctcgtccctccccactcggcctgcatttctttatgctctggcgctttgagaggtcacttaggtactccaccctgagctacccaagggactctgcagtccccttaatcactgcctgtattcctgagcctgttttctcattttgctgatgaatacatggtaaagttaatgtagcagggtagatgggcgaaaggctccctatcctatcctctggccatctgcctcattttttgtccctgactacgggggtcagaatttgagacactaggctctggaagcaacgtggtatattgccagaacatagggcccggaaagcctgctttccagtccctcccagccctgccactaaagttatttgagttctctgggtccccccagtgcccattttgaaggtggagttgtgtggaatgaaatgaaatgatagaaaggtgttttgcaagccaaatgcgaggcattgtttgtcagtcataagcagcaatgaaagcatttcctccaacaagagataccctgggttaaaactgccattttcagtggcaacacaccaccagttaactgaacttttcttgctgggtggtagagtggggagaggatttcagctgatggacaagggcctgggactccagtgtctttcttattgtttgtcggaaagaaaattgctaccctaggggctgtcccacagatgatagtcaatgtgagattacaaggtcagtcaagcctctcaggaggattaaagagacactgtggggcgtgaagaactggctgacatgtgttcatcccttagccttcctgtggggatgtctctttgcttctgttctacccaggagacctgttctgaaagtgggctcctgacacttgatggcccagattgccttgcagtcacagctgggcaaggagcagttggtccctttgcttaacgcagatgaacaatgtgaatgcttgtttcatggaagcaccttaataaatacctttcttttggtacttgatacatttctctttctcttgtaaaacacaggaactctcccatcccacctccactacctgtgttagttgcagggttttgtttttttgttgttgttgttgctttcttgttgggtcctggatcccctgaagcatgtcaatggctacatgtctaagtaacctgtaaaagagccagtgcaagttcaatggcacaacagcctgtgtgaagcagacagagagttaatgcagaaataactccagttaactgggtcaaagtataatttgaaaaattaaggacagtttggctctttgcaagaataagagtcggctaagttcgctgagcaatgcttgctagtgtttactgctgcagtcccaacacatgttttgaaccacccccttccctaaaagaaaaagctgaagagataaagagaaattgaacagtgaggagatctggggagggaactcttcttggttcatatttctgcacagaatacaaaggcaggacttcaggatcttgtaaatcaaaagtgaatatttataaagcgattcattttctgatgttctccatcacagcctgggaggccacacagatgacaggaacgccaaaggagattaattgctctctagttaccaacttttttatttgctcataatattagttgggacctaagaaaggcaaaaaaatctatgagctgttttcttgccaacttgagttatgaagcaatgctacagttcaccgaatcgcccaaccattatacaagaaaagcagccctgttgattctcgcatggggagaccctaaaaccatggtttcagaaacacccgttgaaatccatatatgaatgtgataaattggatttcagtggttaaaaatctttctcttttggaggcttggggaataaacttattagaataggctcaggaagaacctcactgaggtgggtagctgtgttaaattgttaatgaaaatgatttgtttcgaataaacgtggtagccctcaagggacagtaacattctgagtgattgtaagtgggccacaaactcacagaggggaccaagacatcagaactcaggtctttagatgggtaggaacatgtcctgagagaatttggttctttaaggagcagggaggaggtaaagaaggaaggcagacggtgctgcaaatcttgtttgatagcacagattactctatcatcagttcttccttggttatgcattcataattgaaacagtggattttgaatgacccaggcaacttcatagcatttaagtaggagctgtagcatctacttcagagcccaaagatattcaactctccaaaatgatcgttttgcattccttcaagttctttatgtgcaatatttaggttggactttctggaaagatcaatgagttcatttcccattcagattgaatctggtgtttttagaacatttcaatattttcagatcacccattggaggaattttgcaaactctaacatctgtggaaatgatccgtgactagatgtgagctacagcaaactttctgtgttccaaggttcaaaaggtttaagatttctaccccttatactgggaatgccaatctcatgttttgaagaactgtagttgttttaatggtcttttgcatggtggtgcaaggtgaacaaattatctatttaatttgcccaatttcccctaaaaatggcccatttaaaatttccattttacaatggacttcttgggggaggaatatgttggaaccattttaagcagtaaaacttttcaggtgtttaattgcatccatttgctaattacatctatcttttgcaatattagttgccaaaccaaagatccttgtagatctcatagaggacacaggagaaactgatcaatttgtacttcattccaaaaggattaaaagtagtcttgaagctaagattagttaactttcatttcagaaattgcttggtctcatgcttgttacttttaccttgtttgctaaaataaccgtttttgcaagctaaagtttcccttttctcccaaaaaaatctcttgagaaatcaactttaattcccttagaaaggaagatttcaaaatttattttcattttcctataacttgcctgtaaggacttagcctcagctttggataggaatgcaccctcattcacttgaattttcacccacaagccttgcaagacaggagaggcaagtcctttatcttgtgcaggcagacaatacttacacttatgtaaattctaggacattttttttttattctagcaggttagaagcctgagcatcagtgacctctatcatttccagaagatctgtgttaagtcttttttctgctttcttcccaacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacgtaagtgtcttgcatttggaaaataatacactttttataatttctttgaaaatgtggctataatctgtagcaattatgatttagcccaaatgtggccgtgccattattctaagagaagaaagtgaatgttactggtttatgcatgaattgataaaagaatgagagctttgaatcaggccaactaaatttggggctgtttttctgattatcatgtagtctttgtctcatagaacatatgacacattagcttattttctcttccctgttctaaactatacaaatctcattacattttacgtaactctagaaatatctgacagatgagctggaattttcccaaatttcagactcttcagcaaaggctttcagtttatgaaaaataatgacacagaaaagaaaaaaaaagaaaaagaaaagcaggctctgcctattcccttatgccgaaaaacgaggaaggacgaaaccttcctatgaactgggctcagatgaaaaatgttttgaggaaattgagattccagggaccgttagcaaattggatgccatttattgaaaagaacatccccgcaaagccagggaatatttctagaaagtcagcgatccgtgtaatgggctaacacattggagaaagcagagagtggcaggaagtgggggcgggggggataattaaccctccttgctgccacgtttaggagatttatgagtaacggtcgacatatccgttcttgctgcctttgcacaatgtgggtcttaccttctttgggccacttgcagccatctctgaggtagatgcttgctctaaatttgaaggaaaagcctaagctctagttcccctttttgacagcatcaaaaaaagcacaaaatggaattggtccaagaggggcattctctgcttcactgaacttattcatgagaaggagctgtgaaaatattcttggtaggaactgaagcagcatctgaagcccttcacttaaacctttatctcttttatcacataagttaaatagatcaggcagaaggcttgctgacaaggagaacagtgccaagcctattccatccttaagtgtgtttctgtcccactacaattttcatagtaagtgtagtcttcttcctgggagaaacagtgtttaatagtgtttttgattatgcttttgagcatgagcggtgtatggtgatatctagtatgattgggacacaaaaggaagtttagtggggcatgatctcagcaaggaagcttggatcagcctctactcttgtatccctcaaattgcttccttcttcttccacttgaatatagttcatctcagaatcctcctcttccagaagccttccttgatttaagtggatgtgacagaagcatccatgcattctcagctcagctcacaattagctgggcttagggatgaaatattactcaataagtacaatgtacattatttgggtgatggttacacttaaagtccacactttatgcgatatatccatgtaacaaaactgcacctgtaccccttaaatttatacaaaaaaatcttcctgtcttagagagaaacttcccttatagcctgttaatgatgacctcatggggaaagcttgtaactctcagaagaccatctcttatggaaagcctttcatatttatgaagaattgaatattgtccatgaaacttagacaaagaaagatgtgacttaaaaaaattacaaacccaaatctactactttctaatatttccttgtgctgatgaatttgtcccaagcccttttgatattcaattggtgccaaagtgattatgtaacagatggcctagggcaccagatctggtccagtgtttcaggcttattgtcagatgatgacgctaaggtcatggtccttcccttagtgagccactgagcatcattatgtgtgtccatgcccaagctaactgttctgaagacatgcaaaatcatctctgctaaagggaaaacctcaaagcatatgtcctatatatgctgtcttgatatatgcatgcacatacacaaacacacacaatatgcatgcacagagatttatattgcagctctaacagtgagaagtcagaagcagtggaaatgtcagttcatagataaatagttacaaaaatgatccaggtaatgcaatataatgctactattaaaaacactgtttattgaaaatttggtggccctgggaaatgcttgttaacttatttttaagtttcttaaattataaaattaatatatatgcttattatacaaaacaacatgaaagcatctgagcttcatatggaacatgtgtccctaaactctcattccactctcctgggataaccattattagtggtttgctgtgtgatcttccaaactactttctttgttttataaaattatatatacatgcctgtatgatattttattttacaaaaataggatattatatacacttttctgtgatttgcttttgctcaataatgtgtgtaggacatccttccatgtcaatacattgcaatgtaatagtgccatattctttctaatgcttgcatggtttgcagttgcataagtttgcattggtttatttaaccagtctatatttgtagatattgaggttgtttccggtttttgctattaaaagtaagacatttatgaacatctttaggcacttattcaagtatttgtgagaaatagtcgaagtgcatgttcagttttaatcttcataagtactgtcaaattgcccttcatataagttgtattaatttatgctcccaccatctatgtatgaaagtccatttctaattccttcaccaagattataatcaatctttgtattttggggccattttaataggagaaataatctgtaagttttgcttggtatttttctctttctgcagcatcttttcgattatgtactagttcaattttatttcttcagtgaattgtctatttttagtttggttgcttgtgatatttatttgttaaaaacttacttattaaccttttatattttaaatattatttttgatatgccacttgttttaatctttaagttgtatttttcccatatagaagttttaaaattttacgtagtcagatctgtcattcattttctgtatggcttctggatttcttattcctaggaaggtctttctcaccctatatttttatattttcttctactgctgccataattttatgttttacccatagttctctattccatctgaaatttatattcctgtatggtatgcaatggggaactaattttttttaaatctccggatggtaggtttatgaatgttatttttgctcacttttatgcttctgtctattccaaaatttccacaattggcaagtttcacttttaaaacaggagaaaagctctttttaaagtaaaagtacatcttatttcccatatttttactgtgcaactctagagacaagttggtatgtgagtagatgaagaaacagaggggttttctaaaattaaaaaggaaagcaactggaaaaacttcagaaaatgggtaagagtaggcctgggtcataaacccttcacgtctctccttgtctgacaccattttaccaaaagaaggcaaagttttttatcttgcaggggctggttagaatataagcttttaggtcaaggaatgtgttttgtagcctgtttgctctcctatttggggcatcacaggggaatgacgggggatgccattatggtcaaagatgctcactcaattgattcagaaatctgaagaggtgtggaaaaaacgctttgtttgtggaaagctcatcacaaggaatggtgaagatgggtgctgccacttgctggtagctaattagccatagttacaatttctcttataagagagaagacaggctcaggaaacccgaaaatactgatagtgcattgcaatggatgaatgagccatttgttgcttacataaaagtttgttactgtttagcatcagcaaggtttgagttctttagctgggaaaaggtccttgtgtataactccattatgctctgttgttaaagttgtagtcaatgaggccaggaaactcttttgaagttcaaaggagcgtaacattcacagcataatattcatgcaaatatgggataaatgggctgaagagtttgcccatttggcagatctaacttaggtaatgaactattgatcaaagtgaggttgaagaattgaattgttaagaatattcaattatgtatttctaatagaccagcctgtgccaagtctggcaaaggttctggagagagaaattgttcatgtatttcatgcagtccactcctgctttacaaggtagttaactggatcttcaaggagctagattgtcacttatttttctcctcaagagaaaagcttccaatattcagatttggctaaaagtgggcctctggacttctcaggaaaggcaagccaccaaaagattgaagggaaggaagaagatacttagaaagtttgaaacatgtgaagcccacttagaacttctctattgtgagagccagccaggaaggcatgggttttcctcctccagattctcccttggtcatttgaggtgattattgagcaagcaaatgcgtggacctgttcacatcttagaagtttaattaagtggaattagacgaaaggaatacctaaaattagatagcttaatgcttttcaaagtatattcttaattgttttttattttggtgagggggcagtaggttttgtcatggaggctctgtagttagcctagatccaatccccagctccttgacttacttatgtaccttgggaatgttacctaacctctccagctttcgttttcttatcagtacagtgggggaaataatagcataatgagcgtgagcattgtcatttgaagaagaaacgagattgtgtacaccaagtgctttgcatagtggctggcacatagtaagtttttcataagtagttgctattagagcaactctcttacaagccaaagatattatccccttaattttaaggtgagaaacttgaaactcaatgaaatcaagtgactttgtacaaggacaagcagcaagtcccagccagagctagaaccaaaacccaggtctccgaattaagtgttctgttcactatacccatctgcctcttggaattctttgaggaagtcagttcattgtcttgaatagaagcccagtcctttatacatggcagccacttaacacataagagatgatccaagtaaatgaataaaaattttctaacccaaattcctaagagggatagtatactatttgggagttaaaagactgagacaaggactaaaaatttttcaggaacctacatttgctaagccaaaggaaagtagtgaggaaggttaaaagtatgtgcgtctatgtctatgcttcttatatttccctgacttctcagtaggattggaatgtcttcatagtttaatggaaagaggactgtgcttaaagtcaagagacctggtttccggtcagtcttcccttgtttgccgtgtggtattggttgaatcattcgtgttctatgaagtaaagattcactacttacaaattgaaaagaattcttgccttctggactgaaaactaaaggagaatagtataggggctggggaggtggaacaagggaaacgaaggccctggttttgtgtacttggagcaaaccacatggatatttaatattgtcacaaggtaattgcaaagaatattttatccatttaagatttatagcctgtctgcttctagaaaggttagatacacattagagatgaaagaataggggcaagataatgtttttaaagatgaaataaaatagagatcatctgaagaaaatagaaggaatagatgtttttaacatttggtttagtagattatagcatttataatgtaaatctggcttatgcctcccaaaaggatgaaaagagaaactttgggtttgttgtcaagagaaaatttacagtttcatctacagagattattcccacctctaacccactcaagcagtattgatcctgggatgtttgaataaggcacattctgggtaaccttggtttcatagaaaaaagaattgtctggcatttctttactgatgctttgtaaaggaagaaggcaaatattaaattataattcaataaaggactttctataagcagtaaggaaatgcattccaggtactttccctttgaatgatctaaattggagaatagaacatggaaatgttaaatagatgtttaatatgtctactagactggattgtcaactatcagatgccctaagcaagctttctattaacatgatttgtttctgattttaaaaatagatgctcattgttaaacattcaaaaggtacataaaagtatagggaaaacaaaaatgaacagtaatcacaacgtgtatggataaccatagttaattgatatatatatatacttgtagtctttttttctaagctcagttatacaaacatattagtttacaaaactgaagcactttttaaacagtatggatcagggtttgtttatttatttatataaacttaggggagacaagtgcggttttgttacaaggatattctgcatagtggcgaagtctgagcttttagtgtagccatcacccgaattgtgtacattgtatccaataggtaattcctcattccccatacttcttctaccctcccacctttccacatctcctgtgtctgtttttccaaaatgtatgtccatatatacacattatttagcttccacttgtaagtgagaacatgcagtatttggctttttgtttttgagttgtttcacttaagatcaattcacaattggagtctctaaaatgcacttgtagtaaagacaacatcccatgttgtctgtaagtgaaagctgggcggtttagacacgagttgcaggatatgcaaatttgattctattgtgagaagttcaagagctcaacttttattctctaccaaagggaacaaaagtattcctgatcaaacagaaagcctcccttcacagagatttgcaccgctaaagtgctgataggaagaacagtttggttttttgaacaggcatttttatttttgcccaaagttctatgccatatgacatggaagagatgatattagcctgaaaaaatattcaggtcaggtttcatcagcttagcagcctttctgtaaaaggatctcctcatggcctcatagtagacactaatgagaatatcatcaactcccagttatttatgctaatgaaagatagaagggcacaataaattgaaatttcatggaaaatctccagttctcatcttaatggtgtcaccttgcttgactgccaaacttctttgaattatggacccttttcttttcgatgggtttgcccacctgctaataggaaagtaaaataaccacaaaacaagtagtgagagggccatgctgtgggaggcccaggcaggtgaatcacgaggtcaggagttggagaccagcctggccaacatggtgaaaccccatccctactaaaaatacaaaaaatttaggtgggcgtagtggcgggtgcctgtaatctcagctactcgggaggctgaggcaggagaatcacttgaacccaggaggcggaggttgcagtgagccgagattgtgccactgcactccagcctgggtgacagagcaagactccatctcaaacaaaaaacactcagtatataattttgggcaggtgatccagcaagtaggaaaaagctaattaacttctgaatgaaggaaaaagctgcatacacaggacggagaatgttgcttcttcatgactttctttttttctctggcgtctgcaggctggaaatgaagtcttaaagtcctgagaaaacatgaaacagagtcttcaactctagaaacccaattgtcagtgaaataagaaacgttttccccttaactactacatcttgcccttcctacattctgcttcaagtttgataaatgacagaagagacgtacttatgcctttattttttcttcactcttctagtagccttttaaagaaaaaaataattaaaaaggaatttgtttacttgatgtgtccactcatataatgaatagcagagattcatctttttttccactgaccatgtgttataatagaataaatattattgtaatactgacatgacaatgtgtctacagtaatagcgcttatcaaaaacagttcttgggaatgttttcttgattttggactggtgatgaagttactgacctttgcctaatcctgggagctagtcagtaatgattggcaaaacattgatggcatagtgacacgtatctgttgttgtttactttttgtcatcattgttcctattaacaggggcccctaaagtagcagagatagccacctctaatgagggcaagctgatacatttgaaaaatagctgtgatgttgcaggttgaaggtccatctcacaagttagttggaattcctttgggaccaaattctactctcagacaccattagttagcagtaagtcatgcatctgatttgtgctttttgtccaagatgatatactgggattttatgtgttattgattatactgcataactcattaaattctctccttggtaatgtcaacaatttttaaaatttcaaacttataagcatatactgaaattggctttatcatagtttctcaaatttggtgattgtccaatgtgttcatggtgaaattagtataattgtgctaaccactcaatattggacaaccatgctcaaacacgtcttaaaaattatggtgttccagcacttttggaggtgaggtgggtggatcacctgaggttgggcacagtggcaggtgcctgtaaccccagctactcgggatgctgaggcaggagaatcccttgaacccaggaggcagaggttgcagtgagtcaagattgtgccattgcactccagcctggacaacaagagcaaatctccatctcaaaagaaaaaaaaattataatgtttacttttttgatatgctataaaaatatcagtgtcagtaattgcagaaacattgtttaatagcactaatggcgtgaccattcagctccttgtctgccttcagttcctaaatttgctccttccaggagttgtaggtttctgtctgggtcataattagccaaatcccatgttgctgagataataagaccaatacacttgatgaaataccattatgttttcattttagatcaggtttctatcagcagttagtgtttgagtaagatatttgcatcctcaagaagcatagtttggaagacactggtacgtgggataaatgccacgtgaacaaatgaggaaagtgctgttaggtttaaagagaatgaaaaataacttttagctggggtaatcttgtcttcccatcaagatttcaaagcccttaaaagcatgagcactattttatacattatgtgttgtcactgatgtaaatacaaaaatgcaaaatagtctctgccagctgcactattttatatagtctttgttgagtattacttgacttcactacaaacaacattgatttttaaaaggtgattaaagttgtgttaaaaaggtatagtggaaaggtaatttgagaaaaggttagtaaagaatatgtggaagctctttactttccaagttctaaaaacagtgacctgcaccttaccaactacgtagcaggagaggcagaattctgtaaaggttatagtctttggttctaaagctacaagatataggtttgaattctatttccataccttgattagtcatgtcaacttgggcaagttaccaaacctctctgtgccattgattcctcagtggtaaaatggggccaataatgagacctaccttgtagggttgttgtaagaatttagtgaattcagatatgtacaacccttagagcagatcctgcctcataggaaatgctcaacaaatataacttgttgtttttgttattgttatcaccgttctcatctggctctatatttttcttgcagttggttccctggctgctttttacacttatcatctacctcctagcctttgagctaaattcggggcagaaaattcagatggctcagctttcaaactttgtctaataatactccttagaggctgaatttgggggaaaatgtaatctattggctgaaatcagttagttgggttatctgtggttttcaagaataatggtgaactcacatatactgaagcgatccatttaatagtgtcagtgaaataatctatcttaaatattttttagagaatagatagcaacttgcctgaaagttatatattaagaataccttcctcatcacatcaatatatactgtccttttggaaacagactttcctgcaagtcagaatcttaaacagtttggaagagagttttagaaatgtgcaaatgaacttgaaacccacatttgtatagcttgttttatttcagtgcttgagtagtcttttcggtggtctttatcttttattatcccctttcttctttatcaagtaagaaaagggtaggtcattcaaccatgcagaacatatagctgataggaaaacatattcagtttcatattttaaataggtaaatattatgtcaacctctgattgagctaatctaagcaagaaaaataattcagaatcaaacacataatatacagttatagcttactctgcaatgtggatttaaacctacaaagtaacttttagcttacctccattcaagttttagtggccccagactcatataagtatgaatatttatgctaacctagtaatgccatttgaaggagccaccttgtaggatttgcttccacatgtatactcagattctttctgaaatgttgaaataagttgtatatgtgaaatgcaaatcacttaagtgtttgtcagtgagactatacatttattgtacagaaacagtaactctcatcccaccgaaatggtagagaaagatgccttatttagatgttagtcttgggaaattcataatcatctctcatcagttaaatatactgggattattaaaatatttaaaatatttcttaccatgtccttgaatgttgtggagcagaagtttaatttgtatctataccaaaaaaaaatgtattgctaagatttggctgaaaaacactaacattctgccttaaaagtatgttctgttttctttcaattaataaatattttgagcacctacttttagctcacaaatagagattaatataacaatgttgacgatgatagtatcataaaaggggaaataaaaattgttactaaaatgaatatatattcaaccttgccgataagaaaaagaaagaaatattggttccattttcccttacttaaccaagttgccaaaactttaaacagtccattgctgggcattctcactcactgctaatgggaaagtaaattactgtggcttttctggaaggttgtctggtaatgtaaatcaagaatttgaaagtactcaaaacatttgacccaagaaatctacttctaagattttgcattaagaaaatacctaatgttgcaaacagaactttatatgtaaggatctttgtcataatttatttaatggaaagaaatggaaacaacctaatatcccaagataggggattggttaataaattatggttcagctgtgtattggtgtagaactatgtaattagtcatgaggtatgggtaaactatttaatggcacaggaatgttctgatatgttaatttataatgtagtttataaaatgtatataatatatgctgttaattttgtaataaaaccttaatacacataacccatggaaaaaaaagatcagaaagagcttccagtttccagtctgataaatagtgatcttggaggttgtcattcctgttgtcaaaagaaaaaaaactgaatgaactgaaaatcaacaatagatgcagtaagatgggaaatggaaataaaaggtatacatattgggaaggaaaaaacagtattacctttgttcatagatgacatgtttttctgcatagaaaatcccaagggatcaacaacaatgacaaacacactcctgttactaataagtgattattgcaaggttgaagtatacaaagttaatataaaagtcaattgcttttctgtctaccagcaattaacaagtggaatttgaaataaaaaatacaatattatttatataagcagtcattaaaatgaaacaggtgtaaattcaacaaaatatgtacagtatctatatgatgaaagctataaaattctgatgaaagaaataaaaaactaagtagaatggagagatactccatgtttgtgtttaggaaaactcgatattgtcaagatatcagtttttcccaacttgatgaatagatgcaatacaatatcagtaaaatcccagcaagttattttgtggatgtcaacaaactgactctaaagtgtatatggtaaggcaaaacccagaacagccaacacaatattaaaggagaacaaactcactacccaacttcaagacttactattaagctatggtaatcaaagttatgagatattggcaaagtaatagaaaaatagatcaagggaatgtaatagagagcccagaaatagacccaaataaacatcatcaactgatctttaacaaagtaattcaatggagaaaaaatagtcttttgaataaatgggtgctggaacaactgggcatccatatccaaaatgtaaataaatctagacatagatttcacacccttcaccaacatttactcaaaatggaacacagacatgagtgtcaaatgcaaagctaaagaacccttagaggataatataagagaaaaatttaggtaaccttggatttggcaatgacttgcttttttaacttttagtttaggttcagggatacatgtgcaggtttgttaatacaggcaaatgtgtgtcacggggggttggtgtacagataattttgtccccaaatactaagcatagtactcaataggtattttatctgatcctctctctcctcccaccttcatgcctcgagtaggccctagtgtctgttgttatcctctttttgcccattggttctcattatttagctctcacttataagtcagaacatgcagtatttggttttgtgttcctgcattagtttgctaaggataatggccttcagctccatccatgttcttgcaaaggacatgacctcattcttttttatagccgcatagtattccatggtgtatatgtgcacattttatttatccagtctactgttgatggacatttagattgattctgtcttttgtattgtgaatagtgctgcagtgaacatatgcacacatgtgtctttatggtagagtgatttatattcctttgggtgtatacccaataatgggattgtttggtcaaatggaagttctgtttttaggtctttgaggaatcaccacactgctttccacaatggttgaactattttacatcctctccagcagtgtataaccttcccttttctccataacttgccagcatctgttattttttgactttttagtaatagccattctgatgggtgtgagatgatatctaatggtgagtttgatttgcatttctctaatgatcagtgatactgagcacattttcatgtgcttgttgactacatgcgtgtcttttgaaaagtgtctattcatgtcctttatctgctttttaatgaggttatttgttttttgcttataagtttgtttaagttccttacagattcttgatattagaccttcgtcagatgcatagtttgcaaatattttctcccattctgtaggctatctgtttactctgtggatgctttcttttgctgtgcagaagctctttagtttgattagattccacttgctaatttttatttttgttgcagttgcttctggcatctttgtaatgaaatctttgccagttcctttttctagaatggcatttcctaggttatcttccagggtttttatagttttaggttttacatttaagtctttaacccatcttgagttgactttttgtacatggtttaaggaaggggtctagtttcagtcttctgcatatggcgagccagttatcctaacactacgtattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctctttgatactataatagtggatacatgtcattatatatttgtccaaacccacagaatgtgcaataccaagagtgaaccttaatgtgaattttggactttgagtgataatgatgtgtcagtgtagattcatcagtggaaacaattgtacctctctggcaggggatattgataactggggacactatgcatgtgtggcagtggtaacagggggtatatgggaaatctctgtaccttcctcccaattttactgtaaacataagactgctctaaaaaattaagtattaatttaacatataaaaatacataaatactttaaagtatttatataatactttccctccccccacagtttatgggtacatcaaatttctcttcagcaactgcaagcaaagaaagaaaggagtgaaatatttaagttgttgaaagaaaaaggctaccaatctggaattctgtatttagagaatttatttttcaaaaataaatgataagtaaagactttctcagacaaaaagtgagagaatttgtcaccagtagaccttccttgcaggaacttttaacaaaaattcttcataaaaagggctaccaatctggaattctgtattcagagaatttatctttcaaaaataaatgataaataaagactttctcagacaaaaattgagggaatttgtcaccagtagaccttccttgcaggaactattaacaaaaattcttcataaagaagaaaaatgacataggtcagaaacttggatctacataaagaaaggaagaacattagcaaaataataagtgaagtaaaatatttttctttttcttaattgacataataaaggacagtttgttcaaaataaaaatagcagtgatatcttacatgtctgtagcttatgggaaagtggaatgagtaacaggtgtaataaggaatggaagggagggattgggaaaattctgttagaacatatctgttctacacatgcagtggtatagtgttatctaaaagtaaaagtggacttggattaatgtaaatgtatattgtaaactctagggcagccactaaaaactttcttaaacgaagtataattgatatgctcagagaagagagaaaatggaataatataaaatgttcagttaaaaccagagaagacagaaaaagaaaggaagacaaaaaaaaaagtaacaaaaaaactagggcaatgaatagaaagtcattgcaaatacggtcaatattaaactagcaaatcaatagtcactttaaatgtgaatggtctatataaaccaattaaaagacagagactgtcaggggattaaaaatccccaaaatccaactatgtgttatctataagaaaccactttattttaaaaaatatttctaataagttctattgtgtacatttaaggtatacaacatgatgttatgagatacatataaaaattgtaactgtactgaaacaaattagtatatttattcatcttacatggttatccattttcccccacaagagcagttataatcatattaattgaacaatttgtcccttcaagtcaaattcctcagttgtgatgggtcagattcctcaattgtgaccaaccattgcaggtgaaattcaaattttatttttttagtggttttatttttgagaaaaattttatttcacctctcccaatggatagacatttatttcaagatacactgcatcctcttattgtcaacacttcaaacctaccagctactgacatcttgaaacagcataatttgttatccatgactcctgaaagttcctcatgtcaccaacccttatatgatacaaatgtaaagatggctattcgtggaaatgtgttcaccacattgccaagtgtcttgggtctccttttgaaaagaatgttttttcacaaaagtcaacatttccctgaaaatgcagctccatcttctattggtatggtctgtggaagtcacagagactgaaatttcggtccatattatggttgataactacaatttctgttgcaaagtatgcaagcattactttgaactgcatctgatgcaacttggtggtctaggccattacttgcaaattgccaaggcctattttgggaacaatgctttcaattcccttttattgcatgtatcagaacaatatcctgttaactaatatgatggttcattttactgcatatatgagaagaatgtcctgttaaccaatatattttgacttttggttttagtatgttttagtacaaatatccagggacaaattcttcagttgaatacatccaagagacaatttgttcaattgatctgctataatctaatcatttagcaaaaattctgactacaatacactatcattagctatggttctcatgctgcatattagatctttagacttgttcatcctatatatctgctgcattgtattttttgacctgtatctcccatttccacacccctacaccaatcatagtcaccactgttttattctgtatctctgtgaagttgacctttaaaaaaaaaaagataccacatataagtgggatcatgtgatatttttctttgtgtgtgtggcttatttcacttattgtaatgcataccaaagaatattttcagctatacaaaaggaagagatcctgtcattgccataagatggattgacttggaggacattatgctaaatgaaagaaacctagtttaaatataaagacacagatgggttaaaagtaaaggaatggaacaatatatactgtgctagctctaatcaagagaaagctggagttgttatattaatttcagacaaagaagactttaggacaaggaaaattatccgggaaaaatggggggcattacatattaataaaggggtatattctccaagaaaacataacagtccttaatgtgtttgcacttaacaaagcatcaaaatatgtgaggcaaaaactgatagaaatgcaaggagaaatacaaactattagagctggaggcttctatacccctttattagtaatttatagatccatcaggcagaaaatcagtaaggacatagttcaatttaatcatcagtcaactggatttaactgatgtctgtagaatactccatccaacaacatgagaatatacattcttctcaagatcacatggaacattcgccaaaatagaccatattctgggtcataaaacataccttaggaaacacaaaataatagaaatcatactatacttttttttttttttttttttttgaggcagtctcactgtcgcccagggtggagtgcagtggcgcgatctcggctcactgcaagctccacctcctgggttcacaccattctcctgcctcagcctccctagtagctgggactacaggcgcctgccaccacgcccagctaattttttgtgtttttagtagagacgggatttcaccgtgttagccaggatggtctagatctccttaactcgtgattcgcccgcctcggcctcccaaagtgctgggattacaggcgtgagccaccgtgcccggccctacaatatatacttctacaccatactggaattaaactagaaatcagtaacagaaagctgtacaattccaaactatttagagattaaaaaccacacttctaaatcgcacatgggtcaaagaagaagtctcaagagaaattttaaaatattttgagctaaaagaaaatggaaataccacttatcaaaatttgcaggctgcagcaaatgcagtgcttagaaggaaatatatagcaaggaattaatatattaaaagtggaaagatttaaactgaataatacagactaccaccctgggaagctagaaaaagaagagtaaatcaaatccaaactaatcaatagaaaataaattttaatggctacaaaaatacagttagatagaatgaataagatgtagtatttggtagcaaaatagagtgcttttatggattgtgacattggtcatttctaaactttttgcctaaaccagaatcacaaagatattctcctgtttgttcttttagaagttttaaaaaattaggttttaaagtctataacccatcttgagtttatttttatatatagtatgtgatatggattaaggttcattttagtttatgttttgtatattactatccaaatatttaggcagcatttgttgaaagtactatcccttttccattgaattccctttgcacctttgttgaaaatcaattgaccacatatgtgggtagattttgaatctattttattctgttgatctatttgtctaacatttcgccaacaccacattgtcttgaaaacgtcagtctgttgttgttctttttgcttttgagacagagtcttgctctatcgctcaggctggagtgcagtggcacaatcttggctcactgcaacctccgcctctcaggttcaaacgattctcgtgcctcagcctcctgagtagctatgattacaggcgtgtgccgccatgcctggctaatttttgtatttttagtagaaacagggtttcaccaggttggccaggctagtctcgaactccttgcctcaagcgatttgcctgcctcagcctcccaacgtgctgggattacaggcatgagccaccacacccggccaaaaagtgtaattttatattaagtctctgacatgtttcttttgcaaaattgttttggctattctactttctttgcctttccatataaatttttcattagattaccaatttttataaaagatcatgctggtaattcgatttagattgtatggaatctataaatcatattggagagaactgatatcttaacaattttgtatctttcaatccataaataaagtgtatctctccattttttaggccttcattgattttttcatcagcgttttttagctttctaagcgaagatcttacacatattttgttagatttatacttcagtattttcaagttttgggagagctattgaaaatagtacactttcaatattcaatttctaattgttcattataaaatatataaatatgatttataaattctctatagtaactttttaatatattcttatagattttctatgtagaaaattatgtctatttgtgaatagaaagttttatttttttactttccagcatataggccttttatttgttcttcttacccaatttcactgactaatatctccaggagtagtgaagcagacatccttgtataattcctgatcttaggggtaaagcagtctcttgccattaagtgtaatattagctataggttttttgtagatgccctttatcaggttgaggaagtactcattctagtttgcagagactgtctgtcatgaatggatgtagaattttgtcaaatgatttttctgcatctgtggcaatgattacatgattttccttctttggtttgttgatatggtgaattacattgattggattttgaatgttgaactagccttgaatttccaggataagccccacttgctcataaaagtattatctttctacatattgttagatttagtttgttaaaattttgttgagaatttttgcatctatgttcttaagggatatttgtctgtagtttctgttcttgtaatatctttatctggttttggtatcagtgtaaagcttgcattaaatattcagttgggaagtattccctcctcttcagttttctggaagggtttggtagaatgtttgatagaattcaccggtggagccatctgattctggaattttctttgtaagaaagttttcaactacaatttaaattcctttaaaatatataggactattcaggttagatatcttttttttttttttttgagacagagtcttgctctgttacccaggctggagtgcaatggtgccatctcagctcactgcaacctctacctcccatgttcaagtgattctcctgcctcagcctcccgagtatgggattataggcactcaccaccatgcctggctaatttttgtatttttaatagagacagggttttaccatgtaggccaggctggtcttgaactcctgacctcaggtgatccacccacttcggcctcccaaagtgctgggagtacaggtgtgagccaccacgcccagtctcaggttaattatctctttttgattgagctttggtaatgtgtgtctttcaaagaattaatccattttatgttgtttcaagaattaatcattctatgttgttaaactaactggcatacagttattcacattgttccctttttacccttacccttttaatgtctgtagtcaatgcaatgaaaccctcttttttgtctctagtcttagtagtttttgtcttctctctttttatctataggggtttatcaattttattgatcttcctaaagatccagttttgatctcattggtttttccttattgactttctgtcttcaatttcattgatttctgctctttattattctattttttttcttattttgtcctactttttctagtttaagatattgatttgagacttttctccttttccaatatagatatttagtgatacgaatttccttctaagtgcttttttagctgaatccctaaatgatgtgctgtgttttcatttagtacaaaatactttctaatttcctattgatttcttcttcaacccacagactatttatatgctaccagcttcttaaaagtggttatcttcctgtactgggattatgtataatgtttataaaataacactctatattttatagcactttataatttacaaagtgcttcatttaatcctctaacatccacttgagaaacataatatttcacagatgttgaaaaggttatcagggtttgagtgacttactcaatgtcacacagagtaggttaggactcaaacctagattttctgtctcccagtttattattctgaagaaattgtaaagaaaggtttgaaaaataaattggaattcaccttgtgggtatttggaaagattcatagaggttctttgaagcaatcattgatatgaggcatctctctcagtttagttttaatttagatttctgattactagtgaggttgaacatcttttaatatttattctctggtatcgtttggctatgtctccacccaaatccatcttgaattgtaactcccacaattaccacatgtcgtgggagaaacccggcgggaggtcagttatgggggcgggtctttcttgctctgttctaatgatagtgaatgagtcttacaagatctgatggttttaaaaaagggagtttccctgcacaagctctcttctcttgaatgctgccatgtgagatgtgcctttcaccttccaccatgattgtgagacctccccagccacatagaactataagtccaataaacctctttcttttgtaaattgcccagttgcaggtatgactttatcagcagcatgaaaatggactaatacgttgtctgttccaatttcttcttttctgacttgcctatttctgtacttagattgtttttctattggattggttggtcctaattgatttgcatgattaaaatattccaatactaatattttgtttactatttgttcacaatatcttctcttagcttcatgcttatctgtctttattacttcaattttgatcgtcaggaaaatctgcactggactgaagaaaatttgtgtgtttattataagaggagtattgctttattttgagctagtatgatgaaaagtgggagatagaagaggatgggattagaagataaaccacttgatttggaaattcaatttaccaatcatttgtcagttgcttatgcttgcatattgcctataattgcttattgcccacagtgtactaggccatgtgatgaatagagagtaaagaataaatgttacctactttcagggactctgatggagaaatatatcatgtacaataaggcagttaacatggtatgtgctcaagtgaactgtggtataagataagctgtggctaccaaaatttctgttccagcaaaggagagtgagtggtttgagttagttgggagttgtattagtcagggttctctagagggacagaactaataggatatatgtatacatgaaagggagtttattaaggagaactgactcacacgatcacaaggtgaagtcctgtaataggccgtttgcaagttgaggagcaaagaagccattagtggctcagtctgagccccaaaacctcaaaagtagggaagccaacagtgcagccttcagtatgtgactgaaggcccgagagcccctggcaaaccactggtataagtccaagtgtccaaaagccaaagaacttggagtctgatgttcgagggcaggaagcatccagcatggaagaaatatgaaggccagaagactcagcaagtcagcttcttccaccttcttctacctgctttttctggccttgctggcagcaaattggatggtgcccatccaaattgtgggtaggtcttcctctcccagtctactgactcaaatgttaatctcctctggccacatccaaaaacacccagagacacccagatacacccagataggatacacccagaaggatgctttgcatccttcaatccaatcaagttgacacttaatattaaccatcacaggagttgtttaagcaagaattctgtaagttgaatgggagcagggactttgtataaaaattttagttcttttcgtctgcaacacttagcatattgcctgacagtgctcaaatatttgttaaatgattgagtgatgttaacatgtgtaggcaaagccaatcatagagacctaacacaatgcatcatctatcattcctataccaccaacagctctgagaatgttctgatacatccacatttcagacattagcttgcatttccaaagaaagggaacacaaccttttcaagaaaaagaacacatgatatgctccctttatcattgtaacggagtagtagttaaaattttgtattgctgactatggccttatagtatagtttgaaatcaggtagcgtgatgcttccagatttgttctttttgcttagtcctgctttggctatgcaggctcttttttggttccatatgaattttagaattgttttttctaactctgtgaagaatgactgtggtattttgatggggattgtattgaatttgctgattgcttttgtcagtatggtcattttcacaatattaattctacctgtctatgaacatggggtgtgtttccatgtgtttgtgtcatctatgatgtctctcagcagtgtttttagttttccttgtaaaggtctttctactcctttgttagatgtattcctaagtattttattttattttattttattttattttattttattttattttattttattgcatcctttgtaaaaggggttgagttcttgatttgattctccacttgattgcttttggtgtatagaagagctactgatttgtgtacattaatcttgtatccagaaactttgctgaattcttttatcagttttaggagctttctggaagactccttatggttttcaaggtaaacgatcatattgtcagcaaactgggacagtttgacttcctctttactgatctggatggcctttatttctttctcttgtctgattgctctggctaggacttccattactttgttgaagaggagtggtgagagtgggcatccttgtcttgctccagttctcagagggaatgctttcaacttttccccattcagtattatgttagctgtgagtttgtcatagatggcttttattacattaaggtatgtcctttgtatgccgattttgctgagggttttaatcataaagggatactggattttatcgagtgctttttctgcatctattgagatgatcatgtgatttttgtttttaattctgtttatgtggtgtaccacatttattgacttacatatgttaaaccatccttgcatccctggtatgaaacctacttgatcgtggtggattgtctttttgataggttgttggattcagttagatagtattttgttaatgattttagcatctatgttcatcaaagatattggtctgtagtttccttttttggttgtggcctttcctggttttggtgttagggtgatgctggcttcatagaatgaattaaggagggttccttcttgctctgtcttatggagtagtgtcaaaaggattggtaccaattcttctttgaatgtctggcagaattctgctgtgaatccacctggtcctggacttttttttgttggtaatttttaaattaccatttcaatctctctgcttgttattggtttgttcagggtatctaattcttcttgatttaagctaggagggttgtatttttccaggaatttatccatctcttctaggtttcctagtttatgtgtgtaaaggtgttcatagtagtcttgaatgatctttcgtatttcagtatttgaagatactcctgttttgtttctcagtgaggttatttgaattttctctcttttcttggttaatcttgctaatggtctatcgattttatttatcttttcaaagaaccagctttttgtttcacttatcttttgtgtcttttttttgtttcaatttcatttagttctactctgatcttggttatttcctttcttctgctgggtttgggtttggtttgttcttgtttctctagttccttgaggtgtgaccttagattgtctatttgtgctctttcagacttttcgatgtaggtgtttagggttatgcactttcctcttagcactgccttagccttatcccagagattttgataaggttctgtcattattatcattcagtttgaagaatttttaaatttctatcttgattttgtttttcacccaatgctcattcgggagcaggttatttaatttccatttatttgtgtggttttgaaggttccttttggagttgatttccagttttattccactgtggtctgagagagtgcttgatacaatttcgattttcttaaatttattgaggcttgttttatgacctatcatatggtctattttgcagaaagttccatgctctgttgaatagaatgtgtattctgtggttgttggatgaaatattctatatatatcttgtaagtccatttgttccaaggtatagtttaaatccattgtttctttgttgactttgtgtcttgatgatctgtctagtgctgtcagtggaatattgaagtcccctactattactgtgttgctgtctatttcatttcttaggtctgttagtaattgttttataaatttgggatcatggtactggtataaaaataggcatatagaccaatggaacagaatagagaacccagaaataaacccaaatacttacagccaactgatcttcagcaaagcaaacaaaaacataaatgtgggggtccttttcaacaaatagtgctgggataactggcaagccacatgtaagagaatgaaactggatcctcgtctctcaccttatacaaaaatcaactcaagatggattaaggacttaaacctaagacctgaaactataaaaactctagaagataacattggaaaaacccttctagacatttactggggaaacatgccaccaatatttcaacgtaggttctttctattttccataaatgtcaaccggctaagaaataaagagaaagagtacaaagagaggaattttacagctgggccgctgggggtgaaatcacatatcggtaggatggtgatgcccacctgagccacaaaaccagcaagttttattaaggatttcaaaaggggagggggtgcaagaacagggagtaggtcacaagatcacatgcttcaaaggacaaaaaagagaacaaagatcacatgcttctgaggaaacaggacaagggcaaaatcagaaactcctgataagggtccaacaaagatcacaactcaaagggcaaaagcagaattactgataagggtctatgttcagcggtgcacttattgtcttgataaacatcttaaacaacagaaaacagggttcgagagcagagaaccagtgtgacctcaaatttcccagagcggggtttttccccaccctagtaagcctgagggtactgcaggagaccagggtgcatttcagtccttatctcaaccacataagacagacactcccagagcagccatttatagacctccccccaggaatgcattcctttcccagagtaatccttgctaggaaaataatttagagatatcttccctacttgcatgtccatttataggctctctgcaagaagaaaaatatggctctttttgcctgaccctacaggcagtcagacattatggtcgtcttcccttgttccctaaaattgctgttattctgttctttttcaagatgcactgatttcatattgttcaaacccacatgttttacagtcaatttgtacagttaacacaattatcatagtggcactgaggtgatgtacatccttagcttacgaagataacaggattaagagatcaaagtaagacaagtgtaagaaattatgaaagtattgtttgggaactggttaatgtccatgaaatcttcacaatttatgttcctctgccacggctccagccagtccctctgttcggggtccctgacttcccgcaacagacattggcttagacaaggatttcatgaccaaaaacccaaaagcaaatgcaataaaaacaaagataaatagctgtgacctaattaaactaaagagcttttgcatggcaaaaggaacagtcaacagagtaaacaaacaacccacagagtgggagaaaatcttcacaatctatacatctgacaaaggactaatatccagaatttacaatgaacaaatcagtaagaaaaaaaaatcctatcaaaaagtgggccaaggacatgaatagacaattctcaaaagaagatatacaaatgcccaacaaacatatgaaaaaatgatcaacatcactaaagatcagggaaatgcaaatcaaaaccagaatgcaataccaccttactccttcaagaatgaccataatcaaatgcaataccaccatactccttcaagaatgaccataatcaaaaaacgaaaaaacagtagatgttggtgtggatgcagggaatgtaaactagtacatccgctatggaaaacagtgtggagattccttaaataattaaaagtagaactaccatttgatccagaaatcccagtgttgggtatctatgcagaggaaaagaagtcattattcgaaaaagatacttgcacacgcatgtttatagcagcacaatgcacaattgcataattgtagaaccaacccaaatgcccatcaatcaatgagtggataaagaaacatatagataaatagatagatagatagagagacagagacagagagtcagtatgtgtgtgtatatatatatatatatatatgtttctattgattatatatatgtgtgtatatatatatgtgtgtgtgtatatatatgaatactactcagccacaaaaaggaatgaattaacagcatttgcaatgacctagatgagattggagactattattctaagtgaagtaactcagaaatggaaaccgaacatcgtatgatctcactgatatgtgggagctaagctatgaggatgtaaaggcataagaatgatacagtggactttgggcacttggggggaagagtgggagggggacaagagataaaagacaacaaatatggtgcagtgtatactgctagggtgatggatgcaccagggtctcacaaatcaccactaaagaacttactcatgtaaccaaataccacctgtaccccaataacttatggaaaaataaaattaaatttaaaaagattttgtacatcattgtcagacaaacctgggtttgagttccatctcagcttcttactggttatatgactcttgattttccttatctataaaatgagactaataataatatctaccttatgggtcattgtggtgaggatccagtgagcaaagtatgtataacactaatcccctaataggaattctataaatacttgctatgccacttctcttgatgtataataaaatggatggaacttgtgattgcttttgaattttgtgacttggttgatgtttcctaacaggcatattctccatctccttcttcacagattcagagacatattgcatgtttcaagacaagaagtacagagtgggtgagagatggcatccttacctggaaccttatgggttggtttactgcgtgaactgcatctgctcagaggtacaatctctcatgacatgtgatttcccagtttgctcctcagcatgccgagaggctttcagtgcccaaatggccagggaccatggatgataaaatccttaaagaaagtaaagaagcagaccgatcgcactgtctcacgcctataatcccagcactttgtgaggctgaggcatgtggatcacttcagcccgggagttctagaccagcatgggtaacatggcaaaaccccatctctacaaaaagtacaaaaattagctgggcatggtggcacatgcctgttgtctcagctagttgggaggctgaggtgggaggatcacttgagctggggacttctaggctgaagtgaaccgagattataccactgcactccagcatggttgacagaacaagaccctatctcataaaataaaagaagaaagtaagaagacgattgcaagaaaaataaacattttctgtcttctgtcctctcttgctttttggcttgattttcatgggttctctgaatatttactatggacagatatttatgatctcttagcctaatgatatagggcatggttagagaaggcagaagagcctgatagtgggagtggaggcaaaagctcaatagaatgtttagattgtaagacaaagtagtttttgaaaattattttaaggctgacctttagggagaatattaggacaaattataaactggttcattgggagagtggattctatgttgtctcagccaataactgtaattaagactgagtttgtgaaacgttggcctgtacctcttaaggattagagctcccttggcttagccttggctcttgtccagtcatttagaaaggattttggttggcataaatgccatctttgcaatagataaagcaggttgttccatcttcttcccatggtcttgacccaggagcacagctgtggtccatctttctcaacaaacctctgccattatatgttaggctagagtttcttgtttgcactatagatatttgtttgggggctgtcctgcgcattgtgggatgttaagcagtatccctggcctctacccattagacaacaagagcaccaaccccaatcctaataaccaaaaatgtctccagacatggccaagttgcctggggagcaaaaatcacccctggtagagaagtggtgcactaggctaattggaaagggaggccttgtactaggcattgagaattctgaacttacacaaagaattttcaagaccagcttcttacctgagaccttttgtaaggactgcacctcttccctcatgcccagctagagcaggaacaatcacttgcaagcctgatccatttaccatttgaacataattttgggctgtcagaattttgagcatgtggaaacataattatcaggtaacatcaggcagtattaagaggctatgaggttctagaataaagacagaccaagtttccagccctgcctctgccacttatgagccactggacaagttacctgacctctgtgatattcattcatcttcctctttttataaatgggataatgatattaccatttcatatggttctgataaggattaaatttacaaatccatttaaatcatttaaaacaatacttagtcttggtaaacattcaagaaatgttaacagctgttattgtcatcattgttgtccttatcattgtggttatcatcatcatcgttattattattaatctattagctctagaacagaattcagtatatagcattaatgaggattcactttagacctcagctgggaggtgtggtttctgatgtgcttcagtgatctcaattcaagattataccacctgcctctgaggagtgtgatacctgaggagcttctgtggtgttgccaaatgcaacactccaaaaaaaattattctagaaagtacacaagaaaaggaaaaggttgggataaggcaattccaatttggataaaagaagcccgcctctttaaatggttagggcatgtattaaatagatcatttggggattgattaactgcctgggatggcctgattttgtcggattcttgacgcgacacatttcgacacgttggagatggacagctaaccattgggagctgaggctttgatgtctgcaacgcagtcaaaatgttaaaatgatcccaatgccaacagctcaagcacaaggcattttctatttctatatcctcttcactactttcttcccccacaacagcctgacaaatacaagtagcccttgctgcaaatgatttatggatggaaaatgtaaatgaaaaatttatttccagactatgtctttgttctagaaatggttgtgagctgtcagagcgaggggtcttgtaattgtaaatcaggcagggacccagtcgccccacccaggcatactacctaatcagctaaattccaaactctagctcgtcctcagaagaattttggctaaaaaggaaatgagaagaatcacttggcccactgggccaaggcagatttatatggaatccaggatccacctgctagggatgcctccttgcccagggctgggtagcagctcaggggacccattgctcattgtgtctttcatgttattggacaggtgattatgaaatcagagtaggttcttggaaaagacatgcagctagagctggggaatggtagaaatgccatggagccaggccagaagaagcctcccacaattaatgggaagctttgaaaattggaggagtggtgatctcagccttagaaaaatatgccaataaactatcaaccaacccagcagaggtgctggtgatgagaaaaggaaagaaaatgttgaatgcattcagcttcttgggaatgcattattcactgcctgggtgagtccctgcatgactgtttcccaaactggcttgatcccagcgacctttgaaagacatttattttttctcattgccttctctttttcagaatgggaatgtgctttgcagccgagtcagatgtccaaatgttcattgcctttctcctgtgcatattcctcatctgtgctgccctcgctgcccaggtaaagcaatttgtctctttctttcctagctgtggttctccatttccctcttcacccaactcaactcatctccataattccccagaagggaaacttccagacagataacaataggaacctttaggcagtccaaactggcctctaaatactttttatagcccaaatggggtacattctaggctctaataagttattgggtacccagtaacagatttttattgggcttttaatcatttgaaggtgggtgtcaatcggagatggaaattgtggcccagagattttctgctataagcagcctcttcctgccatgggcagcaggcaccaggagagttgcagcatggcggcatgtgtcttatacaattagtgctggaattgcatccgagcatagcttctaaattatgagggggccattcataaatcaaaggagctgacccagtgaggtttatgacagtataaagctgcctgcctgctgaatagtcacctcctccagactgcagttattatgtacacattgttaagtgtaattctaaggggcagccaggcagagaatttttcacacaactgttaggacatctactttcacgatttgcagctacggtatttgtctgaggcaggggctccctcaatgacactttgttcatgtctgactggggcccgattcccaccccaaaagcgtgtggagtgattcagagaatgcctgtgggcccagtggcaatcctagaaaaagctacttgacactcttgggctttgtgaagtagaagccttatcatcctgtaagttgattccatttccctttagggtagaaattcttgaactagggttcctggatgggcttttgagggtcagagaaccctttaaaattgcttgcagtttttggtgtaactatgtatatttgtaaattcctttagagaacatccgcagctttattgtcagtcccaaaggggtgtacaggaagaaccactaccccagctaaggtatagacggtgctttttaagtggtgaggaacttccagaacttataagagagaaaccaaatgtatccaggcaaaaatgttaggaataaggctgggaatggggttcaatgaaaacccagtcaactgaaatgttccaagagtggagaatttttttttaatggagaagaaacacccaaactctttttgtcactacctttataaaatatattttcctgcatcagtaaatacaccctaatgaacacaggtgattcatttccagatggcagaatatcatgccatatcacaggtttttaaattctgagtgttggtgctgatagtatatgctttgagatgtcagagattgacttggcatatgaccaacctaaaagttgttgggttttttttggaataagtccctaagccaggcttactgtttctgtatgtgtttatttgcttcttcttcctaaactggattgcaagaatgtggtatgggtgggggtgggggcgctctggtaaatgggaacaatgtttctgataaagttgccactctggagagcttctttgttttttttttttttgtttttttgttttttgttttttgtttttgttttttggttaacctgccaggtagcctgtcagacagccttataaaagctttttattcctcagaagtctccaaaagtggtctaatgtcataggaacttatctaaacttctgtgtaaagattgttcttccctgggaagaaggttgaggcatgacccagacccagagcatggggcaaaacaacatagaatagaatatggctgcacctaccccagctgcctaacaggaagcaagtattgagaaaaagggaaagtataagctagcagttattttgagagaaaaataaagtgttaaaagaactgagctcaaaaattccagaggtgaaagcgttgaaagaaataaacaccattatggttaagacttaaaaagctcattttatggtatggaggatagaaataaactattccttttcttttccttcttgctcttgcagctcacttctccatgagttcatttttcttcttgttaactataacctttaacagctctttctgtgggtagtagttctaaaattccttagtccttatatacaaaaaagtgtatttattttacaaccattcttgaatgataatttggctgggtatgaaattataggtgcatgttcatctcccctcagcactttgaagatattactaaatggtttgttggctttatgtttgtttatttgtttgtggttaagaattctgctatttgtagttcttttgcgggttcttcgttttttttttcttctagcttttaaaactttcttcttttcattgatgcacacaatgagatgtgtaagtttgattattctcttcagcctgctcagcacatgattttttcagccaaaggagtcaaatttctcttcaatttttagtcagttttttttttgaaaattatctcttcaccttcttattttttctcattctcaaaattgtctttggtgtatattattgcatctcatttaatttatcctttatgtctcctaatgtctcctttatttttccctcctgatattctccctaaaatgatatattacttcaactctgttctccaattcatgaattctttccatgcatactatttaggccatgtgttgggttttgtttgtttctttgtttattttcaataaccttgtttcccctcaggttttcaagttatttaaaaagacatctacatgatgctaatttataacctgttattgttttggggaatcttattctcttttttacttctttaaagtatttaaaagtttatttgaagtccatttcagattgttcaaatatctaaatatttttagatgtgaattgtcacctttgttgggtttcttgacagcttttcttagttctgaattttccttggttttctactttttctttcaaagctcattatccatgggtgttttgggtttgttttgtttgtttgtttttgtttttgttttttcttacatgagcccttctttgtgggatggttgttgcaggctttatagttcactttgctctaaaccaggtcatatattaatgactcggtttgggctgcctcatgcctgaatggtctatttctacctctgttttcttgtgcactactagtctctgataatgatcatggactgatctacaactgcctcatctacaactgcctaacttggacaatcagtgttttttagggaacactgagtggggagagctatgtcagcccctgtttacatgcgagtagtgtgaccctagtccccaacttcacatgggaagccacttgcaagctgtagtttctcctcagccatttggatccaaactatccatattcagtcccagctgctgatggaccatatggctttggctcccatttattgctgtactttccttctatattttattccacgaagagtttttttgtgtttctgaatataattttgcagttttcacgttttatttatttatttttctagttccacatttcatctctctttgttttgaaaataacagggagatttctcatgtgttctctttgccatattgaaccagaatgcaaccagctattctttctttctactgaagataaaacaagagtaaatagctttaaatcatagcagagaggagtggagcttgacaaaaggaagaactttgaacaccgtggctgttaaatcctagaataaatgactaaggataattttagtctctttacttaatatttctagaaataaaaaggtacccacccatctgagatagagttggcacagtcctgctttgagacagggcaatggatgtgatgactcctctgtgttccttccaccccagtgattattaggcatgaggaaactcatgccttcagggccacagaaatgtttggtcaaagaaaagggctctggttttccatcttaacccaatggaaggcactgtgatgaaaatgtcctcatttaagaagaaaatatttaaagccaagatgatgaataagctccgtataaaaagacgacaaataagcaaactgtataccccagatactggctttacatactgtcctatagcagtattgatttagagaagcttttgcctaggtggtaacagactcagtggaagtgtcctacctatcatgcttagagcttagtttccattgaaggagacagaggagccatctcatttcatttgtttatgtatttcccatggctcttgctttctaaactcgttacccctaaaatttccaaggagcccacctgtatttgaaattgtctcctacagctcctgctaaaccgtggaaatcagagtatgcaggcagctcttccagaaataccagagagaaatctatactgattcccacaaagagcaaataaattttttttcatcagcacttgtccaagtcttggcagaggtcaagtcttagtcacataccacagtgctctactgggcccaaagaggctacatggaggctggaacattcttaatggaaaagtcaagactgcataggactcatgaacgtcattaaattcatcctggtctctaagcaagactctgtggagtccctgataattaagagattttagtgatttgaaggaattaaattccctatcttctcttttgggggaatgaagtggtaatgctggaagggaaagtaaaacaacatgacttattttcataatatgtgtatgtatatatttcataatatatatattttattttatatatatgcacagagagagaattttatcacaaaaagaagaattttatagtgatcaggagtctaaatcatgatattatctaagagggctttttaaaatggtcattccactgagaatttgctattcagaattaataaatttgggttttcctggaggtattccagcattcctgggttattaaagagctcttataaaattgccaaaataactgatttgatctggttaacagagacctaatccacagtgtttccttttggctaggtgtgaaaaagtttggcactatgaatggttttaataggaatagtgacagtgtggtttgccaagagagacaccccagtcttagatattcaaggtaggttagggaaaagaccttaccagtgttgcactatagtatgtgttcccataaggagaatgtgggaagccctgtgtcatttctctttcaacaatagttgggttgtgagtgagctagcaaacacaggcatttctgccacaatacaatatgcacatatctgaaaatcctcacattctacaaaattgtacactgaaaaatcacagggcttaaggaaaaagtagcattagagaaaaccactcaaaacttaggcaactttgtaaccagaatattaacaaagcaactatactaatgaaatactaacacagtttaaaaaggcatcttacatttctaataaaatattacagtaaatatagacttctagacttcaccttttaaaatggtaacattagcttgaaggaacagtgtttaaggaaggattgaagctgctaagttatagagacaacagtaaattgcacaaagatcacggagaatcatgtaataagcacttacaagacagagcatgtggcccaactgaggcaagaggaagaatgtagggcaaatggcttcctgatttcagttgagttagtgtacttggcttttagctgctgtcacttggtagtgcaaaatattaatttgctgggtaatcatgtatgaactaatgcaatttctattttataccaacttcattcccttatttagcactcacatatgaaccacttgtgttacacaaatccacactatagcacagactgtgtaagatgaggtgggtacatggcatttgactgtagacaagtttagagtaagagttgaaaatcacttgtttactctgaatctgcttttttttgtctttaatcactgacctatctgcccttgtgttccccttttctcccatcccatgtatttatattaaaaaggagtctagagtctaggtctatgactatgtctgtctatatctgtgacttccacagttacagtaatcaagtagacaggccttttgtgtttcctccagtttttttctagggaaggttcaaaagagagatttatttatttattattgtggtaaaagatgcataacataaaatgtatcattttagtgtataattcagtggcattaagaacatttacaatattgtacaagtggtaagaacatttaccactaatctagtttctgaaatttttcaccaccccaaaaggaaacctattacacagtcactctccattccccttttcccctagcccctggtaaccatgaatctacttctctatggatttgcctattctggacatttcacataagtggaatcatacaatttgtggccttttgcatctagtttcattcacttagcatagtgttttcaaggttcacccatgttgtagcatgtatcagtatgacatttctttttagggctgaataatcttccattattatgcatagaccactttcgttatccattcatctgttggtagtcatttgggttgtttccaccttttggccattgtgaataacgctgctacggacatttatatacaagtttttgtgtggcatatgttttcaattattttgtatatacctaggagtggaaattctgggtcttatggtaattttatttttaatttattgaggaatctctcttaaattttaaggttgccccatcttcttttagttcatttctttgagtacctactgccagccatcctcatggttgctgctgatttgctgcttttgccaccatccatatctgatctccattgctctcttctctcttctattctcttctgaattctatattcgtttgtctcttggattttatcaaaacagatcaattcctttttaacagtaacagccaattagcatattgttttccctagtaaggtgactacaatagctgtagtgtgcaagatgatcaaccaggagccactcctttgcctgcaaaagattggtatatatattacacataataattacatatatatatatatgggtccagagttatccaaaagcctgaggattctgaaatgttggtgtctgaatagcagatattttgctttattattattattactattttaggttacagaggggctgccaaaggagatgttcacttttgatcactagaccctccatgtccatactgactgttctcttagacccctttaaccatcttccatgccttatttccactatttttctcatactgttggtccttggacacttgacacagtacaaggggttaaaaccttcttcaagaaagtagcatttgctgggtgcactggctcacgcctgtaatcccagcactttgggaggccgaggcaggcagatcacgaagtcaagagattgagaccatcctggtcaacatggtgaaactctgtctctatttaaaatacaaaaaaattagctgggtgtggtggtgcatgcctgtagtcccagctactcagaaggctgaggcaggaggatcgcttgaacccaggaggtggaggttgcagtgagacaagatcgtgcctacccttcccagcctctagtaaccactattctactttctgtttctatgagatcaacttttttagcttccacatatgagtgagaacacacggtgtttatcttactgttcctgacttattttgcttaacttagtattttcaagtctcattcatgttgctgtgaatgacaggatttctttattttttatggctgaataatactccattgtgtatatataccacattttctttatccattcttccgttgatggaaacttacgttgattccatatcttgctgttgtgtgtggtcctgcgataaacatagggatgtagctatccctttaatacactgatttccctttttttggatatatacccagtagtaggattgctggatcatatagtagttttatttgtagcttttttaagaagcctccatactgttttccatagtagctgtactgatttacattcccaccaacagcatatgagttcccttttctccacatcctcactagaatctattacattttgtctttttgaacataaccattctaactgggctgagatgatacctcattgtggctttgatttgtatttttctgatgattagtgatgttgagcatttttatatacttgttgtctatttatatgacagagccttgatacattagtacccattatgaatctaccagagaggtatatgggatgtaacattgtctaaatttattcagccataatacccattttttggaggcactttgcagaattagggttctttgttatgtgcttcaagaagtgttgtattttgccattcaatttctaggagcaatgtatgttatagcaataagctattggtatatacagtatcttagtttggagaagtttgttagggtagtaggcaattttagcacaagaccctaaactagtactactcaaattttaacatgcttaaggatcaccttgggagatttgataaaatgcagactcccagaccctacaccaaaaatcctgaatcatttaggctgcagtgggtgtcatgcatttcacacaagcatcccagttaattctgatgcagtcggattgaggactgcactacagtaatagggcccaggggagattttgagaaaggaggtcaagagaactgcccacagaaagccgttctgggtaagatcttgcagcagtgggatctccagagggctgtgggcaacatgacaacattgtttcgctgataatggagcacatagacactctggaaacacattttccttgtgtgacatttccccaggactaaccctgcagtaacatgtgcacaatgtgccatctggcctgcccctctgctttcccagagctcccacccaaaggctgcctcttctgccatcttccacattcagagtccttggctgtcatgtccagaaagcaagaccctccgtggggagcttccccctctaccccgcccattgttcatgacttgttgttggcgagaaatgaatggcatttctcggaattagcccaggaatttctgctgataaacaaatgaaactctcaaagggaaaagcaatcaacatagtttgaaataaaatcagtgttttcagcttagtctgtttttaacttagtttgaaataagagtcacatctagggtattttaaggaaaggattagcaaaatgtcctgtagtgggcttttcatctgagttgccagactgacccttgaaccagggcctgttttcttcttgagtaagcagaagaggcaattattaccttgatttcctgtgacctgtgattctgagacctgtccagccatcggatcagctttgcccaagcccacccccacttccctgccaagttgcctgacacctgaaattgtcattacagcttaatcttttaaatttaggccttgtcctgataaattcaccaatctttgaaggtagtaaattaactcttattaatcatttttactttcgtctgaacacaggatttagaaagcagattttgattgtagaaagaggagacaggtgttgcggggggaagatcccgaggccactaagctcagctgggcacctgaagagttacaaagggagaggggcctgttgaaggaagggcctaaggagtcaagctttacctaccccaaagtcctgcagaacaccagtagtatttaggataagttctttatttgtagcagaggacacagtggtttctagaatgagttgccagctctcaagtttttcactttagtgttgttaatttaaaaccaatatgttctcaaagtaaccagatatccttgctatctgttgcctagagccaaagagttttacttcagggttttggacttaaaatgactgtaacccaaaaggtttgccagattatttgcagccactaagataagcaattgtctttattagaatgatttttgtctgatttttgtgtttagaattttataccatcagctattccctaaaagtgattttaggaactggcagacttagggtgtcagttattgaaatctgttccaaaatccgcctcctcacaggactccatttttggccatcaaagtagtctattttataaatgtcttgatgtgttgtcttttgtctttgccacatatactctaagacacagagactgggaagtggttcagcaaatatatgtatggctacttacaaagtgttttctagagttatgctcccagaattggagataggctaagaaatatatgtactgtatctctcagtaaagggctaaatcaaagctgtctgcaggagggggaggaagagggctgcttggattttagtttaattgagaagacagagaaatacgtcaaacttgggagttgaggttattttttggaacatgaagataatgtaagtgtccccacaagctctttttcttttcttcaataaattcatcctgttttgatttcttcacattcacaagattgtgccctcagggatctaaggccaaatcagagtccacactcactatcataccttttatataatatattcttttattattttaatagagaaatggatattgagaaggagaggacaaggaaatgtggcatgctttcttccttgttttctttctttgtttcccttctttccttccctcattccttcctttttattttcattctcttttttgtttaatttgtgattattttcttgtgctaaaaatccataacataaaatttaccattttaaccatttttatgtgtacagttcagtaacattaagtgcattcacactgttgcacaaccatctccaccatccatctccagaacattttcatctccccaaactgaatctctatacccattaaacactaactcctcactttctacttcctgtctctatgaatttgactactctcagtacctcatatgaatggcattatgccgtatttatccttttgtgatgggctttttttgcttagcataatgtctttaaggttcatccaggatgtagtgtgtctctttttcaaatggggaagagagagaagaaatttgagaagaggctggtggtagaaatgaggaagtgaagtcaggagacaaccaaagagtcttagaggaatctagcaaatgttgcttttcagaacacattttttctggaagactccagagaccacactgtctttgaaaatgacaggcctgacaagcagtaactagtattactgcctgtgtgaaatgctaggttttgaaagacgtgttccttattaatgttccccagggaacttcagagagtgtcatctattaggagctgattactggcaagttttgtcatctgcttttggagaaatccataggaatagaacagtacccctgtttctctttatctggagaagtacttttccaaaagggcctcttctgcgattgctttctgagggaaattgtgtctggagccattcaacatagctttattagaaagattattaaaggattagagtatgaaacctatgaggtgatgttgaaggaaaactgtaattactgaaactggtgaaagaaagacaggggccttcaccaagtttcagaaacataaatgggtcttagaggaggctgatcagctttctccttccacttccaaagggggagaaagagtagaagtgagcttcagtataaaaaacttaggcacaaaaaagtagttccaggcatagataagggaagctgaagtcattttacagtcaatatattatattaatagctcaggctcaatgctgagtaaacacaagacacacataaatgcacaaacgcatacaatatgattccattaatatcaagttcaaaatagggaaaagtaaactatattgattatggatgtgcataaatgtgataaaactacaatggaaagtgaagaaatgattatcacaatagtcagcatggtggtgagttgacctccattggggggtggtgcttctggggtgttggcaatgcactctttcttgatccacgtggtagtcacatgggtgtttgctttgaaagcatcagtacaactctacatttatgttgtacgtatgtaagttatatttcccagtataatataaagtgggattacattttcatttgttcttgatggttctgattggaggcaaaagtaccagaagaccttgcaagattacaaccaagcataggattctgtatgtgcatatggcaatttgggggactgttatatttgtctacttgtttgcattgttttggtcttcttgatgtttggttttgtgtgtgtgtgtgtgtgtgtgtgtgttttgttttgatttttttttttttggtttttggtttttgggtctttttgtcacaaagaatagcagtaccaaaacctagagaaaggtgtgctccttgtcctctaagtgggctcttggaattagtaagtaggcatttgaggcattgatttctaagctgtagagtgcacagtgtattggcatctggatgaagccatctggctccaggattttatcactgaccagagggccagagggcatgtttggcttccaggaagtcaggctggtcaggaacccctttgggaaggaagaagggctttggacctgtggagtatgcctgccttccctcaaagtgaggttttattgtgttatcatggggggaggaaggcagggggggccaataaagagatggggcctcgctctgctgtccttccagttcactgtgggacattcacagagctgattaacctctttgtacctattttctcagcttgtaaaatgagatgataattcctgccttctcttaaagtttgcattgacagtgaacaagaaagttgatatgggaaattgctttgaaaagtataaggaggtatatataatcaaggcagtgatcagcaatgaaaagaaggtatttaaatcctgggtccccagatttcatctgggcatatctcaatatgggcaaagcctgaaaccatagcattttggtacgtgttcctctagatcccaatgatagcagcctcataaccaggcattgaccatgtgtctccagcctcagggaaaagatgaggggagtctaaaggaaacaagtgacaggtttaatgactgtcaggcaaaaggcattaaattaatggcatcacctctgccttgcctttctatttccttctgattagattttcagaggtgcctgtgtgagtatgccgcacaataatgctgatgttctcaaagctgagtgagctcttaacagaaacataaggtagtgctgagaatgcactcagagacaaggtaaaaatctctagactgccttgagaaattgaaggggatttttctgggggagggctagaactgatacctcctccctcctaaatcataaaaagagagagcaagattcaccattatgtgttgattaggctgccttactcctgtttggttcctaccttctgctaatccgtggtcttgctagaggctgtcatctggcgcctcttgcaggagcacagtgtgtccgtactgcagggggcctctcagaccactgggatcagggaaatgagccattgctgtagtgttacttccaaaccagggaggatcagcacacacacacaccctttctgcccccaccaacttctccagggctttagaaatgtctgggaactgttttgttcgtcacagtaatgggaggatgtcattggcatttagtgggcagcaacaagagatgcaaaatgttccacaataagtaggaacacaacgcatggaagaagtgtcccacacaaaattccagtggtggctctattgagaaatactggacagcagccttagtcagagaagcctagtgaagggcgtctcttcctaaccagaagttggtggtatgagtccacacattcattaattcactcactcactcatattaatttcacaaacatttacagagtataagctttgagacatagcccatgtatggtgctgaggtttcagagttcctgcctcgacgagttcacaatctagtggaggagacacgcataacaagattattaaaatgtaatgtgatgagtactctggtagaagtgtggacaagggctgtgcaggcagagaggggagaagataggcactctccaagagccaggaatcaggcacagtcccagaggggagtggacatttgagctgggttctgacagatgaatggcactttgccagatgtagaagagggaggtggggagggcacgtgcagaggcatgtgtgggatccgtgactgcagttgagtatggtctgtgtaggagggaggaggctggaaatgtcagattgatggaggcccagtctcaaaggaccttgtacatcctgtgggtagacattattttgcagagccagcccactgcaaaagtagggaggaggtgcagtttgtctttagtgttcttggatgtctttttgcatcccctttcctctcttgcagtccctcatatcctcatctctctcccagccacttacaaaggcagctgatgagactccttccagcagaaaggtcaatgcttagcttaactgtaagaattcactaaggatagatttctggatgtcaaagggagagtctttgggcagagaacctggaagaactgagcactatggagatagggcagaggagctttgttcagtttacacacacttgatgtaagtgtaagtgtatgtaagcgtgtgggtgagcatgtatgttggagtgggtgacattgtgtggtatgtatgtgtgtgtgtgtgtgtgtgtgtgtgtgtgtgtgaatgagagagagggagaaatgggacaatgatagttcctatctcaaaggactgttgtgaggattaactgaattaaggtatctaaaggagttagcatagtgccctgcccatagtataccctcaataaatgcaaggtattgttggtattattttagaatgcagggccagaattcagtctggagaagggggaacatgcttactaccaagatggagatgaagattttacactaaggcttagtggctacgtctggctagtttcaaatatgtgcctaggacacattctatcactgggataatataatttttcagcatgttggcttatcagaatgtacatgttcccaagtggagccatagcattacactgtatatatttgggtactttctccatctctactcatggaacacatggcaggtagaaagctgttgttttacaaatgacgtggacctgtcttgaggcccagatcagctgatctgtcctcatgtatagcaacataaaatagaagaaccacagcactagggccagagccagggagatgcattagaaaggaattaacttgggaggatctgaattagggaacaaaagtactagccagagaaggaaggaagaagcaaaaagggggaaaaaaatcactaaaaggacaggatacataagatcatccagctgcccccaaactgaacttacaatgttttctgtgttctctttggaagaggagttggcttgtccagaattcaatggaaacttgttgattgacactgaattgggcacaagttcaatgtgagtgcgcctgcagctatttatttgattttttaaaaatgcaccctttgcagtaagactgtttagtttctactggcgccctggggcagtgagtttagattgttaaaatagcagccattaacactctctgtgttatgacactgtccttcctaccccactttagaggaatcaggcatgaggttgtttgacaaaagtttaattctcctctccccaccaaaagaaactgagattcctcctctgagtcagaggcacgtttgcccagccctaaccctgaaaacctccaagtctgcctacccgcctcaccaccatccccacaaacacacacacgtgactctcatgtacatctggaacacacacactttcacatacactctcacaggctcacacccacacccatcccacaagctagaggaaccctagggagcccttgtgcttgtcttgctgttcttttgttttgctttcctgtatttgctttgttttgatttgaaatcagtctttgggattacattggataattttttcatgttattaatagtgctgtgcagggagcatgtaaggacttcctcctcagtcctggccatgcttgcttccccaaatacaatgctgactctcattgatcaatcaaactgatctttgtcagactttgcatacaatacctcatgggcaaatagctcagggagctctaaaagatgcctgaattctgggattatctagattattcatgagtctgcttaaaaggaaattttttaaggcaggactggatagctatggctttcccaaaggccctggggaaaaatcaaaggagcagagacaatgtggaaagtgtggaactgctcagctcccagagcaaggcaataatctgaccaaacactaagcccccacccaaagtcagcattggtcaggctgaacagccatcatgagcacaagcctaggaggcatggaagggaagttctgtgttctctggacatctgtgatacatgttgtctataccagcactgtccaatagaactttttgcaatgatggaaacattctatatctgcactttccaatgtggcagccattagtataggtggctgttgaacatttgaaatgtgactggtgtgagactgagaagctgcattttaaattggatttaatgttaatcggtttaaatatgaatagacatatgtgactagtggttactgtggtgtatggcacagctttatcccattcgctggatacttctgtgcggcagtgaatttaattttgtacctcctctctgttcagtgtcttgcaactacatcataaactttttgagggcaggaatcatatattgtacaactacagaaagttataccttgaaaagatattttttttcagctgcctctccccatatttgacaaatagggagactgcgaaagactctgtaactttcttgaagtgacagcactcattagtaacattacctgagcctggaacccaggtctccttgcctcccggactgtgcttctaccacatctcccttgcagacaagttttcgaaagaggaagagttttcttcctctccactttcttcactgtttatatctgagattcagcccctgatacttggaaataatttggatctcaagtctacatttatctcctcatctgccaaggcacaaaataggctctggacaaatgtctgtggggtgaaaattctctgaggtctttctgttgtctgttatcttctatatttttaaagaaaatctttttctgcctcagtgtgtttgagacaaccattacttatgctgtttcagcccagggagatggggcctctgtagatgtggccctggcctgtgcaggtgctcaggtatacattagagaagcctgtgcaacagcctggcaggctgataaaaaagctgtagcagtttgggacctgggcccctctgtcttctaaattctctagacttgatggtagacaaggatgccatcagacatagcgccctcccttcaccacattttcatagtaacctagaactaaagatgcttcagggaggagtctagggccatatcttactggttactttagaaagtaagagaaaatacccagtagaaactaacctcagaatcacctgctaaaagaaagaataattcaacttgtaggtccaagtaaagtatcctttcatctctcttctcctttctctgttttccaccccaggcctttgccctcaacccagagccaacctatggtaacacagcaatagctgaattgaagcaaaacctgttaacagtcaccaaaggctgagtttcggccaagcagatagctcctccaggcagcccttcaaaagccaggcagaggcaagggggtaaatagcctgtggcctatctgcagtagaatggccagatggtttgctggtgccaccaaatgaaggagtgatctggtactaagatagaaggcttccagggaccctcccagccctaaaaatcttaagcccaagtgtagtcatcagatgccaaggacactggagaaagtctttggagcatgtagaacaccaagccaattggagtgcctgctaggacagcacaggattcctagaattccggccacaccatatacacccccacccccagagggcagccagtggccacagcagaggccttacccagcaggctgagaccctcatcagaccctccaagagcctacttccttacttagggcctgcctgcttgcactgtgctgagttcagggaggtggacaaactgtacctcccactttagcctaagaatctgacttgccatggactctccaggcagtgaatcattttgagcaagcacttaagcaactttccactgagtcattctgaggactgtcaggtttgctaatcctgatatatactgtgtataccctttgttcagatcctatacccatcctgatattggaggagaggggttataaacaacagaactttaaggatgtgctcattagaagtcatttgtattagggttccctttgccctactgactctaacagggcctgaagcactaagagaaatcctgctggtaccaacttttgatttgtgtatgcttttggttacatagctatcaagagtatgtactctttacctggagtggcagtgcacattggatttcttttccagaccctccatggatctgttttcctttggcttcttctagactaggggccagcatttctttttttctgtaaagggccaaatagtatatatgctagcattagcaggccttgaagtctctgctgtagcaactcttgcattgtaatgtgaaagcagtcataggcagtatgtaaataaatgggcatgaatatgttccaataaaactttatttacaaaaacaagttgcaggtcatatctggcctataacccctgttctagacacaataggctaagtcaaattagtagctgagacttagtttcagctgctagagtgcttaagcatatcacattggggaaaaaatcactcttatcctccattcttttggggaagagaggtagaaattgcaggaatattttcatctttcccattttgaatatcaaagcccattcctcatcaaatattacatactccatagtaatcagaattggctaaagtatgatgcagtagcaacctacaaagttcaggacttaaaacaacaaagatttatttcttactcatactacctctttgtcttaggttggtgcctgtcattatcaccaacagactctggctgacagtgccgcaccatcgggaatttagttccagcactatgggaagggaatataacacactgtggtctggctgtttaagacttttggccaggagtgatacagattacttctgctcatctggcattggccagagcaagtcacactaccatgacttgacttctacaggacagggaaatgcaatactaccatgtgcctggaaggaggagaatttgaatattgatggaaagccctaatgacaatcacacactctaagaactccttttcagtttcttcttcatgtcattccttgcctacctttaggttatctggcctagttgtatcttttgtccaaccctacctggccttcctcagacatgctggtcattgacattgatacatgggggagggacaacttagggactaaagcattgggacagtaattattccctaaaatgctgtgtagaccagcatgaacatgaagtcaggcctcagagccaggtcttacatgccgttggatccaagggttgattgccattgggcagcaagcctgagaaaaattggacctcccataactctggttttgatttcactttagtttacttttaatgagaatttgaatcagagaggaagttctaagcatattgactttaggcagtgccttcccttagtgctatggagagcagttatcaagagggaagaggaatatggaatgtgaaaggtagaaagtataggtgatattaatgcagtattatgggctaaagtgaaacatatggcccatgattttagaagaaggaatatatctgcaaagacaaaataattagttgggataagcccattgctctaacaatccccaaatcttagtgactaaagacaatgaatgtgggagtggaggggcctatggagagggagggcttttgctccatgcagtcattcagggacccaggcccctttcactctagtggtctttctttcctctagagtctcacagttcatcactggagcctctggtatgtggtccttagtttagggaaaagaaagcaaggagagttttgcaggacgttttataggtcagtcttctaaggcatgtttatcatttcttcccacattcaattgactggaactcattcacatggctccacctaactgcaggcgagactatggaatgtagtgtagctgggtgccaggagtggaggatggagatgggtttaatgagcacacaacattgtgtattccgctgcatacttgtcttgagcaagggtgattttttgtaggaagggttcagtctgactgagtcttaactgaagtcttcatcaacatactctcaatattgaaatgttttccccttacagagcactgtcggccttggttgaacagaagactagtcctgactgcagaggccttagataaatgcaattttgccagtccttacattttacttcataattcacatggcctctggacagatatgtaagagcacttgcattctcattggtacaggtttgggatatgtatcctggggcaggaacgtgaaatagatgacattcaatggtatcgtgagcaatgatcctaggaaattcattctgaatcctaaactgggcgtaaaccattcttaaaaagtaaaaggaaaccattaaaattggaactacataactaatctttgttccatttttggcctggctaccagggcattcagagtcctttaacacactcacatagaatacatagaataattatgttaatcctattcattgtttttttttttttttgaaggagtctcactctgtcacccaggctggagtgtagtggcgcagtgtcggctcactacaagctccacctcccgggttcacgccattctcctgcctcagcctcccacgtagctgggactacaggcgcccgccaccacgccgagctaattttttgtatttttaggagagatggggtttcaccgtgttagccaggatggtctcgatctcttgaccttgtgatccacccgcctcagcctcccaaagtgctgggattacaggtgtggtatttcttatagctacttctcggttcaggtgttttctattttcaattacttcatgatatatgttgtttgttgagaacaggagaaaaaaataaggcatggcttcttcttgttttatttaggctcggtttgaagactggcatttgtgaaaaagatttttctgtgtctatcgtgacttcctgagcagttggttttatatggtgtagttttggagatgaacttcagctgaaagaaaggctcaactctaagtttgatgtgagccaaaggagtgcatcacctcttcaaggacagctagatctttgctgtctaatctaaagctgttcaccagaatggagaaagcacttttatgttccttttctccctagctatatttcaaacatttagggattagatgatttgtatctattattttttctagtccagagcttcgcaaacactttggggccagataattctttgtcatatcgtctatcctgtgcattgtgggatgtttagcagcttctctgacctctacccactagatgccagagtacccttctcaactcgtgacaaccaaaaatgtctccagacattgccaaatgtcccctggggaaaagttggccccagttgagaactactgtagttgtaaatttttttttaattgggggtagataccctcactttcccagaatcctgttctgtatttgacatttcttgcagagatgggagttggaaacaaaggttatggatgtcagggagctcagttctaagattgcctgcatttatacctccctggggtgtggactcaggccatatggaacaaatatgacatatgtttgtccagtacgggcagtaaaaaggcttctcaatactcattaacctttgagaagctgacttgtttctacagcattattgaaggttctgaataagatgaactcttagaatctgaatcactgggaatcttcctgaagtgcagatgatgtttcagtaggtctggagtgtgggtgtgagattctgcatttctaactagctctcaggtggtattaatgctgctggttcccataccacactttgagtagagggttggtggtctctggagaagaggagctggctaactagacactatttttaggttctgcagaaggaattgttctttccaagattattccattggcccagtaagtagtgaagtaatctgcagttcttaaacattccctccttctcctctcaagaaggtacaacccacagtgatagtctccctgctctctctttcattctctgcagccatttaaggctaatatgaggtaagctagtcaagtacttccttttgattagctaccttatattttttggaccttctgtgtgtccgtgtgtaagagagagagtagtttcctttccagaggaaatagtggggataacttcggaaaagccattacagtgtcagaaataggtggctattttatcctagctggagtttcagataatggaaaatccatctctagaacaatgtagtatagctccacttctgggatcacttctggttggccacttcctagcctttgtttcctcatctataattgtagataatagcaataatcaccttagagggtggacatagggagaaaagaactaatgaatatcaacctgaagccctgagcacagaaccagctcagtgtaagcatgagccagtaaatattagttcctaatcttattggtgtggttattgtcattattggaactgggatcctcagactctttttgcctctaaattgtttgcatatattgtactcctatcagtgacatctttcatcatgtgcagtgattctcaatcagggatgaggtggtatgtggagtttgaaaccactcccaccagacaccatggtctccttgttcctcttttgagggttattggtctaagcaatgactgaatctcatattgtttttccagccttggtaagtccaaagatgataatataccttatttatttgtttgatctctgacccctatcatcacttttcactctaatcactttaatatgagcatctggctgccaaaagaagcccagtttcaaactggaaatttttattaatatttgacatatttttacttttcacacctttctttcctaaggaattgtcaccatcccatggcaatcaatggtggagttctttagaatccagatttcctaacaccttccctttcctttctgtgtattgtgtagtcttaactaaataactctccccacatcaggaattttggtctgggttcttaaagaatttcctaggagaagcaaaatgatactttgtcttttcctctagtagttccatgacatggcagatgagctgcctccttggtcgtcaggaagaggtagactggattttcctaacagcgttcccactgctccagcagcctggagccttgtgtgccaccactttccttgcaccctctgccagtggcctccagggaccactttctgaagccagctgctaacagttttccaaacaaaataatatgtgcattgggggataacttttctcaattaatcttcaagtaccaaatgcctcttttcttcctttatgcctaatgtgatagcaatgggctctttcagtcacctcctgacatatcctgtccccgagctcattatctcttttccagtcatctcagaatagtttttcaaaaatgtaaatctcatcaaatcatttcactacttaaataacttccctggcttctcatcatatacaggaaaaataccaccccctggacttgacttctttgtgtctccaggtgcctgatgtcattgggctgttgttgcaagtggttctggttattagcactatacagtatttcacaggggagcattttctcttgatttatagggcttgctaatgaaagaaaagatactggagatgctatcagccatctaggagtaacgtgttaggtcttagctgaaggttgagtgtgactgaagttgggagtgcggttctggattcagcagataatagtgtccatgagatggcgaatatccagatcctcaaaatatctaggttttgatgtggtgcagggcagtgctttccaaggagtgtttctggggcattcatagttgttacctaggtgaaaaaaagagtctggtggataagtaaagtcagagaaaatgctgagttatcattaaacaggtttctttactatgggacttgtgagatccttttaacatattgaaagggacactgaatgttgaatgtggatcttttcccaactttatttaagcacagaattttgttttcacagagcatcttgtggactagtagtgctctgcagagcagacttgggaaatgctggtgtaggcaatacaaaggaatgcttgactgaactccccactgtctcatccagatgcctcacattgtttctgtaaatgctgcttgagggtaatgactaatttgtccatttcaaagggtcattgaccttcaaaaaaaaatctagttctcaaaggattagaactaaccaagtaatagtagaactcattcttaatttattcagggagaagaggaaggcagtgagtgacaacattaccacataacctgttattaacaatgaggcatcgtgaagaatcattgatttaacattacacctcctggtaattagaggtttttaaaacccatagtacagtagcaaaggaataatacaaatctatcagattcaccatggaagggattctttttgttgggctacataatccaagttcacatgaagatttgaggttgaggaattagcctctgaaaacagagggatttgtgttttatcttccgcaattattagactggattttagtgggcttctctagccctcacgttttgctgctctaggtaaaatgaagagacctaaatttgaatctttgctttggcactaaatagcagtgtccccttggcatctctgggcctcatttccacctgtcaaaagagaaggccatttccagtttcctcttggagatagaaccctaggaggcttatgtaatgagattggaatggtccatgagctgaataatggagctgatgataaagctgttcagtaaagtggaagaagaaattttgacaggaaagaacatagaggttgcctctgaagactggattatgagaaacttccacaagtaagtactctcagcacacagaaagctgaaaacaagtgtgcataaccttagagccacagaatctggacagagttgtttgcagagatctcatactgctgaagtgaaatcctcagcccccctgctttgtatggcaatagagagggtacttcttttgggtcatgaaatcctgagaatctgattgaacccacagacccttttcccagaagaaatcgattctgtaactcacttctgaatcacttttgaaaatcatacttatttctctccagctatctgcccttaaatgaagaatcaccttgcctctagatatgcatatttatatgttaatgaaattaataccagactcttaaaattagcatgtatcactatttgaatatttgttccttcttgccatgctctgttccttttttttttttttttttttttttttgagacagagttttgctcttgttgcccaggctgtgcgatctacagcacaggctgtgcactgcagcagtgcaatctcggctcaatgcaacctccgcctcctgggctcaaccaatgatcctgccttagcctcctgactagctgggattacaggcacctgccactacaccaggctaatttttatatttttagtagagacagggtttcaccatgttggccaggctggtctcgaactcctgacctcaggtgatccacccacctcagcctcccaaagtgctgggattacagtcatgagccactgcgcccagccagcatgctgtgttctaatgctagagccagcaggagatagagaagtagaaggcatagaccctgtctcctttgcacttattgatcacttaaaaagcggcacactttatattaggtgctagatggtaggatgcaaacaggcagaccatgagagttgctgcagaaaatcagagtgtgtttgatgggccctgggggctggatatgagtaagcaaagagtagtctgtgggggcagttggggctagcatgagtcagggcagaattggccaatcagaggtagagcattctttagccaagtggcacatcctcaggggatacatctttgacatgaacttcatgaccctggctgggccatgctgtggtgtgggtccgtacatggaactccagtctttggggtgtgcttactcacaagcagttgactgacactgcaagactagagttgctacctataaggcagcacatcacaagctgaagggacttttctaacttctatgggatgtagtaactctggacactggaccatcaaagcagacaaaattatacatctctttttgccttcaggtagaatgcatttggtaagcagggagataatcataatcagttgactttgttgtatgttgcttctttactccctgaatctttttgaaaaacataatcatttttgttctttataatatatccctgtgaaagagaagcaggtgaaatgattacctctgacacacacatacacatatccacacagaaagttctttagaaactgaagcctagagatgcaaagtgatagcagttccatcacacagcaaacaaatagtacaacttagctaagaatacatgggccctccccctgccccccaaaaaacccccaaatctatgccatttgcaagcactctttgcttcacagagacatggccctttcttgcacactctctcctcaagccatccttcctagccatctgtctgacaagacggcatattcaggcagggtcagctactgactgacagcagctgaaacactgacggaagtgggatgaaaaacagcctgcagatggggtccggatgaggagggggagagctgggattagactaggatgtgagctttcagcgccctcttccactctcttctcgccagctggagcagcagatgactgtttcctctcactcggcaccttcttggttgggacagagtgttgtgtctgtctgtttagctgcagagtgatctgttgaatctgctacaagaatttcctggcctgggacctcactgggggttgggccaagggtagaagtagggaggccactagtcttgttgaaggtgtggtcccacagagtctcctggaagctttcaagcaggaaaatcttccccccatcaccccctcctttagctgagctgtctggctgacccactccatctcccaaagtggatacaccacggctggggacactaggcaaaattatgacttgagattgactccctctacccatttgtgattctccctttctttttaatttacctttctcttcttcaactgcctatcacctacaaaacaccttcatttttttcaggcccgctccgctctgatacccagtctttgtgtttgtattgtataacgtttggaggttattttttttttttggtaacgctttattgaggtatacatacctcatactgaggtttacatactgtaaaattcacccttttatgttgtaaagttggttttagtatatttacaagatgttgcatccatcaccactatctaactccagaatattttcgtcatctctaaaagaatcccatacctactagtagtcactcccattctccccttcccccagctcctggcatccagtgttcttctttctctctctatggatttgcctattttggacatttaatgtaaatggaattatacagtatgtggtgttttgtcactggccttttttttcacttagcagaatttttcaagtttcatccattatagcaataatattacattttatggatataccatattttgttcatccattcatctactgatggacatttgcattgtttccatcttttaactattatgaataatgctgctataaactttcatatacacatatctgtttcagttccttctttcaatttttttgtgtatatacctgggagtggaattggtggcttatattggtaactctatgctcaactttttgagagactgctagattatcttccaaagcagctgtactattattatttttttttacattctcaccagcactgtataagggttccaatttctccacctacttgctaacccttgttattattgtcttttttattatagccatcctagtggatgtgaaatggtatctcattgtaggattccccccaatagcgcctttctctttactggggaatagttccagtcttgtgtattcatcactgtgaagatattaaacctctgggaaagatagggcccttctctaactaatgattgaatctgggggcatatcaggcattctggcagggtggagaggaagagagtttagggacatggtgaacttgccacctttggaagctctaccatcgcagaagcaatctgctctattgattgctttcccttcccacaaagagaccatcaagtgcagaagtaatcaagtgaagttttcttgaaaaggcaagacaagagctgggcaacgaagggtgggaggccaaaggatgtatgaagggggaaatggagaggcttcctaaactaaaaaatattaaatcctttctgaaaagcaccttcagtagtgacctaaaacaaagatgaaagtcaaaccaatcaacaattacttttgtttagcaattctggaaaacatgttgcaggagaggacactggaaatgatggttaaaatacggtgggagccatggcagttcaagcctgtaatcctagcacctcaggaggctgaggcaagaagatcagttgatcccaggactttgaggctgcagtgagccatgatcacaccactgcactccagcctgggcaacagagtgagaccccaactctaaaaataataataataaaataaaatacaatgggagtgttggccaaggagttcactttttctctctattccatgccctttaggactactcataatcacaaatacatttgtgacccttctgagcgtaaatccacctgtctggggtgctcaataagtccaaagtagagtctatgtgcttggtaaatggctctggctagaaagcaactgcttggctaaatcacacctgacggtcttcccactgagatgggaaaatggggcagatagtgtttgcccaggagctggggcataaaaggattcttagtggatgtgatggctcagaagtgaatctctagttaccacttgggatctgacagtttttgagaagttctacagggctgtgaaagactgcacaggggtaaaaacaaaccttgtcattacattacaggtgttgagaatttctaaaatttacagtatataatactgattgaaaagtaaatgtcactgctactttggagttcagcataagccttatacagaggcagggtctgccagtgtggtaagaggatggccactgtaagggttaagtagccccacatctctttccctaccagcctgctttctgccctccagaaaccctatcatttatagctagtagtaaaagaacaacaattgcatttattgggcattaatatgttcctggtactatgctgaacagattatgtcttaccttgtttgatcatcccaacaacctatggggtaggtaccattatcatcccaattttatagatggagaaactgagactcagagatgctaagaatttgctcagctaataagcaataattagcaatggagctttaatttgaatccaaatgggacactctgaagtaaggcttctcctctccctaggacaggtcttggaagctgcatttttagcaagttccctcattcaggtcttaagttctagaaagtttcacactctttacccggtgctctacagcctcattatgaataaaacatcaaaggcctatgttacaatataattatctagaaaaggaccctgttttaaaacattatctaccattttcatttcagtatgaattacttaacgggattagtattaaggcctgccagcatgacctcaatgtgatgggccacaggagagttaagttcttatgggggaggagagtttggggaaaatctagaaatcgttggactctacccgaggaaagcagatctagttaagtcatcacatcaagaggcccaggggaaaaagaagtgatggcagttgaagtgctgaaaaaaaaaaagaaatctaaaggtaggcatcattgattcaactgatgggcccatttgaagcagtacctctgatctcagggagcatcccaaggaaaatgtcgtctgaatccacatagcctcagaatatgagcattgttactttttggaggtggggggaggctgcagacacccactcttctttgtttttgtttttgttttgagatagagatttgctcttgttgcccaggctggagtgcagtggcgcaagctcagctcactgcaacttccacctcccaggttcaagcgattctcctgcctcagcctccagagtagctgggataacaggctcccgccaccacgcctggctaattttttgtagaaacggggtttcaccatgttgactaggctggacttggactcctgacctcaggtgatccactgccgtcgcctcccaaagtgctgggattagaggtgtgagccactgtgcccagcccactgtttttgatacattcatcctgcaagatgtgttgcatcctggatgtatgctcttactttgcctgactgagatgcagctagctcccagctgctcctccctccattacagcagtgctctggtagaaggccatgggtgatttcccactagcaaccttatttgtctatgttccttccatttgggccaaggactaaaagccagctcagatttacacaattactttaacattgtttaagaaagcaatgtaacaacctccactttgcccagatggacgggctcaatgatgtcggtggagagaacccattattggaataagactgggaacacaaagtcatagctaggatctctcccactagtaggaatacagccgggcttctgatgaccagctttgtaggattgattttctatggttggaatggacccaaaatgttcacctagtctagtctacggccttcaagtagaagttttttcaaacgtagtcttcaaatttaatgaggaatacatttatatcattcaagaatatgaatgcatatgtatatgtacatgtatatatgattatatatctaggtatacatataaaagaatgcaatagaatatcttattcaccccgtcccacactcacccaattcttatcttctccctacaacatgtagttcccccccataacttttagtggttatatatctttccagatttttatgaaaatgtaagcaaatatgaatatatatatatattttaaaaatattttttcatttacataaaaggtagtctattgtgcacatcattttaccccttgttttcatcatttaataatatatctttctgtattagtgcacagagaacttattcttttatagaactacataatattttgttataataatgagccatcatttatttaaccagatttctatcaatggacatagaagttgtttccatattcagccattacaaacaatgctgcaatgaataatttttatatgtttcacacatgtgcaagtatatctgtagaatgaattcttaaaaataggattgttgggtcaaatatatatgtatttttaaatgaacagatattgctaaattgcccttcatcatgttttaatcaagtcttcacagacttaccaagagagtgttttattcaaacttttggatttttctaaatctgctaagaaaaatggtatttcattgcagttttaatttatatttctctaatgaatgaggttgattttttcatgtctaagggccacttgtagttccatttctgtcaactgtctatttatatcctttttccatttttaccattgggttatgaatctgtttcttgtcaatttatagaagctctttatatattagggacaaataggattttaatccccaaacagcaaatatgtgaagagattctattccagtgttttacagtgtcttatggcagcaaactctttcttcaaatgaaatttaaaaaagctaataaaaacacatttcactaacaaagtaagaggtattctgttgaagtagaaatggggaagggattttttttttcacatccctcaagtacctctgaagaatcctaaagcagcacagaacctagtttgaaaataatttccctacatgcctagttggcctgtggttccagtttctaataactctttcagcaaggaatcttttttagtatctaacctgaatccttattgatgcagttgatactcctccccacttaacattggcaatttgtgattatttgacctctcttccattatgaacctttatgtgttatttaaatacattatcatttaacacctttttgtgccttcccctccaatgaaagcaggattttacttgaagtcaggggaatgtcctatttatctttgtagctttaaggtaacataatgccaggtattgtcaatgtatagtcaaggatctattagtgccaggtatagtcaaagacctccacaagtgcttgttgaatgaataagaaaacaagagagaaatagtgttttgactcatgtctccatagcacctaccatacacatcagtgcaaagcaaatgcctttcagttagttatcatctatggaaattgggaaaattccttcatattcttcaactttactgctttcctctctgtgacctctttctagagcaagatcatctaccatttattgtgaatgttatgtaccagatacctttgggctttttaaaattaattatcgctgaacctcacagccacgtaaagtagaaggcatactcaagccttcctaagatcacagaaccaagacatgccaaagctggtgtcttagtctgtttgaactggtataacaaaacaccacaaactgagtagcttataaacaacagaaatttatttctcacagttctggaaggtggaaatccaagatcaaggtaccatcagatttgttctctggtgagggcttggcttctggttcagtgatgataccttctccctgtgagcctatatagtagaaggggcgaacaagctcccacaggcctcttctattaaaagcactaatctcattcatgaggatgttgcccttataacttaatcacctcccaaaggccccatctcctaaaagccatcaccttgggggttacgatttcaacatatgaatttcagaggcacacaaatattcagatcatagcagctgggaccccagagaccaatgtttgcagaccccagagaccaggctcagttatcttctcttgcatcactgtgagatacgcacatagaaacagcatcctattctaggggtttctttcaaggcctttttgtcattctctcttcccatatatttctgagacttggggtaaagccctttagatgatgtagttttactttgttggatgtgtatgtctctctgtgtgtcatgggcaattaaagggactataacctcttctttctagtctttaccttcatttccatgtcccttctccagccacctcccaatagcctgcaaatgttctaggactctatcagtagaatgacagagaaccaaagaaatgctagcatcaggctcagccatcagaagaaaagtaggaaccaaagtaatggcagcaatggcaaaagaaaagatggcttggcgtcaaggagattagcaactgatctctgaaagctctggggaggtttgtatttataacactgggagcagatttgtctcctgacatacaagctgcttttctgactatccaagaactgtcctactatggaaatgatcattttatagggtggggagagtggggaagagagcagtcagcatgaggacttggttccagagtgtgggaagaagggtaacaccaggagaggagggaaggcgtacaaaaagaagtgaagtggaaccacaggcttcttggtaaaatttgccagttgctctgaaggacaaaaaaaaaaaggcctgtggcagttattcagactgaggtgttagttagtgacaaggtgtaagtgtaccctctcatataattcttgggattacaaaatctgattgcaaaaggtagccatttaacctagaggaatggacttccaatagtggcattttaagcatcagtgtgagaaaaggtggtaagagacatttgggataagggggtattttctgagcatcccggaaatcatagttctgcttacatatgagatcatccctcacttggggagaagaaacctcctctttcccaacacatctgtggtcacatgacttagtgcttgtctgctcaccctacaatggttttttctccagtcctcctcttagtgctaggtgggaatttgactggaaacagaagagatgggggaggttagaagccacgcagcctggtcattcctattgtagcattccctgaggggccctgtagccagctttgctttgaactgattttctgctagttttcagtcaggaacactgaatgtgttccaaggatatttgtttactagcccagccaccttggaaaatctgggagaggagaaggtaaaatatgaggtggtttttcttccttctgcagttaggaagcatgctgtgttggccctctaaagatgcaaggggagatttgagtccatatcgcattcctagaaatattgaagcttaaagaggtaaagtgccttgtacaagattgtggggagtcagtaccattgagttgggattgtgactcagtgatcctgctctgaagctttaacacccattctgtgaagagcacaaatttgaaagcaggaaagctatatttctgagttggctctcttgttaaacagctgtgtgacatgggacaaatcttttggagtactagtagcctcattttcagtaattcgccccccacccccgagatacacaccattaagggtgttgcaagaatgaaataagaatgagatgttaagaattttattgcataaaactagccttaagcatgaccataattggtttctttttctttgattctactgtgtcttcctctctttctctttctccctatctcctgttgagtagaataatagactccagtgccaggttactcagaagactattgcaaggaagattctcaagatcattcttccactggaaaatctcaccctgcagttgccttgccattgattccttggtagaaggcccggttcaaaaatcaagccacattcttttgaggcaaaataattccaaacttcttttttgttgttgttgtttgtttggtattccaaacatctgccagctcccataagagccgtgacaaatattattttgtaggtcactgtagatttccttcaccacaaaatgctgagatttggaataattagagcccagggggcaaatgggcctgcttctgtcctttctctgatgggtttcactcatgtctgccagctgcagctgtctgattgtatacgcttgtgggcaggggcagggcctcttagcccagacagagttaattagtatgagttaaactctttctaggagctaaggctgtctttataaggcaaaagtaaggaactttctttatatcctctaaagggtcattaataagtagttaacaccctgagagtgaattactcagaaattgatgttagatcgacttatatagcaaagtatagaattgagttagttacccaaatcgctgaagccaaaagaagtgcattgtctgttttctgggtattttaggccacaacattagggacagcatagccttcatgttctagtggtttgggttttggtttttaattaaatggtcccttccttattataggtttgaagtgattggcactttttttgatagtggttatgagggaaggttctagaatcagtcagacatcaagttatatcttagtgctgccacttgcaagttgtgtcaccttgggcaagtcaatctcttaagccttagtttcttcatctgcaaaatgggcataatcatgtctacatcagaacattattagtaagagccaatgagattatgtatgtaaaagcactcattcctgcctggcacatagctagggcttgataaatggtatctattcgtgtattattattattattatggatgttattattgttagccttatcattttcactacatactgagaataatttcattctttttgcttgtttgtttgtttgtctgtttgtttgttttttgagatggagtctcgctctgtcgcccaggctggagtgcagtggcgtgatcacggctcactgcaagctctgtctcccgagttcacgccattctcctgcctcagcctcccgattagctgggactgcaggcactcgccaccatgcctggctaattttttgtattttttagtagagacggggtttcactgtgttagccaggatggtctcaatctcctgacctcgtgatccgcccgcctcggcctcccaaagtgctgggattacaggcatgagccaccgcgcctggcccattctgtttttttttaaacagttgtattgaggtataacttacccaccacaaaatagactcatattcattacagttttgactgatggaaaagaaaggatggttcaactctctaagcctctccctaatgaaacacacagctcccctgatttctctccttccactgtcttatggcaggcactttccaagctctggttgtatcttttgttggtttcaattccttttttcaccactcactagctttgtgacttcaaataattcacataacctcagcaatcctatttccctcaaatgaaaatgaaggtaagaatttaccctacttgattcacagggttgttatgaagctccattgtaataatatatgtgaaatctctttgtaaatggtctgctgggttactataattcacaaatatgagtttcaataatattcaaatgtcatattgtgtgcttcagacattagatgccttgagagatccagattgtggctggagttatttagagaatgcttcgtggaggaaaggcggcataagctgaaccttcaagatcagataggacctcaatgggtggaaaagagtcagggagtgggcagtctcggtggagggattaaaaaaaagcaaaaccacagaggctggaacaaacagataagcacaaaagtgatttaaaatgtaggcggtggccgggcgccatggctcacgcctgtaatcccagcactttgggaagatggggcaggcggatcaattgaggtcaggagtttgagagcagcctggtcaacatggtgaaaccccatctctacttaaaaaaaaaaaatagccaggcgtggtggcaggcgcctgtagtcccagctacttgggaggctgaggcacgagaattgcttgaacccaggaggcagaggttgcagtgagcagagctcgcaccatgcactccagcctgggcaacagagtgagactcagtctctaaataaataaatgtgggagggaataaagttaccagggcagtataatagatgggtccccttctgaagcaactgggggaaaagattaaatgagatagcatggactccttcctttcaggaaagataatatcttattcatctaggaatattagctccatctaggcagggaccttgtccatgttctctgatccctctctaacacatattacaattcctggcacatagtaggtgctcagtaaatggtcaacaaataaaagaatggatggatggatggatggacggatggatggatggatggatggatagatcataatgtcagctgctgtacttgtctggctgttttaacattattcaaaatcattggtcactggagcggggactgtcttaaaactccctctatgtagtacagccccgtctgctgttgggatttatgaaattcttgtcaatgatgccaatactcagtgtggtttttctccaccctgttctagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggtaagaccctacatcttaacattcctgctaggccctactcaaatacaagagcttcctctgtacttgtactttcatttgtgcctgcactgtaaggtgtttgaataaaacatgacttgcattaaatcataagcctccttgacaatccaaactccctgatcttcacccaccctgaacaactctgttgaagggctcaggcccaatcatatcccagtcttaaagctgtaggactgcttaaatgggcaaaggtgagctgtttgtgttgatcggcgctccttttcataataattataccaccaaagcctccatctgaaggactcacaattatttgaagctttgggaatgctatgggtggaaaagtcactttgactatctagggccactcactccaattaacaagaaaatgagttgtctgttagttcccatatctgaagtattttactaaccagttaattcctagtgccctgcaatgagaaaactctctataaatgcttggtcatgatgactaccaggacattacttgtcagaagaactgcatttactttacaaacaacgtatactaattacatcttatctaatatgcagtccggagaatataatcaatagaactagaaaatggagtaaaatgagtgtttaaactgaagcaggaaggaatgaagttagatgtagtaacaacttttctgcctgcaagtggcattaagcactggattgtcaagggaagctatagaatctcttccctttaggacttttagtaagaatatagtatctcagtagtttaggagaattttcgtgtggccttgctttcttaatggccttccaggaatcattctagccccaaaagaatgtgcttctaagaactaagaacaaggtttaaggaataacatttgaaagatagaaatttaggaaatcaggattattgcaaagacagatgtaaccagcaagtaaattttatcctctcccttgccttgtgctagactgagctgtggccatcagatcatcttgtatagttttgtattaccccagagagcttgttcctttggtttggaagggagagtctagtgaatattacaaatggaagctatgaaataaatcttcattcctttaaacccccaatccagctgggggaccaagggtaccatgaacagagaagaaagaaacaagactataattcatggttcagaggctcatggcatccctgacagactactttgtaccaccttagaccatgatgctcgactaggattgctaacttttctgtggcttagtctctggcatggaggaattgtaggagaaaaaaaataatgcgtaataaaatgtaggaagtaccgagaactgacgatgggagagctggggggaaggacatgccgtgttttgagtccctgctctatttcaggtattaagtgaagcctttacacttatcctagatgcttctaatcttaattctgtttctccttggcaggagggaaacgtgtattgtggtctcaagacttgccccaaattaacctgtgccttcccagtctctgttccagattcctgctgccgggtatgcagaggtaggtgtgttatatcccaagacccctgggtgctgctatcctgtgtagtagaatttagaaaggaggaaaatacctgtctaatgtcctagggaaaggtaatttttatggtagccttagtttttaaaggtggtttaattaacaaagggaaaaataaataaagcattgattttaaaggccacagcctttaaaaaaaaaaaaaaaactacaggatggagtgctgtgcttcaggggaggatgggaaagagtcatcaaatgtgaaagtgaatatatttatttctccatccttaatcccttctagcttggcccttaaattattgtatcataaaacacagactattttcattcatagccttagaaggaagaatggaccttgcaaggaattgatgtggccattttgaagactgtgcagggcaaatttaggtatactttttaaaccccataataagatggtgacaaactcaataaaagcaaaacagaaagcattttctcaaattatattcaaaattgaattgtcttctcacattagtctttttttctttaggttttattttttttataatggcaccagttttttcgctaggttcctgggatcaagtgtaatcccctttaatttctcctttgttacctcttctcagattaccaaatctttcagcagttatctgtatctctcccttttcccactttcccactggcaatatccttattttgtcctttttccttctatccagtcaacatattttttgaccatctactgtatgctcagcattgtgctagaattggggtatttatattgataaatacagtagatatatagggtggtgctagaccatatggcatctttatgtgagttacaaaaaggattcccttacataagatactttattgccatttttcagaaaatcccagggaaagcacctttgtagctgtggcatccttttgcagcacacaacctacacaacaatatatatagcatacatagcagccaagatatgttctttgctcttatggaactcaccagaaaagacaaataataagcaaacgtggaaatacagataatgcaagtactatgcagaaaataaacataggactgagattaaaaataagtagtttatttaggttgagttgtcaggaaggcctctctgagaaggtgacatttaagctgagacctgaaagataaaaagaagtcacccatgcaaagatcccaaagaagaacattctaagtagagagaaaagaaagttcaaaggccccaggcagggaagagcttaaagcattcaaagagcctaaggaccagtgtagctgaaatgtagtgattgtggttgaaactgacatgggatgaggctgaagaggtaactaggaattagaccatgcaggattctgaaggccatgggaaggattttggatttccatttttaatacattgggaagctattggaaggttgtgagaaagagtatgaagtgatccaattaacatattaaaagatctcactggctattatttccagactagactggagggaggcaataatgcaagtggagagactagcaagatggttagggtagtactctttccagtgtgagaaaaagggtgcttggactgagaacacagtagtggttcagagtggagcctttggagccaaactgccttggttctaatcccagccttgctactttgtagttgaatgaccttattcaacctttctaccaatctttaaagtgaggataatgttagctcctaccttcaagatgtttgtgagatttcaatgagataatataagagaaggacctggcacagtgtcttgtatatactgaggacccaataattaaaagtggacaaatttgaaatacatttggagccgtggttctcaactatgggtgcatattggaattaccttggtagatttataccagatcagaaggaggaggatgtgattccaatatgcagctaaggttgtgaaccactgagttagaggaaaaaaattataggatttgctggtgggggatgtgtaggtgacttctatacattactgccattttaatcttccaaaaagcaatccatcaccgtgttacacccctgttcaaaaatttttatgccaacatgtatttggacttactatatgtcagtcccagttctaactaagcattttacagatatgaactcacttaatctcatgacaaccctatgtgaggagtactattgttctccctgttttatggatgaggaaactgaggcagagagcggttaagaatcttatccaaggtcaggtagctagtgagttgaggagctaagatttgaatcctggcagcctggctccatatttcaggctctaaccacagtgttctgccactgaaagggatgactccctgtcgccactcaaatacatgtcaacccccgactctgatagtgaaggcctttcatggtctaacctcaagttacctttataggtcaatattcttccattcatgcacctcagggcccactgcattgttcctgtgctctcttacctttttacctttgctcagtcctcttcctgtcagtgtttctcacactttagtgtgcttcagaattgctcagagaacttgttgaagttcagattcctggatcacacctgcagagattctgatttagtggccttggagtgggacccaggaatctgcatttaagcagaccccatcgttcattctgatgcagaatggtggtctgtggactgtcactttgagaaaccattcctgagaccatgtagataacctggaaccaaggatttgttttaaaaaatctgagtttagtgcacttaaattgagcacattaaaattctgaaacctgagtgaaccagtggaaaagcaaccaatttcagttcctgattggttaaagcatctaagtccgaccatatggcaaccaatttgagatgaatgagtggtggccatttcatgataaggaactgggatgaaaaggagacaaaagggctgtctaagtaacaactgcacatgtacaggttggatggagaaaatgtttcctctttctggaaaattctttttctccatccctgcctgtggaagtcctgctagtccttcaagacctagcacaaatgcagcttcctcagattctattgcaggccgtcctcaggtcgcattttgataagtagtagttggaaggcctttcttttctgccttcccacttccatccctaatttctccacccataaatcctgcttatccttcaaaatccagcctaattgccacttcttccatgaaatgtttttaaatcctgcaaactagaagtaaacctgtctctactctaggactcctcagcacttaacctgtgcttcttctggagcatttatcaccttgtcaacttctgttttttattatttgtgcccatgtattatcatccctattaatgcataagctcttcaagacagatactctttttcatttatctttatttctcccactgtgccaggcagagtaggtgctctttaaatgaatgcacactagattggaatgattactagaaatttagtcaggatttgaattaggtgctaccaaaaaagaatatggttgttgtgcatttttccccctgaattactgattgactgtggtagatggtgttgactatacattgattcctcgtcaataggaaattacttggtctcattcctgatctccaagttgttttcttcccctataccactttaggaaactacagttaacattgctttttggaaggactgagcttgtttggactaccagtgtatgctcatcccttttaatatgctatttgcatcagccctcataagtcaatatggatttagttacagcctaatttgatttatgctttggtaaggccctggatctttccatacatgtttctcacaatgtgtgtgtgtatatgtctgtactacagtgtagctgttacatttcagtcaagaaagatggatattttgttcctcacctcctttcttgtcttggccccaacttaatttcagtgtggctcaaaagaaagtccatactgagcagaggtgtacatgtggttgctaatataaccagttggtcactataatccagctgttaggctgatattattccctttggggaaaaggatatgtgaaatctaaactggaaaacaattgataatagaaaggaaaggcaacagtgaaaagacatgtcactgcaacctaggggcaatacggtataatgcaaaggacagaggctctgaagccagaaggtcatagatttgacattgcagggctaccacctacgagtgctgttatcttggacaaactatttaaccactcaaaaccttggttttctcaggtgtaaaaatggagattatgcttactacgtatgaaatgggttgtgtagattaactgagatggcgtagagtgctaggagatggcctaatacagagttattggtttataagtaacaattactatattttatatagtaattactatatttattacccccgagttaagtatcattgcaccttctcctctatctttgatagttttgcctttttaaaatgtaatctccatagacagaactttagttctagttcttcttgtggtaacagatcctggaactagctattttatgtactgttctatcgttacaatttaaatttcttttcttttttatgtcctcagaagcaacagataaaagctagttattactggccatgtattgtccctttatatacttgataattcattaagttctttctttgcaacctctcatccagcctaaatgcacaattttctttcatcttcctttataaagactaaatcctacacttttgtaaaaattgttgttctttcattgcctccagtttctttgcatctttcagctgtatataatgtggttgaaactcctttgaagttctaacttttgaagcacctagttattttttcccatggaaatgacgtttttacaatactgtatcttatataagcgtattactcatacagcagggaacccagaaacctctcccctatgctggccaccctgactgcaggccaaatactgaagaagaaataatcttttgactgctgaacttgcaaaccttcatataaagggcattgaaatagcctctctgcactgtccccaaacactaatgtgtgtctttcttcctgggtcagacagcaatcctagacgcggattgaatctcagacctagccttcattggctagacgtgtctttgaggctgggacagtcaaggagagcgttggcagaatgtgtgtcattgctagcacttcagcaaacctcattaggactggaagcatagtgcaaacagccactggaaccttaagggaaattttatcagaagaaaaaatctcttcagatcctgtgttagtttgctaaggatgatagcctccaactccatctatcttcctgcaaaagacatgctctcattcatttttatggctgcatagtattccatggtgtatatataccacattttctttatccagtctgtcattgatgggcatttaggttgattctgtgtcttcagaattgtgaatactgctgcaatgaacatttgcgtgcatgtgtctttttttttccccaaatactgcatgttctcacttataagtgggagctaaatgatgagaacttacgaacacaaagaaggaagtaacagacactggggtcttcttgaggatggagggtgagaggagggagagaagcaggaaagaatctgtacaacaaaccctcatgacaggagtttacctatgtaacagactttcataggtatcctcaaacctaaaataaaagtttttttttttttaaatctcttcagagattatactactgccacattctgggaaggcaggcttcaaacccaaacccacacccagcttccctccaccattgatcatttccacttcctgtcccctgctcatcttgccaaaacaacagggaaggctatgtacttggactctagacaagggaaaggtatttggggtaggtattaactgtattgaaagccaagtatgcatttagtaaatggtgtctaaatgtagcacgtacaatgtgccagacaatgttctaagcacttatgtgtggaatagctcatttgatcctggcaaaaatagtagcaactatttatatccccattctacagatgcggaagctaaggcagaaaagttgagtgatttgtccaaggacaaatggtagtaagtggcagagctagaattttaacctggtcagtctggcttcagagtttcaagctcttaacttctatactacctgttgggacccattcataggagtatgacaaggatatctcctagtacaggggagtaaaggggaagacgggacatgcatggcacattgttgtgtgcagatactcctaagagagtatcttaccacactgcccatgttttcccatcaaggccttaacttacccttctctcactctaggcttaaagtgtcttgagtgtaaatgtctactttctttcattcagcaaacattgttaagcaatcactaagagcctggcactgcaccagtgctagagatacaatggtgaacaaaaatggacatggaacctgccttcatggagttttagtagggaagatagacaccacgtcatgatataagtaattataaaattgcaactgtgccacatgccacaaaggaaagttgttataaaagccaataattgagaggggttgacctagtcagggaggtgaaggaagacttctgagactgtctctccagcctcaactcgcaccacatccctccttgttctctgcactccagggtgaggaaagattggctcaaaaattagggagataactggtggcagtcatacactcctgggatccccaacttctgatcccaccatgaatccagtccctccccaggctgtaggggtctataatgttctttctacattatacatgctacataataccctaatctaggaattttcttttactcttctttcttttggctgtttcctgtttttcagagacagggtctcactctgtcatccaggctgtagtgcactggcacaattatagctcactgcagcctcaaactacaagctacccttctgtctcagcctcctgagtagctgggactacaggcgtgcaccaccgtgcccaaccaatttttttttttttttagagacatggtctcgctatgttgcccaggttggtctcaaactcctggtcacaaatgattctcctgcctcggcctcccaaagtgctgggattacagacatgagcccagcctaggaattttctttttgagaaactacttgatcatgctaccatttcttaccatattatccaatctgaatttttcagcttgtttttaaagaccctctgtgaaacagtctgatccttccttaacctactttccagcctcatttctctgacaccaacacacacatctcctttaggctggctggctgatctctttgttctgttacatgctatgtttcttcctaccttccctcctgttatgtgcttcacttaaactgttatttttcacaagcttggaatagcccccgctcctcttctacctattcgcatcctactcatctttcaagggtccagttgaagttgcacctcttctaatagttttgcccaatcactctagttctcattgatcttctttgaccaccttcaggacttaatctggttcaaaaataagcattcagaaatatattcttgcactgttattgctttgtgtcttcctgtttcccctggcataacataatattaatcatatatcatgctgactggtttatttaatacaaaaagagccacagtcacaaaaagctcttgacagcattccaagtacagatgcagtagggaggcaggagaaatggtggaacttacaatttgctcaacccaagcccgttcatccaacatatctcaaatgagcccagggagaaaatggaagtcactttttatgaaattttgatatttctgctaactccttcaaggtaaatgaaactggaagcaattgtttaaaagtatattagtcagtgttcaagataagtgccattttacctaagacacttgatttctctttccgaaagagcagcaaaattgcacctcagatcccatctcagctagaatccgggatcttcagggaagtggtatgtgagatacttcattgattttaaacatcataaaaattgaccagtttttcaaagttttcaaaatcaaagaaaactgaagaaaataacagcaaatccaaatatagattctcacaaattagtctcaagttgtttatgttttggcccacattttctgcagaaacaccaccatctcctggtcatgatgataggaaagaaacattgttaatgagaaacactactttaaaaaatgaaaattcatcttgtataactgaaaccttatgcctgttgattagcagctccccacttccccctccaaggtgaacaagttctaaagatctgcagtacaacattgtgtgtgtatagttaaccatatagtattgtatacttaagtttgttaaaagggtaaatctcgttaagtgtccttaccacaataaaataaaaaaaattaaaattaactcagtaatttttgagtttatacattctcacctaaacttcaaaatacagtccgccctctatattcactggttgcacatccatggattcaaccaactgcagatagaaaataatttttaaaaacacgttaaaagtaacagtacaacaatctaaaaattacaaattttagaaaccaatatagtaaaatgactatttacatagcatttacattgtattaagttttataagtaatctagagattatttaaagtatatgggagtatgtgtgtaagttatatgcaaacactatgccattttttatcagggacttgagcatctgtggattttggcatctgtggggggtcgtggaaccaattccgcatagatactgagggacgactgtgtattgatatactctgatattttcatagctatagaagagtctcgctgtcattaataataccttttcaaaagtgaatcatttatgttcatgtgtatgggaccattttagagatttgccatcctcacctacctctcctcatctaaatcccaactggatctccttccatggaaatgttccagattgtttttgctttctctccatctcttgtgctcaaaattcatccccacgtacttgctgactgtcccaggaccccgtccctctaaggtcatcatgttccttcttggcatgtttcttacgtctagaatatttcttcttgaatagaaagtcattcagacagtggatgggacagcgttgactttcacattgagtttaacaaattaatagcactgattcctaatcggccatctgggttgtcctgtcagggtcagtaataccccattctgtttctgggattggaggacttttttgtgtgtatatgaatctgtttctataataaaaataaggaattcccagtgaagcatttcagagcaattatttcttcatgggtggttaaagccactctttcttcaaccttattctttctaactccttcaaggaattccatagctgcccagaaacaccattggatgtgcccattactcacattataatagtctttatgagcttagactccaacaatttatagaaatcaacctggtttgttgactgacagtgcaaacagaggtaaaagatacatgagaaggaagagcagtgtatacaactgactgcttttcattttcaggttgaccagacagtcagcatgggtaggtcattgagtttctcctctctgtcctgctttttattttcagttcatggatgtggtagcacagaactctactttatttggatacttggatttttttttttaagacagagtctctgttgcccaggctggagtgcagtggcatgacctcagctcactgcaacctctgcctcctgggttcaagtgatcctcccgcctcagcctcccaagtagctcagactacaggcgctcaccacatctggctaacttttgtatttttagtagagacggggtttcccgatgttgtctaggctggtctcaaactccttacctcagatgatctacccgcctcagcctcccaaagtgctgagattacaggcatgagtcaccgcgctcagtgggcacttggatttttaagacttcactttataactttgtaaattgtactcctaccaatgaagcagatatctttcctgtcaagcctcatttttagccaagagagaaaagagattttaattaagatgcaaactcttttttaaaaaattggaaatagaggactagcataattatgagaaattctaagccagtttagaaggtgtgagccgaagaaatctctctagccatttttaaaaatatctccaggaccctgtcttccaatgatttagagatgaaatgattccttttcaatgtgcaggcatgcagttatctttgctaggctttgtttgcttgtttgtttgtttgtttgtttgatccaagcccttttctttgttaaatacacagcacacttgtgggagtcccttaagccgggtattcccccatgtgtaagctacccttgaggagaaggaggaaaaagaagtggaggcaaagaatgggaagaaaggggattaggaatagcagctaacatttagctgacacagtgtgccaagcacaattctaaatgctttgcatatactaattcatttaatcttcacaaccctataaggtaggcattattgtctccattttagcaataaggaaactgaggcacagagaagttaattcatttgcccaaagtcacataagtaggaaggagcagagccagaatttgaatccaaactgtttggctccaatctgttctcttagccattatattatactgcctctcaacttggggaagcaaagcaaatttgggaactcttatttctgaggctaccgggaggaacagactgtgtgatgaccatctttccaggggccagatatggtaacaatccagcagatgcattgggactgctctgagaagcaaagattctgtttctcaccataaacttggatctgtttagccacatctccattgaaagagcagagtgtggatggtgggtaccatccagctcgtagtttctgtattcactctcttctgatttcctcctggaaacgcatgcattctcacaatgcactttttaaaaagtaagtatttatgatttttctggacaaataattttgtactcttcttcagatttggcttgctactgttggcaggaattccccccgttgtgtgtgttttggtatttctcaaggagctattttgttaaaaatactaagatcttatattgacagcccaaacaataaagtacttcatttgacaaagaagtattttttaagaaaataactgtctgatcctttttatggctgtatagtattccatggtgtatatgtgtcacattttctttatcccatctatcattgatgggcatttgggttggttccaagtcttgctattgtgaatggtgctgcaataaacataccggtgcatgtgtctttatagtagcatgatttataatcctttgggtatatactcagtaatgggattgctaggtcaaatggtatttctggttctagatccttgagaaatcaccgcactgtcttccacaatggttgaactaatttacactcccaccaagagtgtaaaagtgttccaatttctcatcctttccagcatctgttgtttcctgactttttaaggatcaccattctaactggcatgagatggtatctcattgtggttttgatttgcacttctctaatgaccagtgatgatgagctctttttcatatgtttgtgggccatataaatgtcttcttttgagaagtgtctgttcatatcctttgctcactttttgatggggttggtttttttttcttgtaaatttgtttaagttctttgtaggttctggatattagctctttgtcagatagatagattgcacaaattttctcccattctgtaggttgcctgtgcactctgatgatagtttcttttgctgtgaagaagctcgttagtttaattagatcccatttgtctagtttggcttttgttgccattgcttttggtgttttagtcatggagtctttgcccatgcctatgccctgaatggtgttgcctaggttttcttctagggtttttatggttttaggtcttacgtttaagcctttaatccatcttgagttaattcttgcatgaggtgtaaggaaggggtccagtttcatttttctgcatatggctagccaggttttcccaacaccatttattaaatagggaatcttttcctccattgcttgtttttctcaggtttgtcaaagatcagatggttacagataagtggcattatttctgaggcctctgttctgttccattggtctatatatctgttttggtaccagtaccatgctgttttggttactgtagccttgtagtatagtttgaagtcagatagtgtgatgcctccagctttgttccttttgcttaggattgtcctggctatatgggctcttttttggttccatttgaaatttaaagtagttttttctaattttgtgctttataaaacttgcagatttcttgtattgttgtatatcatcattggaagctcaaatgcctatcagtggagaatccttatactagtttccttttaaagcttctctcaaatttcagcacacttgctccctcccagcagaatttatagaattagatgtttggcagaggctccctaaagtcatctgcttctactcacttcttcatctctagcttcggtatggagcactggcattaaagtgctcccccatggaacccagctcatggtaaggagagacttcacaatgggtttattcctccctgctctcttccactttgccctgattctgctcatttcaacttctgcctcaaaaaatacagagaacatttcccctgtctcagggatttgtctcatgtccctttgccttatgattagagtgactatgtaatttactatctcaaccgaggcacattttgaaagcaagagctgcaatcttaataattatgcctgccagaaaaacaggcaataaaactgagttgtctgagataaatctgctctatggctaccctatttatgatgtatggttcaaaagtggccacatgctggcatagttttgctctctgaggcttatcttcatgggtatctcggaatctcattgtacacttagtccttttgagaggacagtttacctctctgacctgctcaagccaccagagattaatggaagccacaggagttataaacagtctgaatttcagcctagcttttggccatttttcaaatacttgttctccctttctcccactactagaaagccaacccattacagcttcatagggtaccactcagagagagtatgactgaggtttgaataaacaatacatgtggcttttagggttaaatgaatattgtttgacatacagtacactacacttgtttttatttcagttcaaaaaattggttaaaattatatcttgttgcttctcaaaattaattagaatccatctgaatccattagaatctctgttttttgttttgttttgttttttacaaaaagacttggctgaatgaaaaagcctccatctcattcagataatctttccagtgatcagacaaaaagagcaaagaaacaggttttttagggtattggtgcctactttttttcaaagtatgatatctaaggttgcaaatggacatacctattttcagctatccagacagactgtacccaggtctagagaaccacttatagccttataaaatgtcaacatctaagaagataattccagtttaattatgggttaaattaaatagaataattcaaatgttaaaacgtttagcagctacttaatagacttaatagaacattgaagtttagagaatgcaattttgatgactttgaaagctcagaggcaccagaaatgctaacagttcctagtatttatatatttaatgtatataatttataatgtacatagtatatcttatatataaatatagtgtatatatacatatatgtgtgtatttatatacaggttaaatatcccttgtccaaaatgcttgggactggaagtatttcagatttccgatgtttttggattttggaatatttgcattgtacttaccagttgagcatctctaatccaaaaaccccaaatccaaaaatgctccagtgagaatttcctttgagcatcatcagcactcaaaaacttctggagcattttagactaggaatactaaaacctgtatgatatatataacatacagttttagtatgatatagatgatatatatatatatatcatacagttttagtatgatatagatgatatatatatgtaatacaggtttagtattcccccattacttgtttttgtcaggtttgtcaaagatcagatggtatatatatgtgtctgtgtgtatatatatatgtgtgtgtgtatatatatatatgtgtatatatatgtgtgtatatatatatgtgtgtgtgtatatatatatatatatatatatagtctccattactttttaatgaagtgctgaaatttaggtatgcattcttgtctgcaaatgctcatcaaatacacatcacgacacactcatctgatttgtgttacagggtattagtattcttctcctatgcctgatagtgacttgcctccttgattttccatcttacctctctgctcatttgtaagaggcgctatgtgcttctataatgctttgagattctgactggactataagtatttaatgacactctttaattaaaatccttttaaaaactctagggtataaattaaataaactgaacttttcagaaggccagctaagtaaacattttatgtcaataccaatcattaaatctacattttaaaaggacatttgatgaagagaactagtctatcatttttcttttgcaacttgttttctcccttttgactacttaaattaggcttgaaaccacattatatagcttttacattttgttttgccatttgctggtaaatctttactggtttctattcgtctctctagtcccatattttatttggcccagacccactactgcccactgaaacaagggggacaagtaaatctaagctcatccctgctcaatcactgtccccagctctccagatttgcaacccaagagttgtcagatactgatttcccctttgccttccttccccatcatcaaatcttccttcagggtcttatcagtttcttttcatctgtaggagtctcattcaatccttcttgtgtgttattgcacagatgctcatggcctattacatattactatagcagcttcctgtatggcctcctgcattcgagttactccccaactagtctataccccattgccagaataggcttccacaaatatcagttttatcataggaacccctacagaaaaattggcaacataatcaaatgtgaattcttcagccttttacaaaattttatatttttttgaatttttactgtttactttttacaatttaattattttcttaaaattgtgtgggtacataataggcatatatatttatgaggtacatgatatgttttgatacaggcatgcaatatgaaatgaacacatcatggagaatagggtatcgatcccctcaagcatttatcttttaagttacaaatgatccaattacactctttaagttattttaaaatgtacaagtaagttattattgactatagtcaccctattgtgctatcaaatagtagcacattatttactacccctatttacctcaacaacacaccccactgtcattctccctccctccttcgctctccctctcctccctttctctctacaagttcaattaccagcgtaatttctcttgttttcatatctgaagtttctactcaagccacaccttgcttgctgtctccagtatgtgacttgctgtttacaaagctctggtcctttgccaatgtcactccctttggttgaggtactctctgcccttatcactgtcggtttatgctgtgcagtatctacttctaaaaatgtgacttaatggttctttcaggaagctttctacgattacatctgactgctcactcatcccattcagtgtctcctaagcatgtgtatttcatttgtatttgctttttttgtgtgtttttaggctgtttcctatattgatttcccatcacctccaacctgggtgtaaatatcctgagggcaagagcccagcctgattttctcctctttctgctgtagtatcaggctcttcacccaagaagtgttcaaagcatgttaactgactcttgggcataattttctagttataaacatagttgaaatcatctttgttttacagtagtcagtcagggtttccacagagttcagcttgcagtctacaatctttactcagacatggaataaaacaggcagaaaagagtatatatactattgaccaagcacttaattctgtatgttttactgcagttcaattcaatacatatattgagcacctgatgtgtacgcagcaatatgctaagtgctccagcctggttattcacaaactcctgcatccatcagaatcccctggaaggcttgtcaaaacccaggatcaccagcccccatcctgagtttctgacttagtaggtatgggttgggatctgaaatttggcatttctaacaagtttccaggtaatgctgatactgctagtccaggaagcacattttgagaagcagtggtctaggagatacagaggtggtctaagacataatctctcattccaaggaatttacagactctctagggagacaaggaaggcccagaaaacatttaacagtaataaatattgtacagtgttttagtatttattgattcgacaaatattgaataagtactatgtgcccagcactgccccagatgctggagttacatcagtaaacacaatagacaaaaatccctgctgtcatggggggattctaatatgggaaagcagacaataaacaaaataaataaaatataagaaatataagatagtaataactgctaaggagaaaaagcaaagagcaggcataaatatcagatgggggttggaactatagatagggtggtcagagaaggcctcccagttccatcatttgacaagtatttattgagcgactactatgtatcaggcactgttatagatgatggtgatatagtaacacaggtaatgaacccttttcttatggaatggacatacctatttgggagccaggtaacctagagttttggtgttaattctcacaaactcattattagactctgaatggctacttcccctctcagccatggtttcttcatctgttaaatggagcagttggacaaagttatgcttgacgtcctctatacttctaaaacttcaggatgcttagtcttttaggcaatcagaaatatgtaagagtgtttgaagaagactttgcagaggagagaaaacttaaatggttttcacaggcatgggggagctatggggtgtgggagatggaaggtaatttcagaagaagaataacatgagctacagcacggaagcaacaatgggagtccagtattcagtgaagagcaagtagctcaaagggttcccattgaagagtagctgagatcattgggtaggcagtagggggtgattgtagagagtcttggttgggaacccactgagggttttgatcagggaatgacacgattatacaatcaaagtggtgttttactgttttatgaagattaacctagcaaatagttaaatcctcaaaattcattatttttcatcagataatatttgaattatgaagatttacagtcatactctgttataagtcactgcctgattctaatattgctatcaaactaatttttaggtcgttttcaagcccttaaaagcctatgatactacctaatttcccctaacactactactacatgcttgaactggtaacatgttactctttttgtgtgtgtgtgtgacagggtctggctctgttgcccaggctggaatgcagtagcatcatctcggctcactgcaacctccacctgccaagctcaagcagttcttctacctcagcctcccaagtagctgggactacaggtgcacaccaccatgcccagctagttttcgtattttctgtagagacagggtctccctgtgttgcccaggctggtctcaaactcctgagctcaagtgatctgcctacttcggcctcccagagtgctgggattaaaggcatgacccactgcacccggcgtgttactcttatgaaggcttgagagagtaatcagaatagaaaattcttagtacttacacttttttgtgtttctggttatcttataaaatatatgttgaatattaggtttatcttcagccatatatataatttaaatagtactcatttcaagtgatgcaaacatctctaagacaaggctcttcccattcgcttgcttggtcagaggtaacacaagggcaatattcttggaaatgatcctcttgttttttaatcagttgaggtatatccacagctcttgtgtgtttgttgctctagaggctgaaagtagaatattcttcctataagcagttactttagaagataatgataaggagttctctgtccaaagagtgggtcatgtagacctagagaaaggtgtgtcataagaaattatgacagatcaaatcctcaaaactcattattttaatggtagtttaaacagaagtgaattatgacctgcaaaacacttaactgtcacgaagtaaaatgagcaaaagtgacagtgatggttaaattaggtggaaagtgattattttccttttattttccaaattctgcataatgttgctaggacatctatttagaaagtggcaactttcttcagagttgttttgaaaaatgaggcacacccagagaaatctttcacagccgctttttgaaggacagccacaaaagcaaaaacacttcaagaactttgggatcatagtaccaaaaatgttgctgggtcacaagggtgataactttcccttttatgaatgtatgattttctccttatttctttttaataaacaggagatggagaactgtcatgggaacattctgatggtgatatcttccggcaacctgccaacagagaagcagtaagtgtgaatagctcaaataattcaacactccacagcatcaggccaagctttcctctcctcgtggctactattctagcaaatccaaaaaaaaggcccgatttctaacaccatttttcttcccttttctcaaagtttttaatgtcatcaccaactggaaaccatttaagtacactgtaaaattggtaactggaggcaggaaatgtgcacaaagaaaccatagccccagccctttgtctaggtcagaagttggtactctttcaggatgacttgccaagtctttatgtgttctctaaggaagctaggtcactcctatcctcaacagtgaggaccttctgtagggttgtaggatacaaccatctttttggtgggatttggtaggtacttcagacatgtccacataaactctttcccaagccttaggctctcagtcatacagttggaaaagaggaaaggtagcagtctggattctcctctcttcagcctggtgatgtctcccttctgttctctgcactaatctcagaataagcctcacaagtaggcatctgtctatgtaagtaatagcatcttttgttcttttgtattttgaaggaatttataaaatagcattcctctctaaaaatatatgtctaagaagctttacactacaaatttcttaaaatctgaaaaggagatgttccgattcaaagaatctatcatacaaaatgcacagtggtgaccattgcacataaataggtgttcatcacatccttgtacaaaaaaagtatgcaaggacattcactgcgttgttgttttcataaaaacaaaacaaatggagacaacctaaatgtctactagggacttggtgtgtacatccaattaatgggacactgtgcagttgttaaaagaatacggtacatctaaatgtagtaaagtgaattgagctccaagatatgttaagtaacaaaacaaggtgcagaatgaaattgtacactatcacttctttatgtaaaaattgtatgtgcatgtatataaatgcatataaaccaatctggaaggtcacataccaacatgtcaggtgtgctaatcttaaaggagtagaagtgggcaggaggaaaggtagattttgactttttactttatattttctgtataatttgatgttttcctataagcatcaattagttttgtaataaaatatatttgattttctaaaaccctagaaaaatctcagcaaggattgaatatgaggcaggagtccagggaattacagggcaagcctgaggatattgagcatgtgaggaagatgttgataggggatgcagtagaatgactcatacaaacatcacagtgctgctgaggctgggcttcctggtcatcacatgggccacttctaacttgcatgctcccagcttgccaacacccaacccaaagcttcagcagtgagatggaaccatttctatttgtcttactctctatcagtattattttctgaacactgctgtttctgaatagttgcagaagaattggggaaaggggtttggagaacagtactctggacatctcaaaaaatcagcatcctgcaagagagggtaggcttccctgtttgctggttaatataaaccctgaggaaagattttctccacccaactctatctgctttatagtaagtgagattccttccagagcctgacaggagatgatgtcagtctcagttttctgtgttgtctgttcctctttttctcagcccctattttttattgtggtaggtagttgagagtggctgaattagtggctgtcaaccagatgtcattctaaaccaaatttagagtttagtcaccttaagctatgtgacttattccctgagaggcccccacactaagcactatggccaccttagcagtcttgctggtaatgccatgaattagcctttcttcttgacttcattttacactgccctcaattccagcccttatctttcagcttcattgacaggcctagtgataggcctggacttaatccagtacttcctgtagcaaaaaaggtcgggtacagaatgtgggcccttgaaatagttattgattttcaaaggagttcaagacctatctttagaaacaaacatttgtgcctggtagaccaaaatggccatatggtttcactttattataaataaatatttccctttgttctaaaagggatagatattgtgggatatgatttgaataataaatagcatctgtagtaatggaaaaatatatacctggcacatagtagtcacccaataaataaacattgaatgaatgggtgtgggaggtggcgtaaaatgtgtgtgatggtggagtggggagggggttcctcattaattttaatgcacaggaatttgtctcaaatcagagataaactcttcaaatttgttgtttgctcttgaccagcctaaaatgagaaaataggagaatcccttctgaatatcctttgcaggcccaacttcctcagggcaagaagaaaaggcagccctaacaacagatttcttatccaggagactgtccttttcgtaaactgttcctatttaccgggaaccagcaaaacctctgttcaacagaaatacagctgactggtttcttttgccaggtggtctgaaaaccatcggcttagcaagttttatgaagtgcacaggaagaggaaccagtggttcaaatatgactcctttgtaaaaacctgaaacagtttttgtttgatttctaagttgtaatttctcatgaattggtcctcgtgccattggtggggagtgtgtctgcgtgtgtgtgtgtgtgtgtgtgtgtgtgtgtgtgtgtgtgtgtgtgtgtgtgtgtgtgtgtgtgtggagtggtgtggtatgtggggaggaagaagtaggtgcagactagaaagccaaaacatgaaagcatgcataattttgttttggacaacagccaagccctgatttttgccccctgtagattacgttgaaatttaccattaaaaaaagtgaaagcgtttgggatagaaacgacatgaaacagataaaaatccatgtctcatttgtactgtcagaacaatggtttgggaaggaaattggcctaagtgtcttccagccagagatagtcctaggttggtagtgattaagatacaatgttttaatggctgtatggattagaatatattctgaagccgctttttaaattaaactttttttattttgagataactatagattcacttgcagttgtagcagaaaatacagagagatcccatattccctttgcccagtttccccaaatggtaacatcttgaaaatctatagtacagtatcacaaacatgagggccctttctggaccctgatgttttcttgtctacaccaataaaactcttatattttagactttagaacatgaaattcttgggggtcctctacaatagtggggatttttcaacactggaaaagaactgttttagagccacctctaaagcctgaaatatttttcagtctttcaagtaagtaaatcaaaaaataccaaaatactgagcaaaataaaagatcatagctatatggtcatttctaactggttttgacccgctctctcaagcaggctagttgcagctaatttttaagataagctccaatttcacttacaacttcagggcgttaataacctttttctcctttgctctgagttacaaggtcagaatggcccctcataagtctctttcatttgtttaggggaggaactctaaaagaaccattacccttaaatcaaaatcacacaccaccaccacccactccagcccccaaacagaaaatcctttatgtcagtgattcccaaccttggcttcaaaccagagtctcttggggagtatataaaatcctaatgcccaggccttcccccaaaccacttacataaggatacctcagagcgggacccaggtatgagtattttttacagctcaccgggtgattttagtgtatagccaaagtggagtatgtggtatatgtggttgtgaacattgtagctgaatgaacttttgtatctgaaagaacttctctttgcaccagcttttagtcaaatggttatagaccactgagtttgattggacattctttcttccactttctccttcttctccttctcttcctccttctattcatcttccccctactcctacactcctaccatctccaaaaactcaatcttcattatcaccatgagtaaactgcctctcctccttggcctcagtttctctgtctgtaaaacaaaagacttcaacaagattaggttctgggggactgactggtctacaatagggcctgtgatcaaaattcttgaggattttgttttttcatcatgatcattttcctaccattattatatgtcccaggtctgagacgttggtgctaaagaatggcttttcattttgtgttcaccatcatgagtcagagaacttctcgtacttgcagcttatcctgggtcaacaaccttccctctctaattctatcccagtccaactgcttctttttaggatcagtgggacaccaaccagccaaactgtcctctatgtgttcctttggcaaaactttgccaaacttcaaaaaggacagagcaacctataatggcctttgtggaatgtgagtgattatggcagaaaaggacatatgagccattgtgggaatgagaaatatttgaactgagaatcctatccatgtgcatgaaaacaaactgatgcaaatttttatttgtgtgaattttgatagcaatgcaccaacataggctcttcttagatagaataacattgtctttcaaaaggctaaaaaaggtcctcttacttcagctcctgtttactctccctttcccctaccagtggccccttcctgccaagagggcaataatacttcccaaagtgaaatttgcaacatgcctgtctgtggcccataactttaaacagtgttttatgggatatggtcaggggaccccataactatcttcccaaggttcctcactatttctgtcactgaatataaagaccttccttttcaattgcctgtgaaagagttttttaatgggttccccctccttcacccctaacaattgcctataaaatacaattaatcttacttggctttaagccttaaggttccattcttcattcatttcatcttcttgtacccccagcctactttagctcctgggagaggggtgggtagcacaatagtctggtcatcacgtgtgttgaacccttgctgaaagattacttgtatgacaagactctaagcttttcttaggtaccagagttttgttcactcaacaagtatttgatgaacaccttctagatgcctgacactaaaatctaggcactggagatatagcagtgaacaaaaagtccttgatttcgtagagcttacatgccaatactgtcatgtactatcaattcttctacctataaaatacctagggtatttgtactgcattgtatgatcttatgccattacctgtctttagagtctaagtacatcttatcaagactatactcgaatctcatcttttcctcctatccagttcaccctatgcatgatcaggattcaatgctttgaaacagttctgattacattatttctctaactttaaaaaaaaaaatccctcaaagccttctatgccctcacctctattgcttaccaaataaagtcttcaccccttagcctgtcatttaaagtcttccatgatctggcttcaacccacttttggaatgttattctgcaactgttcccttttatggactcgatgttctcttcttcaccttctcaacttgtaaacctctgcctggactattccacttaacttctgcctgtaaaaaagtctacccatccttcgtggcccaggtcacaagccctccccaactagaagctctctctttctccttctgatttgcacaggactgcttacttcttctgcagcctctattcacattctgccttgcgtgcagactactgtcttaactcttaaactgaaatgtgagagtcttggcagcaggaaggacgctttagcctttttggctcttttctccctgagaagtttgcctgtaaatctagtcctatcttttagaagaagagagataaaccttggcaagttgtcattaaaaaaaaattttaatgaaaaaaatgtcagctgcttgtacatgaccacatccctatttctattggtgtaggtaagcatgcagctgaaatcagagctcaccactataaatcaaaattattgaatgacttctagtatataacttaatctctgtgatctcattggtggcttttggactaaatttgttcttgttattttacagagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaaggtaaggggcatccttcttttgtatacttccacaacaaggcttcagcagccctggtctttgcagggctggagctgggaaaggaccctttctcccaggaatagcccatattcacttgtggctcacttagcatcaagtctgtgggtatagtcaggtgactccaggagactctttggacttccttaaatgcagccaaaagagcatagtccggtcccttttgtaaacagcctcttgtattttctcaattatccctggggattgtaggtcatttgggaaaatttcttgggtctttaacagaatgagtgattgtctgtgttttagtaggggacccaacattcaaaggtactcagtgccaaacatcactgaagctcttatctataccttagaaatagcaattctcacacctcaatgcaccccagattaccctggggctctcgttaaagatacatattcctagccccacactcagattctggttaaatgtgtagcatatgagactatccttagaaacgagtaatccaggtgcagtggctcatgcctcacagcactttgggaggtcgaggcaggaggatcactcgaggccaggggttcaaaccaggctgggcaacataataagactctacaaaaaaaaatttaatgaaaaaatattagccaagtatggtagtgagtgcctgtagtcctagctacttgggaggctaagacaggaggatcacttgagcccaggagttcagggttacagtgagctatgattgtgccattacactccatcctgggggacaaagtaagaccctatctctaaattaaaaattttaaaaaggaaaaagagtaatccagtgagaaatcccaaaaccacctggctgagcaccaggaagactgatcaggttaagactgacatgctgtccacttagttgatcaactggctacagcaggcacccatagacttccatagcttccaatgtcttcttacacagcattttctggcctccacccgccccctgcccccacccccacacacaccagtagcaggagtcagggaggagaaactcaatcaaacaattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaaaaattaaattgcttttgaaatttgcaggcttaaaaaaacattcgaaataaaaccattaatggaaaatggtgatgtagtagaagaattggaaatacttactatcgatctgtgtttgatttgtattttattatttttaagttccaaggatttctgataaaagcttatgaaatcaggaagaaaggtaaagatagcttgattttcaattctaaattgcctccaatagattccatttgctgtgaaagtatttcaaagccttttaaaagtgtagggaaatggattttgaaaatcctaaatcccataatttccacaaggtctctttaatttcagggcagaggctcatcccttgattttctccatgtcctacaaaaaccccagctggtttacatttattcatttgcccccactgatttggatgcaacagttctgttctgacctttctaatatagctcactgaggaatcacttgtccccacccccaactcccaagctggatgattcaaaatcatctcgataatttttggggtaaggagagggctatgtttccctgtccagaattaacttcaccccattccactgcagagtctcatccagtctagactattcctttagtccaaatgttcaggggagatggagcctagctatataacactgggaatcctgcctgccctgctcatcatggatcgttcttttccttacatctcttgctaataatgtggtcctctgatatatctacttggctccttgttagcatcaaataagagaaatgataggaatccaccattttgaacttgaatccagcctaaattttcttgaagcatactgtgtgtccacttgatcacattgtctagaagggaacgttactgtttggggagaaaaaaaaaaaaagaggtaagggcaggagagtgaacagcacatctggcctgtcttgtgtgatcctgtccacagccctgacctcacagttgaggtgtcagctctccattttgtctcattgtaacattgtgagccactccagtttaggttattggaaatctttacgtgggttgaccagttagagtgtccagtattctagcagctcttgcaaaggacaggaaaaggcagctaacattattcttatttcttaatgtgactcagtggacttgatgagaaagaactagcccagtgattcatccttctgaggccattgtcttgcagccaaatcagccaattcctagaaatgcatcaagtgggactatttctccccaacagcccagcctgaagtgatacaacccaccctagagatgttgttgattgggatgccaacaggtttccctgggtgtgatgaggtgatgggaataataagaaacacacccagtcctagtcatgacttgaaatctccacaatgtctcagcactctcaaaaagggagataactcatcctcggacttccccatctgcagccttgtgcagttatcttggagcctagctccatgccttatagtaggagccagatatatttggtgttgatttgcatagaaagatactcctgtggccccttccctttataggcccctcagcctgcatcctagatgcttgctccttttttgggtgggtctggggagggaacagggtctcactctgtcacccaggctggggtgtaatggcgccatcacggcttactgcagcctcgacttcccgggcccaagtgatcctcccacctcagcctcccaagtagctaggactacaggcatgcactaccacacctggcgactttcgtattattatttttgtagagactggggtctccctttgtttgccagctggtcttgaactcttgggctcaaaggatcttcctgcctcggcctcccaaagtgttgggattacaggcaggagccaccacacccagccagatgcttgctcttttaaggtccttcagaagacatggggccaatgacttaacttcccacttaacaaatgtcagactgccaaaggatatctgtgaagcaagcagtgatcagctgtagccaaatatctatagccagtatgaggtgggagactgaggaaattgcctgaaattagaggcataaaaggctatcccttcacaagttacccaggagggcttggtcctttccctctcaatcttgacttatcactttccttcctacaccaaacagtgccgaacaccattaagctccatacttatatatgttggtggatcagacagactcatagcatttgacattctgaatggatttgcttcaggatccggaagaaactgtccctttgggaagagcagtaatttttgcatctagcctccatggaaagcaaatctcccaaggaaattttcatgcctggaagcacatccacttgaggcatacaaattttctatagaactgaaaatattaacattacattctactagagatagaactctgctttcatgcattcatttattctcatatatatatatgagaatatatatatatgtggctgggcgcagtggctcgcgcctgtaatccaagcactttgggaggccgaggcaggcggatcacgaggtcaggagatcgagaccatcctggctaacacagtgaaaccccgtctctactaaaaatccaaaaaaaagttagccgggcgtggtggcgggcacctgtagtcccagctactctggaggctgaggcaggagaatggcgtgaacttgggaggcggagcttgcagtgagccgagatagcgccactgcactccagtctgggcgacagagcgagactccatctcaaaaaaaaaatatatatatatatagatatatatagatatacagatatatagatatatatagatatatagatatatatagatatatagatatatatagatatatagatatatatagatatatagatatatatagatatatagatatatatagatatatagatatatatagatatatagatatatagatatatatagatatatagatatatatagatatatagatatatatagatatatagatatatagatatatatagatatatagatgtatagatatatatagatatatagatatatatagatatatagatatatagatatatatagatatatagatatatatagatatatatatagatatatagatatatagatatatagatatatagatatatagatatatagatgatatatagatatatatagatatatagatatatagatatatagatatatagatatatatagatatatagatatatagatatatagatatatatagatatatagatatatagagatatagagatatatagatagatatatagagatatagatatatagatatatagagatatagatatatagatatatagatatatatagatatatagatatatatagatatatagatatatagatatatatagatatatagatatatataggctgggtgcggtggctcatgcctgtaatctcagcactttaggaggctgaggcaagtggatctcttgagtcttagagtttcagaccagcctgggcaacatagggagaccccatctctacaaaaattaaaaaaaaaaaaaaaagcacggcatggtggtgcatgttagtcccagctactcgggtggctgatgtagaaggattgcctgagcccgggaagtcaaggctacagtgagccacaatcacaccactgcaacctgggtgacagagcaagatccggtcttaaaatatatatatatatatatatatatatatatatatatatatacatatatatatttatggactgcctactatgtctgaggccatttataagcatccagaagctgctgctgaagaatctggagaagctcctgagagtagaatatggcccaagctgttttttggtcacagatactactcggtaaacatagccccatggctatgacaagaacaaaggatgcttgatatgttaagtagttcagggcttgggttctgaatatagggttccattttagctccttagcttttaattgctaattctgcattctctttcagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaaggtgcgttggttggaggccctgcttttggttgactgagattctcacctagtctttctaaactttctttaggcatcagaaacataacctttcatataattgtaatgataatatttctaataataatgaatttcattctctcttctcttgaaagactgaaaaggcagttgcttggaagaaatttactacccagaaatatgcttgtgtctaccacacctctcatgtatccctgagtgttgaacttacctatgcttttctaaatagtagagaatttaggctatcatgatgataaggaagaatagtagcagctttcatttatatcactattaaacccatcaaagtacaatcacatccattgcccttttaagacaggacgagaggcaggtgagttatagtggaaggagaccaggttctgatccaagcctaagatgttgagtgatcttggaaatgtgccatatccattctgagcctcatcagccttatctgtacaattgaaagtttagaaaaattatctctaagctcccttctaacactataatcctataattatattattatttattttttaaagataagaaaattgaagtacaaaaatcaaaggacttgcccagattcattcaactaatcaatcataaaaccaaggcctataacccaagtcacttccagcccatcgttttttctatgccagtagaaaatattgactgataaaaaagacaagttaattatttaaatggtagtttttaaaacatgagctaaataaaaatatagtccctaatattggggttgacagaatataggatgggtaatcaagcattctatctctgtcttgccacaggtttcctgtgtgatctataacaagtcacttcacccctctgagcttcagtttccttctttgcagaatgagagggttagagtagattttttggggggcccttacagctccaacattcgaagagtcgatgatttagtcaatcccaggcacatgaatttatcatttcttatgcttctgcaaagcatttttataaacacagatgaaaattcaaacattttaaaaagtaggtagagagctaaattatatacttcttcaacttagtccctcatgactagtaggcaaacatgccctgaatcaatgtgtatttattgagcattttcctgcaggccagtggtactcaaacttgtctgaacattagaaccccttggcgagcttctacatatacctgtgtcccatccccagagactataatttaattgatttgaggtgtggcctgggctgtggcatttttaaaagatccccaggtgaacattgtgtgcagaaaagtttgagaactactgctgtaggcccagggtcatttatggtcttgctactcaaagtgtggtttatggactggcaacagctaggagctggttaaaaatgttgactctcaggcccccactcaagacctactgcatcataatctgcattttaacaagaacctcaggtgattctaatgcacattacagcttgagaagcactgatttatgacacaaaatcttcctcaatgtaacaacccccatcttccagagtacacagggggcagcgtgtggacaggaaggacaggagctatttgataaggtgtagagaactggggcattgaaatttatgagaaaatgtatttattacgaatacagagagaacacattctttttatttttttttttattttttgtttttttgagacagagtctagctctgtcgcccaggctggagtgcagtggcatgatctcggctcactgcaaccttgcaacctccacctcccggttcaagttattctcccgcctcagcctcccgagtagctgggactataggcacgcaccaccacacccagctattcaaactcctgagctcaagtgacccactcgcctcagcctcccaaagtgctgggattacaagcgtgagccactgtatccggccaatggagagagcacattctaaggatgatatggacatccgggccacccagcaacaatgacctattatgacttccaagtctgtggtctcactggatcctcaaaccttttagtatcacatagtggtagtttcatgaacacaattttctcttctgtcaggggtctaacacttaatagtttaaaaagtaatgcaacaagataatttcagacaaaaactaatatttacacaaattacccatgataacataaaccctctcattgtataatattccaatttgaatctcaggccttcagaccaagtcttatttcattgtgtgcttaaaattttattgatgcagatgattcaattaaaaaattaaataatcaaaaagctgtgagaacaagacaaacaacagtcattgcttttaaaacaattgtcctctcaggttggtaatgtttattaaaacatttggtggccgggtgcagtgactcacacctgtaataccagcattttgggtggccaaggcaggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctcaaaaaaaaaaaaaaaaaaaaaattggctaaaaaattccacttctaggaatcctaagaaagtaaccacagacatgcacaaagatatacaaataagaatttttgctgcaatgctgtttacaatactgaaaaattggaaataatctgaaagttcacgaatatgggaatgattaaacaaattatggtgtatctgtaccgtggaatattaatatagccattaaaactcattatagaccaagattgaatggcagagaaagatgtttgcaatgtatttgttaagtaaaaatagcaagctaaagaacaatatgtatattatgatccaactttttgtgttaaaaaagaaagcgttgaccaggtgcggtggcccatgcttgtaatcccagcactttgggagtccgaggcggacagattgcttgagcccaggagttcaagaccagcctggacaacatggcaaaaccatgtctctaccaaaaatacaaaaattagccaggtgtggtggcatgtgcccatagtcccaactactcctacttgggaggctgaggtgggaggatgggttgagcccgggaggtggaggttgcagtgagccaagatcgcgccattgcactctggcctgggcaacagccagaccctgtctcaaaaaaagaaagaaagaaagtgtttatatatgctaagacaaaaaaaagaaacaaaaagactggaggagcatacggcaaaatgttaacagtgaccattttcttgtgactgaattatgggtaactcttattttcttatttatttatttgtattttccaaattttctatagtaaatatgtgttacttttgtatttagaaaacataataaaatttatcatgtaaaaaactgccctccagtatcccagttggcagtatattgaagtctgaatgattaaaccgatttttctggaagagctgcttttcccactttcccactctgctcaagtttgtggagatagacgattgattgagcaacatggaagaagagaatttctgtctcattctgtgtatctgcctctcagtgagccagacatgggtgtctgcatgttgaatcactccttagtcacattgcctgagagtcaatagccacatagccaagggcacctgctccaggtactctgcaactgcagagcatcaggaggcatgcacttgctcatgcattcaatctggaaatttgttttaagtacctactgtgtgcaagacacggttacatgcactgaggacagagatgtgaacaagacaaaggctacttgccagcatgctctttacattctagcagaaaagaaagacagtgaacccaaatcaataaggtaattttagattgtgatgagtgctgtgaagaaaaaccaaacaggatcaagagagagtgaatggggcaggaagcacttttaaaggagtagtcagggaaggcttctctaaagatatttgaatagagtcctgaatgacgtgaaggggtgagaaatgggatgatcatgacattactggcctcttaaaaaatgacacatgacacagaagaaaaggaacaaggcagtgaggagagaagtagatggaaggaagaaagaatggtaaattcagttatgttgaaaagggaaaagagataaataaaattcactgataatccagccaaaagtttcattgtaacaagtgattgcagcctcctacaataacaaactaggaccaatattaaagatgtgagtttcatctctctcttccctttgctctggtagaggctgaccttgctttgcatatcaatggccacctacagggttgggtaagatgtccacttcctgaagattccccaactcacttctcacactgtcgtgccaaactcctattaacctcagtagggaaggcaccagatttaagaggccgaagaaaagatccagagccagcaaacaagacatggggttttattaggggctgacatacaggggagagagtccagtggaggtgggctggacaggagaaccaccttacatatagaaacagtccagtggcagcaggttgggcaggaaaactgcaaccacttgcaaacatcatgcagtttatatagcattttcactgaacactctccccttaacgacctggcaaccttcatctaacccaaaactcaaggcctctatcccctgtgcagccccagggatgagcctggggttcagatggtcctcacagacaaggaaataatctcccagttggccacgcctggattcccaagctcagaacacacattcagatacgtctgccatacagggtcattctaagggtacacttaagttattgctatcatgagcatttactgtacatacaaccacaataccatcccaataccttgaatttccataattacatactccttttaggttatggcattaaaagtccctattaagacttaaaagttgtcccagctggaataatacttctccttcattaccacttctgcaaggaattctggaaggctcaggatgggaacattctcttgggctgtggaaatggccagaaatgacatcaagcacattgtcttccccaaaagaaaatgagagtaggtgaactatagtgatcagaaagcaccttgaagtgcagagtgtgaaaaacggcggatgttgctaagtaggtagttctaaagacaaactttgcttttcttagcattttcaagtaccagccagagttaagtcaataatgagttttgttgtttgtagatcccttcggtcaagtaaattaagctcttgtagggaaggaggtagtggtgcaagatgactcttcaggctactggaagaacttttagcatattacaggtactgccagtgccatcatggatttcatgtcagctatagctgtagccaatattaagctggtgagcaaagtttgagaaatgaatttggctgtcattctaaaggtgataattgaatacacagaagtctctgtacactcagtgacctcttccctctctccaacccatttaaaaagtgctagcacgtggcccttaattacctatcaccaaaaagactggcccaccaagtaaataaatagctaaaaagaaggacaaaaggaggaaaacaaaaagcttgattccacaataatccacaaattgagtaattcagtctggaatcaagagaagactatggttttgtccttacaatgccaaatggtggtgggggtgggaaagctaatcaggttaccaagagacatacaatagcaatttgattacaacttctagtccaaatgtgtctgattggctaacagtgagtctccctaattagagtcacagatccaaagcactcaacactcagtggtttcatcctcaacaattcagatattcttacagatggcttctgttgttctgatttgagtgtatgctttaagtacgcagttcaagagagtactgattacaaggccagcaagcaaacttaactcactgataaccaacaagaagaaactttttaaaacaggggactgaggaaagaggagggagggtggagtgaaatgtagagcttgtgcctttatgcctgcgagctgaaattcaacagtttagtttacacattaaatgatccatcgctgagggacttgaccaattttttgtgtctcccaaccattcatttggcatagcatacatatggctaatctgacatctagattttggcactggtgctgatccggtattattgttccccttacaaacaaatcaaagagcattcagaaatgtcaagccaatttggatggatcctttgggcaagtatatgcacataaatgagtgtcatgaatgttttctaagtataccaaaatgatgtcaggggatgttaaccaaggccctttttcagcccattccctgggcctctcctggcaacactgagctggacagagcatgatcctgaccctgtatggaaattcctatgttctcttaagtgcctaggagatttgtacctggctacatttttcctcatgaaagtccacttctcagtgacagtagtaggggtctagtgttccgaagaactatggattctgtcaacacatggacttcaatcaaagttacgtgctcctttgtgatttgtggcttaatctgtggcttgttgcagtggcagcctaagctgggctaatgaagtatgggtggaatttctgtctctcgaagaatgttcttgttaattgtccacttttgataagtgtgagatgttatgaacaatgagatacataaatgcagaagttcacttctagctttagaaaaccatgacaaaattctacttgcttcctgattccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggtgagcaagacaacattaatttctcatctttgtaagggggcacagaaaaggatgagaggactcactttaattttgcttcaacctgttccctcatttggattaaaagttctttttgattgcttagaaactgacatatctaacactattgtcattatggcctttcaaatttaacgatggcctgtgctaaagatcaagtactgacccttgggtttccaaagctgcctatttcacaccaccaaaagctggagaagcggttctcaaccctggctgcccatcagaatcatcagggagagttttggtttcctttaaataccaaatatctgggccctacccccagagattctgattagttggtctggagtggggcatgggcatcagtgtttgttcataatgcttctcaggtgattgtaatatgtagccaggattacaaactgtcaaactgtagtctgtcattctttccagaataaagctcaacaaccatgaaaacccattcattcagggcaaagctaagtccctaatatcacgatgtgtcttctggggtaaaacaaatttaaaacatcatccctgccctcaagaaggttatagtcttactggagaaaccccagtcacaatgttcaattccttttctgattactcacagtgactaccacagcaagccacattctgttcattgtgatcctacagctcttctaactttttgtaggctcaagactagtgcttatttagtgtggtcaaggttcctcacaatccaagtggataagtgagatttcagctggaaaatatacacatctttttgctattggctctcacataaggctcaagagtactcgaacttctgtatgcatcaccattacacagggagctggttttaaatgcagatacctggccccatcccagagataggaattcagtagaccttgggtagagtccaaacatttgagtgtttaacaaatagccagatgattctaatgcaggtggcacttggaccatgctttgaaaaagactgctcagtatttatgaggctttttttctctccctttagacaacagcctttatctaaagaatgcatttctccctaaaaaaaagatgcttgaacatgtatatattcactcatgcttatttttggtctatgccttggagtgttgatttgccatctttaactccctagctcatccataacaggacacctaggactaggcactggtttgttgcgtttccccagcagtgggcccactattcgtcatcccacatctttcgcctctcagaggtgtgcagatgaatttcaacttgctaatgtagcgtctaaatatcctcttgttcacagttctgggttatcaaggtctatgcttggtggacacagaaaaagaggcttaatctacttcgcccatttaagtgggctggtaatatgttgctccttcagtataaggcagttgtcagttgtctacctgttattgtgataaaagctattcaggcaaggttgagactgtggagagcactctattttaactctccccatttatgaataaggaaggctaaaggatctgtgaatatttcccaaaggaaaatatgcttttcagtgagttcaagaacaagggtggcttctccatttacaaaaccaacctgcctgcaatcccactgcaggctctcagtgcttagccaggagggcagcccagcggtttggcatggacacagtctatccaggttgggggcaagtgcagaatttctaatactgcctatggctgcagaagctccagtaagcacttatgctagattccatgtggctttccctaggagagagtcccatggtcagcagcactatctcccttatctccatccactggagaagccgaggggaagccagtaagccaaggaaacaaatggagtcaattataacccttgagccatccaagttcctggttaagcacattacacagcccaactcgatactcttaagccctagtaatgaaatgatatgctgagcctgagcagaaaaaaaggagttgatggttccagattgagtgcctgaccatttgctccactttttgcttggccctaggcattctccagcacttccatattgagaagatctccaagaggatgtttgaggagcttcctcacttcaagctggtgaccagaacaaccctgagtaagtagtacttctcttgactgctccctgaaaaacacattcagttttcaatttagcatagccacagctaaagtccctccgcaatctcagtgaacattagcactgctcagtatcaacactaaaggatgttccatctctcttctgggtgacttagcagtgaatggggtgtctgaatgtaatctgaagagcttggacatggtgaatacaaacccagatgtagtctgagcataggatacctcaggtcaaggcttcctgaatgtctttaatgaaactgctaagcacagagtctcaagagggttggagaaagctcataagattccaggtctggtatatttatggagacttcacatctggaagggtgtatcctctggtggtgggtatgagaggcaaagagaaattaaaggcatatcaattcctgtgttatatgaaagcacttttactcctggggaactgcccctgggtggtcatgtttccttaaaagcattcaggcactcaaaaacacttgcagctctcccactttccacactagatggagcctagggactaagatacttctaggcattggggcgggtgttgagcacttctaatgggataaaaggcacacagtttctatccacagggaattataatggatgagacagaacatgaaaatgacttcagtatgaattagtatagttctgaggagttaaatatcaaagtgctcaggggaatctgcaaagaacaatgagatgagagccaggtgggcttagtcggggaaggcttcggggaggaggtgtgttttgaaagagaagggtatgactgggcaatgggtcaggaaatcagtccaggaaaagagtgcagcctaagagaagactcagacaggagcaaacaggaaatgtgggtaggggagaggaatgatcacaaaggccacagaaggtgcactaaaagattagaagatttggaggtagaaagtagtcatagggcctgaaaaaaagccagtaaaatgttcaaatgtaaggcaagtagcatctgtagttgctgcaaatagcatagagatatcaacatggtgctttggaaagatgtctttcggctatcagatgcatatattacattaagcacacactttgacgaagccagattatgaagtgcccaatttatcatgctaggacattggacttgatctccaggccagagaatgccagtggaggtttttaagcaagtgaatggtgcattcagatctgctttatttatttttttatttttttagaaagaggtcctcgctgtgtggagtgaaaggtggacccttattaagagaagtgggatagtctgaattaggaactaattatactatattaaatcaatgagacgggaggagacgtcactgtgagaaacatttctgaggttaaatcaacaagatcagcatcaaagagagaaacgagtttggaatgggtccgatattaataactcgactgggtgaatagtaataccattcaccaacagggaaactgtgaagaataagcaggtattggtgaaaaagagtttcacttggaacatgtttaaattaatatgcttaagagccatctgagcagagttagggtccaataggcagctagaaaaagagccaaggcagtcagttgcttgtctttggcaggactcatagaaaataacaggacagtatgagaattcaaatggaaaagttgggagtccttacatgtgagtaagaaaggaggcagagtgtaagatcctaggatcaattatgggacttctgaagttacatgttttagttcatactgtgaacaaggctttgttctaggttccaggggacttaaaagatgatttagatatactctgtgcccatggcaggatttggggtatataatggagtagaaggtatgtgcctcaaactgtgtgtagctgaaagaagttggtatgatcctacagggtcacctaggagcaaagaagaacaaacccaactcttttatataatgtgcctagcagagcccagcacattatagggcttcagtaatagctggttccttgcccaaatcctcttcttgtttttttgtttttccttctatcttcccattgagtcatagagaatggggaaaagggagaaatccaagggagaaaggagcagagaaatcaggcccatagggaaggtgggtcattattctcttgtggctaaggaaaagaaaaagaggttcaagacaggtttgggcttaagaggagttggcttaacttggactaggagttctccaggttgcagtaccatgagcacaggaataaaaagaagacaaaacacagtatccagggtgggcagagacaacaggggatggaagggctacagccaagtttactctgcgtggaaagggattccatggggtatatgagaatggatgaggaaccatgggaagggatttagggtgctaagggggtataaggacagcatgtggacgtaggagaaagcaacgtcgagaagtttttaacaaaagatagcaggaatagaggaaagagtgatatataatcaaatagtaatcaagtaacccaaaccaatatttggggaccctaagggtaagcaaagccccagtaatacagtaggtgccgttttccaaagtgcctttttgacctggtgccaagtaagctgcctaaatagctaacaagcagatattgaagcattttgtaaatgctaaatatactgtaaaaattccaagaataacacttaggttttgctcttgaggaggggcagttctatattattcttgggattcttacaaatgctatgtgttgaaatgaaaacttcatttcccattttccatatctgctactagaaaagtgttttggggccattttttgaaaccaagtgatatttgtattccaaattccctggtaggtccatgagtaagtgggtaagcatggggtatattggttctattcctaatttgctctgctttcctcttacacactcccggccactttgcgtttgtttgccttttaggccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggtta

SEQ ID NO: 3635 - DNA, 120035 bp, human
cggacgagagcgccccggggagctcggagcgcgtgcacgcgtggcagacggagaaggccagtgcccaggttagtgagcagtgcccggcgcccgcttccctcacctccttttccagcctttgcacaggtgggttgccttctcttggccggagccgtccctggaagtttccccagggtgccccaaattcccctgccaccccaacctgttctgtgctccagcagttagcaacctggatggaggtggggcccaaggcttctgaccaaagcaagttgggggtctctgaattcgaactcacagctcgtccctccccactcggcctgcatttctttatgctctggcgctttgagaggtcacttaggtactccaccctgagctacccaagggactctgcagtccccttaatcactgcctgtattcctgagcctgttttctcattttgctgatgaatacatggtaaagttaatgtagcagggtagatgggcgaaaggctccctatcctatcctctggccatctgcctcattttttgtccctgactacgggggtcagaatttgagacactaggctctggaagcaacgtggtatattgccagaacatagggcccggaaagcctgctttccagtccctcccagccctgccactaaagttatttgagttctctgggtccccccagtgcccattttgaaggtggagttgtgtggaatgaaatgaaatgatagaaaggtgttttgcaagccaaatgcgaggcattgtttgtcagtcataagcagcaatgaaagcatttcctccaacaagagataccctgggttaaaactgccattttcagtggcaacacaccaccagttaactgaacttttcttgctgggtggtagagtggggagaggatttcagctgatggacaagggcctgggactccagtgtctttcttattgtttgtcggaaagaaaattgctaccctaggggctgtcccacagatgatagtcaatgtgagattacaaggtcagtcaagcctctcaggaggattaaagagacactgtggggcgtgaagaactggctgacatgtgttcatcccttagccttcctgtggggatgtctctttgcttctgttctacccaggagacctgttctgaaagtgggctcctgacacttgatggcccagattgccttgcagtcacagctgggcaaggagcagttggtccctttgcttaacgcagatgaacaatgtgaatgcttgtttcatggaagcaccttaataaatacctttcttttggtacttgatacatttctctttctcttgtaaaacacaggaactctcccatcccacctccactacctgtgttagttgcagggttttgtttttttgttgttgttgttgctttcttgttgggtcctggatcccctgaagcatgtcaatggctacatgtctaagtaacctgtaaaagagccagtgcaagttcaatggcacaacagcctgtgtgaagcagacagagagttaatgcagaaataactccagttaactgggtcaaagtataatttgaaaaattaaggacagtttggctctttgcaagaataagagtcggctaagttcgctgagcaatgcttgctagtgtttactgctgcagtcccaacacatgttttgaaccacccccttccctaaaagaaaaagctgaagagataaagagaaattgaacagtgaggagatctggggagggaactcttcttggttcatatttctgcacagaatacaaaggcaggacttcaggatcttgtaaatcaaaagtgaatatttataaagcgattcattttctgatgttctccatcacagcctgggaggccacacagatgacaggaacgccaaaggagattaattgctctctagttaccaacttttttatttgctcataatattagttgggacctaagaaaggcaaaaaaatctatgagctgttttcttgccaacttgagttatgaagcaatgctacagttcaccgaatcgcccaaccattatacaagaaaagcagccctgttgattctcgcatggggagaccctaaaaccatggtttcagaaacacccgttgaaatccatatatgaatgtgataaattggatttcagtggttaaaaatctttctcttttggaggcttggggaataaacttattagaataggctcaggaagaacctcactgaggtgggtagctgtgttaaattgttaatgaaaatgatttgtttcgaataaacgtggtagccctcaagggacagtaacattctgagtgattgtaagtgggccacaaactcacagaggggaccaagacatcagaactcaggtctttagatgggtaggaacatgtcctgagagaatttggttctttaaggagcagggaggaggtaaagaaggaaggcagacggtgctgcaaatcttgtttgatagcacagattactctatcatcagttcttccttggttatgcattcataattgaaacagtggattttgaatgacccaggcaacttcatagcatttaagtaggagctgtagcatctacttcagagcccaaagatattcaactctccaaaatgatcgttttgcattccttcaagttctttatgtgcaatatttaggttggactttctggaaagatcaatgagttcatttcccattcagattgaatctggtgtttttagaacatttcaatattttcagatcacccattggaggaattttgcaaactctaacatctgtggaaatgatccgtgactagatgtgagctacagcaaactttctgtgttccaaggttcaaaaggtttaagatttctaccccttatactgggaatgccaatctcatgttttgaagaactgtagttgttttaatggtcttttgcatggtggtgcaaggtgaacaaattatctatttaatttgcccaatttcccctaaaaatggcccatttaaaatttccattttacaatggacttcttgggggaggaatatgttggaaccattttaagcagtaaaacttttcaggtgtttaattgcatccatttgctaattacatctatcttttgcaatattagttgccaaaccaaagatccttgtagatctcatagaggacacaggagaaactgatcaatttgtacttcattccaaaaggattaaaagtagtcttgaagctaagattagttaactttcatttcagaaattgcttggtctcatgcttgttacttttaccttgtttgctaaaataaccgtttttgcaagctaaagtttcccttttctcccaaaaaaatctcttgagaaatcaactttaattcccttagaaaggaagatttcaaaatttattttcattttcctataacttgcctgtaaggacttagcctcagctttggataggaatgcaccctcattcacttgaattttcacccacaagccttgcaagacaggagaggcaagtcctttatcttgtgcaggcagacaatacttacacttatgtaaattctaggacattttttttttattctagcaggttagaagcctgagcatcagtgacctctatcatttccagaagatctgtgttaagtcttttttctgctttcttcccaacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacgtaagtgtcttgcatttggaaaataatacactttttataatttctttgaaaatgtggctataatctgtagcaattatgatttagcccaaatgtggccgtgccattattctaagagaagaaagtgaatgttactggtttatgcatgaattgataaaagaatgagagctttgaatcaggccaactaaatttggggctgtttttctgattatcatgtagtctttgtctcatagaacatatgacacattagcttattttctcttccctgttctaaactatacaaatctcattacattttacgtaactctagaaatatctgacagatgagctggaattttcccaaatttcagactcttcagcaaaggctttcagtttatgaaaaataatgacacagaaaagaaaaaaaaagaaaaagaaaagcaggctctgcctattcccttatgccgaaaaacgaggaaggacgaaaccttcctatgaactgggctcagatgaaaaatgttttgaggaaattgagattccagggaccgttagcaaattggatgccatttattgaaaagaacatccccgcaaagccagggaatatttctagaaagtcagcgatccgtgtaatgggctaacacattggagaaagcagagagtggcaggaagtgggggcgggggggataattaaccctccttgctgccacgtttaggagatttatgagtaacggtcgacatatccgttcttgctgcctttgcacaatgtgggtcttaccttctttgggccacttgcagccatctctgaggtagatgcttgctctaaatttgaaggaaaagcctaagctctagttcccctttttgacagcatcaaaaaaagcacaaaatggaattggtccaagaggggcattctctgcttcactgaacttattcatgagaaggagctgtgaaaatattcttggtaggaactgaagcagcatctgaagcccttcacttaaacctttatctcttttatcacataagttaaatagatcaggcagaaggcttgctgacaaggagaacagtgccaagcctattccatccttaagtgtgtttctgtcccactacaattttcatagtaagtgtagtcttcttcctgggagaaacagtgtttaatagtgtttttgattatgcttttgagcatgagcggtgtatggtgatatctagtatgattgggacacaaaaggaagtttagtggggcatgatctcagcaaggaagcttggatcagcctctactcttgtatccctcaaattgcttccttcttcttccacttgaatatagttcatctcagaatcctcctcttccagaagccttccttgatttaagtggatgtgacagaagcatccatgcattctcagctcagctcacaattagctgggcttagggatgaaatattactcaataagtacaatgtacattatttgggtgatggttacacttaaagtccacactttatgcgatatatccatgtaacaaaactgcacctgtaccccttaaatttatacaaaaaaatcttcctgtcttagagagaaacttcccttatagcctgttaatgatgacctcatggggaaagcttgtaactctcagaagaccatctcttatggaaagcctttcatatttatgaagaattgaatattgtccatgaaacttagacaaagaaagatgtgacttaaaaaaattacaaacccaaatctactactttctaatatttccttgtgctgatgaatttgtcccaagcccttttgatattcaattggtgccaaagtgattatgtaacagatggcctagggcaccagatctggtccagtgtttcaggcttattgtcagatgatgacgctaaggtcatggtccttcccttagtgagccactgagcatcattatgtgtgtccatgcccaagctaactgttctgaagacatgcaaaatcatctctgctaaagggaaaacctcaaagcatatgtcctatatatgctgtcttgatatatgcatgcacatacacaaacacacacaatatgcatgcacagagatttatattgcagctctaacagtgagaagtcagaagcagtggaaatgtcagttcatagataaatagttacaaaaatgatccaggtaatgcaatataatgctactattaaaaacactgtttattgaaaatttggtggccctgggaaatgcttgttaacttatttttaagtttcttaaattataaaattaatatatatgcttattatacaaaacaacatgaaagcatctgagcttcatatggaacatgtgtccctaaactctcattccactctcctgggataaccattattagtggtttgctgtgtgatcttccaaactactttctttgttttataaaattatatatacatgcctgtatgatattttattttacaaaaataggatattatatacacttttctgtgatttgcttttgctcaataatgtgtgtaggacatccttccatgtcaatacattgcaatgtaatagtgccatattctttctaatgcttgcatggtttgcagttgcataagtttgcattggtttatttaaccagtctatatttgtagatattgaggttgtttccggtttttgctattaaaagtaagacatttatgaacatctttaggcacttattcaagtatttgtgagaaatagtcgaagtgcatgttcagttttaatcttcataagtactgtcaaattgcccttcatataagttgtattaatttatgctcccaccatctatgtatgaaagtccatttctaattccttcaccaagattataatcaatctttgtattttggggccattttaataggagaaataatctgtaagttttgcttggtatttttctctttctgcagcatcttttcgattatgtactagttcaattttatttcttcagtgaattgtctatttttagtttggttgcttgtgatatttatttgttaaaaacttacttattaaccttttatattttaaatattatttttgatatgccacttgttttaatctttaagttgtatttttcccatatagaagttttaaaattttacgtagtcagatctgtcattcattttctgtatggcttctggatttcttattcctaggaaggtctttctcaccctatatttttatattttcttctactgctgccataattttatgttttacccatagttctctattccatctgaaatttatattcctgtatggtatgcaatggggaactaattttttttaaatctccggatggtaggtttatgaatgttatttttgctcacttttatgcttctgtctattccaaaatttccacaattggcaagtttcacttttaaaacaggagaaaagctctttttaaagtaaaagtacatcttatttcccatatttttactgtgcaactctagagacaagttggtatgtgagtagatgaagaaacagaggggttttctaaaattaaaaaggaaagcaactggaaaaacttcagaaaatgggtaagagtaggcctgggtcataaacccttcacgtctctccttgtctgacaccattttaccaaaagaaggcaaagttttttatcttgcaggggctggttagaatataagcttttaggtcaaggaatgtgttttgtagcctgtttgctctcctatttggggcatcacaggggaatgacgggggatgccattatggtcaaagatgctcactcaattgattcagaaatctgaagaggtgtggaaaaaacgctttgtttgtggaaagctcatcacaaggaatggtgaagatgggtgctgccacttgctggtagctaattagccatagttacaatttctcttataagagagaagacaggctcaggaaacccgaaaatactgatagtgcattgcaatggatgaatgagccatttgttgcttacataaaagtttgttactgtttagcatcagcaaggtttgagttctttagctgggaaaaggtccttgtgtataactccattatgctctgttgttaaagttgtagtcaatgaggccaggaaactcttttgaagttcaaaggagcgtaacattcacagcataatattcatgcaaatatgggataaatgggctgaagagtttgcccatttggcagatctaacttaggtaatgaactattgatcaaagtgaggttgaagaattgaattgttaagaatattcaattatgtatttctaatagaccagcctgtgccaagtctggcaaaggttctggagagagaaattgttcatgtatttcatgcagtccactcctgctttacaaggtagttaactggatcttcaaggagctagattgtcacttatttttctcctcaagagaaaagcttccaatattcagatttggctaaaagtgggcctctggacttctcaggaaaggcaagccaccaaaagattgaagggaaggaagaagatacttagaaagtttgaaacatgtgaagcccacttagaacttctctattgtgagagccagccaggaaggcatgggttttcctcctccagattctcccttggtcatttgaggtgattattgagcaagcaaatgcgtggacctgttcacatcttagaagtttaattaagtggaattagacgaaaggaatacctaaaattagatagcttaatgcttttcaaagtatattcttaattgttttttattttggtgagggggcagtaggttttgtcatggaggctctgtagttagcctagatccaatccccagctccttgacttacttatgtaccttgggaatgttacctaacctctccagctttcgttttcttatcagtacagtgggggaaataatagcataatgagcgtgagcattgtcatttgaagaagaaacgagattgtgtacaccaagtgctttgcatagtggctggcacatagtaagtttttcataagtagttgctattagagcaactctcttacaagccaaagatattatccccttaattttaaggtgagaaacttgaaactcaatgaaatcaagtgactttgtacaaggacaagcagcaagtcccagccagagctagaaccaaaacccaggtctccgaattaagtgttctgttcactatacccatctgcctcttggaattctttgaggaagtcagttcattgtcttgaatagaagcccagtcctttatacatggcagccacttaacacataagagatgatccaagtaaatgaataaaaattttctaacccaaattcctaagagggatagtatactatttgggagttaaaagactgagacaaggactaaaaatttttcaggaacctacatttgctaagccaaaggaaagtagtgaggaaggttaaaagtatgtgcgtctatgtctatgcttcttatatttccctgacttctcagtaggattggaatgtcttcatagtttaatggaaagaggactgtgcttaaagtcaagagacctggtttccggtcagtcttcccttgtttgccgtgtggtattggttgaatcattcgtgttctatgaagtaaagattcactacttacaaattgaaaagaattcttgccttctggactgaaaactaaaggagaatagtataggggctggggaggtggaacaagggaaacgaaggccctggttttgtgtacttggagcaaaccacatggatatttaatattgtcacaaggtaattgcaaagaatattttatccatttaagatttatagcctgtctgcttctagaaaggttagatacacattagagatgaaagaataggggcaagataatgtttttaaagatgaaataaaatagagatcatctgaagaaaatagaaggaatagatgtttttaacatttggtttagtagattatagcatttataatgtaaatctggcttatgcctcccaaaaggatgaaaagagaaactttgggtttgttgtcaagagaaaatttacagtttcatctacagagattattcccacctctaacccactcaagcagtattgatcctgggatgtttgaataaggcacattctgggtaaccttggtttcatagaaaaaagaattgtctggcatttctttactgatgctttgtaaaggaagaaggcaaatattaaattataattcaataaaggactttctataagcagtaaggaaatgcattccaggtactttccctttgaatgatctaaattggagaatagaacatggaaatgttaaatagatgtttaatatgtctactagactggattgtcaactatcagatgccctaagcaagctttctattaacatgatttgtttctgattttaaaaatagatgctcattgttaaacattcaaaaggtacataaaagtatagggaaaacaaaaatgaacagtaatcacaacgtgtatggataaccatagttaattgatatatatatatacttgtagtctttttttctaagctcagttatacaaacatattagtttacaaaactgaagcactttttaaacagtatggatcagggtttgtttatttatttatataaacttaggggagacaagtgcggttttgttacaaggatattctgcatagtggcgaagtctgagcttttagtgtagccatcacccgaattgtgtacattgtatccaataggtaattcctcattccccatacttcttctaccctcccacctttccacatctcctgtgtctgtttttccaaaatgtatgtccatatatacacattatttagcttccacttgtaagtgagaacatgcagtatttggctttttgtttttgagttgtttcacttaagatcaattcacaattggagtctctaaaatgcacttgtagtaaagacaacatcccatgttgtctgtaagtgaaagctgggcggtttagacacgagttgcaggatatgcaaatttgattctattgtgagaagttcaagagctcaacttttattctctaccaaagggaacaaaagtattcctgatcaaacagaaagcctcccttcacagagatttgcaccgctaaagtgctgataggaagaacagtttggttttttgaacaggcatttttatttttgcccaaagttctatgccatatgacatggaagagatgatattagcctgaaaaaatattcaggtcaggtttcatcagcttagcagcctttctgtaaaaggatctcctcatggcctcatagtagacactaatgagaatatcatcaactcccagttatttatgctaatgaaagatagaagggcacaataaattgaaatttcatggaaaatctccagttctcatcttaatggtgtcaccttgcttgactgccaaacttctttgaattatggacccttttcttttcgatgggtttgcccacctgctaataggaaagtaaaataaccacaaaacaagtagtgagagggccatgctgtgggaggcccaggcaggtgaatcacgaggtcaggagttggagaccagcctggccaacatggtgaaaccccatccctactaaaaatacaaaaaatttaggtgggcgtagtggcgggtgcctgtaatctcagctactcgggaggctgaggcaggagaatcacttgaacccaggaggcggaggttgcagtgagccgagattgtgccactgcactccagcctgggtgacagagcaagactccatctcaaacaaaaaacactcagtatataattttgggcaggtgatccagcaagtaggaaaaagctaattaacttctgaatgaaggaaaaagctgcatacacaggacggagaatgttgcttcttcatgactttctttttttctctggcgtctgcaggctggaaatgaagtcttaaagtcctgagaaaacatgaaacagagtcttcaactctagaaacccaattgtcagtgaaataagaaacgttttccccttaactactacatcttgcccttcctacattctgcttcaagtttgataaatgacagaagagacgtacttatgcctttattttttcttcactcttctagtagccttttaaagaaaaaaataattaaaaaggaatttgtttacttgatgtgtccactcatataatgaatagcagagattcatctttttttccactgaccatgtgttataatagaataaatattattgtaatactgacatgacaatgtgtctacagtaatagcgcttatcaaaaacagttcttgggaatgttttcttgattttggactggtgatgaagttactgacctttgcctaatcctgggagctagtcagtaatgattggcaaaacattgatggcatagtgacacgtatctgttgttgtttactttttgtcatcattgttcctattaacaggggcccctaaagtagcagagatagccacctctaatgagggcaagctgatacatttgaaaaatagctgtgatgttgcaggttgaaggtccatctcacaagttagttggaattcctttgggaccaaattctactctcagacaccattagttagcagtaagtcatgcatctgatttgtgctttttgtccaagatgatatactgggattttatgtgttattgattatactgcataactcattaaattctctccttggtaatgtcaacaatttttaaaatttcaaacttataagcatatactgaaattggctttatcatagtttctcaaatttggtgattgtccaatgtgttcatggtgaaattagtataattgtgctaaccactcaatattggacaaccatgctcaaacacgtcttaaaaattatggtgttccagcacttttggaggtgaggtgggtggatcacctgaggttgggcacagtggcaggtgcctgtaaccccagctactcgggatgctgaggcaggagaatcccttgaacccaggaggcagaggttgcagtgagtcaagattgtgccattgcactccagcctggacaacaagagcaaatctccatctcaaaagaaaaaaaaattataatgtttacttttttgatatgctataaaaatatcagtgtcagtaattgcagaaacattgtttaatagcactaatggcgtgaccattcagctccttgtctgccttcagttcctaaatttgctccttccaggagttgtaggtttctgtctgggtcataattagccaaatcccatgttgctgagataataagaccaatacacttgatgaaataccattatgttttcattttagatcaggtttctatcagcagttagtgtttgagtaagatatttgcatcctcaagaagcatagtttggaagacactggtacgtgggataaatgccacgtgaacaaatgaggaaagtgctgttaggtttaaagagaatgaaaaataacttttagctggggtaatcttgtcttcccatcaagatttcaaagcccttaaaagcatgagcactattttatacattatgtgttgtcactgatgtaaatacaaaaatgcaaaatagtctctgccagctgcactattttatatagtctttgttgagtattacttgacttcactacaaacaacattgatttttaaaaggtgattaaagttgtgttaaaaaggtatagtggaaaggtaatttgagaaaaggttagtaaagaatatgtggaagctctttactttccaagttctaaaaacagtgacctgcaccttaccaactacgtagcaggagaggcagaattctgtaaaggttatagtctttggttctaaagctacaagatataggtttgaattctatttccataccttgattagtcatgtcaacttgggcaagttaccaaacctctctgtgccattgattcctcagtggtaaaatggggccaataatgagacctaccttgtagggttgttgtaagaatttagtgaattcagatatgtacaacccttagagcagatcctgcctcataggaaatgctcaacaaatataacttgttgtttttgttattgttatcaccgttctcatctggctctatatttttcttgcagttggttccctggctgctttttacacttatcatctacctcctagcctttgagctaaattcggggcagaaaattcagatggctcagctttcaaactttgtctaataatactccttagaggctgaatttgggggaaaatgtaatctattggctgaaatcagttagttgggttatctgtggttttcaagaataatggtgaactcacatatactgaagcgatccatttaatagtgtcagtgaaataatctatcttaaatattttttagagaatagatagcaacttgcctgaaagttatatattaagaataccttcctcatcacatcaatatatactgtccttttggaaacagactttcctgcaagtcagaatcttaaacagtttggaagagagttttagaaatgtgcaaatgaacttgaaacccacatttgtatagcttgttttatttcagtgcttgagtagtcttttcggtggtctttatcttttattatcccctttcttctttatcaagtaagaaaagggtaggtcattcaaccatgcagaacatatagctgataggaaaacatattcagtttcatattttaaataggtaaatattatgtcaacctctgattgagctaatctaagcaagaaaaataattcagaatcaaacacataatatacagttatagcttactctgcaatgtggatttaaacctacaaagtaacttttagcttacctccattcaagttttagtggccccagactcatataagtatgaatatttatgctaacctagtaatgccatttgaaggagccaccttgtaggatttgcttccacatgtatactcagattctttctgaaatgttgaaataagttgtatatgtgaaatgcaaatcacttaagtgtttgtcagtgagactatacatttattgtacagaaacagtaactctcatcccaccgaaatggtagagaaagatgccttatttagatgttagtcttgggaaattcataatcatctctcatcagttaaatatactgggattattaaaatatttaaaatatttcttaccatgtccttgaatgttgtggagcagaagtttaatttgtatctataccaaaaaaaaatgtattgctaagatttggctgaaaaacactaacattctgccttaaaagtatgttctgttttctttcaattaataaatattttgagcacctacttttagctcacaaatagagattaatataacaatgttgacgatgatagtatcataaaaggggaaataaaaattgttactaaaatgaatatatattcaaccttgccgataagaaaaagaaagaaatattggttccattttcccttacttaaccaagttgccaaaactttaaacagtccattgctgggcattctcactcactgctaatgggaaagtaaattactgtggcttttctggaaggttgtctggtaatgtaaatcaagaatttgaaagtactcaaaacatttgacccaagaaatctacttctaagattttgcattaagaaaatacctaatgttgcaaacagaactttatatgtaaggatctttgtcataatttatttaatggaaagaaatggaaacaacctaatatcccaagataggggattggttaataaattatggttcagctgtgtattggtgtagaactatgtaattagtcatgaggtatgggtaaactatttaatggcacaggaatgttctgatatgttaatttataatgtagtttataaaatgtatataatatatgctgttaattttgtaataaaaccttaatacacataacccatggaaaaaaaagatcagaaagagcttccagtttccagtctgataaatagtgatcttggaggttgtcattcctgttgtcaaaagaaaaaaaactgaatgaactgaaaatcaacaatagatgcagtaagatgggaaatggaaataaaaggtatacatattgggaaggaaaaaacagtattacctttgttcatagatgacatgtttttctgcatagaaaatcccaagggatcaacaacaatgacaaacacactcctgttactaataagtgattattgcaaggttgaagtatacaaagttaatataaaagtcaattgcttttctgtctaccagcaattaacaagtggaatttgaaataaaaaatacaatattatttatataagcagtcattaaaatgaaacaggtgtaaattcaacaaaatatgtacagtatctatatgatgaaagctataaaattctgatgaaagaaataaaaaactaagtagaatggagagatactccatgtttgtgtttaggaaaactcgatattgtcaagatatcagtttttcccaacttgatgaatagatgcaatacaatatcagtaaaatcccagcaagttattttgtggatgtcaacaaactgactctaaagtgtatatggtaaggcaaaacccagaacagccaacacaatattaaaggagaacaaactcactacccaacttcaagacttactattaagctatggtaatcaaagttatgagatattggcaaagtaatagaaaaatagatcaagggaatgtaatagagagcccagaaatagacccaaataaacatcatcaactgatctttaacaaagtaattcaatggagaaaaaatagtcttttgaataaatgggtgctggaacaactgggcatccatatccaaaatgtaaataaatctagacatagatttcacacccttcaccaacatttactcaaaatggaacacagacatgagtgtcaaatgcaaagctaaagaacccttagaggataatataagagaaaaatttaggtaaccttggatttggcaatgacttgcttttttaacttttagtttaggttcagggatacatgtgcaggtttgttaatacaggcaaatgtgtgtcacggggggttggtgtacagataattttgtccccaaatactaagcatagtactcaataggtattttatctgatcctctctctcctcccaccttcatgcctcgagtaggccctagtgtctgttgttatcctctttttgcccattggttctcattatttagctctcacttataagtcagaacatgcagtatttggttttgtgttcctgcattagtttgctaaggataatggccttcagctccatccatgttcttgcaaaggacatgacctcattcttttttatagccgcatagtattccatggtgtatatgtgcacattttatttatccagtctactgttgatggacatttagattgattctgtcttttgtattgtgaatagtgctgcagtgaacatatgcacacatgtgtctttatggtagagtgatttatattcctttgggtgtatacccaataatgggattgtttggtcaaatggaagttctgtttttaggtctttgaggaatcaccacactgctttccacaatggttgaactattttacatcctctccagcagtgtataaccttcccttttctccataacttgccagcatctgttattttttgactttttagtaatagccattctgatgggtgtgagatgatatctaatggtgagtttgatttgcatttctctaatgatcagtgatactgagcacattttcatgtgcttgttgactacatgcgtgtcttttgaaaagtgtctattcatgtcctttatctgctttttaatgaggttatttgttttttgcttataagtttgtttaagttccttacagattcttgatattagaccttcgtcagatgcatagtttgcaaatattttctcccattctgtaggctatctgtttactctgtggatgctttcttttgctgtgcagaagctctttagtttgattagattccacttgctaatttttatttttgttgcagttgcttctggcatctttgtaatgaaatctttgccagttcctttttctagaatggcatttcctaggttatcttccagggtttttatagttttaggttttacatttaagtctttaacccatcttgagttgactttttgtacatggtttaaggaaggggtctagtttcagtcttctgcatatggcgagccagttatcctaacactacgtattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctctttgatactataatagtggatacatgtcattatatatttgtccaaacccacagaatgtgcaataccaagagtgaaccttaatgtgaattttggactttgagtgataatgatgtgtcagtgtagattcatcagtggaaacaattgtacctctctggcaggggatattgataactggggacactatgcatgtgtggcagtggtaacagggggtatatgggaaatctctgtaccttcctcccaattttactgtaaacataagactgctctaaaaaattaagtattaatttaacatataaaaatacataaatactttaaagtatttatataatactttccctccccccacagtttatgggtacatcaaatttctcttcagcaactgcaagcaaagaaagaaaggagtgaaatatttaagttgttgaaagaaaaaggctaccaatctggaattctgtatttagagaatttatttttcaaaaataaatgataagtaaagactttctcagacaaaaagtgagagaatttgtcaccagtagaccttccttgcaggaacttttaacaaaaattcttcataaaaagggctaccaatctggaattctgtattcagagaatttatctttcaaaaataaatgataaataaagactttctcagacaaaaattgagggaatttgtcaccagtagaccttccttgcaggaactattaacaaaaattcttcataaagaagaaaaatgacataggtcagaaacttggatctacataaagaaaggaagaacattagcaaaataataagtgaagtaaaatatttttctttttcttaattgacataataaaggacagtttgttcaaaataaaaatagcagtgatatcttacatgtctgtagcttatgggaaagtggaatgagtaacaggtgtaataaggaatggaagggagggattgggaaaattctgttagaacatatctgttctacacatgcagtggtatagtgttatctaaaagtaaaagtggacttggattaatgtaaatgtatattgtaaactctagggcagccactaaaaactttcttaaacgaagtataattgatatgctcagagaagagagaaaatggaataatataaaatgttcagttaaaaccagagaagacagaaaaagaaaggaagacaaaaaaaaaagtaacaaaaaaactagggcaatgaatagaaagtcattgcaaatacggtcaatattaaactagcaaatcaatagtcactttaaatgtgaatggtctatataaaccaattaaaagacagagactgtcaggggattaaaaatccccaaaatccaactatgtgttatctataagaaaccactttattttaaaaaatatttctaataagttctattgtgtacatttaaggtatacaacatgatgttatgagatacatataaaaattgtaactgtactgaaacaaattagtatatttattcatcttacatggttatccattttcccccacaagagcagttataatcatattaattgaacaatttgtcccttcaagtcaaattcctcagttgtgatgggtcagattcctcaattgtgaccaaccattgcaggtgaaattcaaattttatttttttagtggttttatttttgagaaaaattttatttcacctctcccaatggatagacatttatttcaagatacactgcatcctcttattgtcaacacttcaaacctaccagctactgacatcttgaaacagcataatttgttatccatgactcctgaaagttcctcatgtcaccaacccttatatgatacaaatgtaaagatggctattcgtggaaatgtgttcaccacattgccaagtgtcttgggtctccttttgaaaagaatgttttttcacaaaagtcaacatttccctgaaaatgcagctccatcttctattggtatggtctgtggaagtcacagagactgaaatttcggtccatattatggttgataactacaatttctgttgcaaagtatgcaagcattactttgaactgcatctgatgcaacttggtggtctaggccattacttgcaaattgccaaggcctattttgggaacaatgctttcaattcccttttattgcatgtatcagaacaatatcctgttaactaatatgatggttcattttactgcatatatgagaagaatgtcctgttaaccaatatattttgacttttggttttagtatgttttagtacaaatatccagggacaaattcttcagttgaatacatccaagagacaatttgttcaattgatctgctataatctaatcatttagcaaaaattctgactacaatacactatcattagctatggttctcatgctgcatattagatctttagacttgttcatcctatatatctgctgcattgtattttttgacctgtatctcccatttccacacccctacaccaatcatagtcaccactgttttattctgtatctctgtgaagttgacctttaaaaaaaaaaagataccacatataagtgggatcatgtgatatttttctttgtgtgtgtggcttatttcacttattgtaatgcataccaaagaatattttcagctatacaaaaggaagagatcctgtcattgccataagatggattgacttggaggacattatgctaaatgaaagaaacctagtttaaatataaagacacagatgggttaaaagtaaaggaatggaacaatatatactgtgctagctctaatcaagagaaagctggagttgttatattaatttcagacaaagaagactttaggacaaggaaaattatccgggaaaaatggggggcattacatattaataaaggggtatattctccaagaaaacataacagtccttaatgtgtttgcacttaacaaagcatcaaaatatgtgaggcaaaaactgatagaaatgcaaggagaaatacaaactattagagctggaggcttctatacccctttattagtaatttatagatccatcaggcagaaaatcagtaaggacatagttcaatttaatcatcagtcaactggatttaactgatgtctgtagaatactccatccaacaacatgagaatatacattcttctcaagatcacatggaacattcgccaaaatagaccatattctgggtcataaaacataccttaggaaacacaaaataatagaaatcatactatacttttttttttttttttttttttgaggcagtctcactgtcgcccagggtggagtgcagtggcgcgatctcggctcactgcaagctccacctcctgggttcacaccattctcctgcctcagcctccctagtagctgggactacaggcgcctgccaccacgcccagctaattttttgtgtttttagtagagacgggatttcaccgtgttagccaggatggtctagatctccttaactcgtgattcgcccgcctcggcctcccaaagtgctgggattacaggcgtgagccaccgtgcccggccctacaatatatacttctacaccatactggaattaaactagaaatcagtaacagaaagctgtacaattccaaactatttagagattaaaaaccacacttctaaatcgcacatgggtcaaagaagaagtctcaagagaaattttaaaatattttgagctaaaagaaaatggaaataccacttatcaaaatttgcaggctgcagcaaatgcagtgcttagaaggaaatatatagcaaggaattaatatattaaaagtggaaagatttaaactgaataatacagactaccaccctgggaagctagaaaaagaagagtaaatcaaatccaaactaatcaatagaaaataaattttaatggctacaaaaatacagttagatagaatgaataagatgtagtatttggtagcaaaatagagtgcttttatggattgtgacattggtcatttctaaactttttgcctaaaccagaatcacaaagatattctcctgtttgttcttttagaagttttaaaaaattaggttttaaagtctataacccatcttgagtttatttttatatatagtatgtgatatggattaaggttcattttagtttatgttttgtatattactatccaaatatttaggcagcatttgttgaaagtactatcccttttccattgaattccctttgcacctttgttgaaaatcaattgaccacatatgtgggtagattttgaatctattttattctgttgatctatttgtctaacatttcgccaacaccacattgtcttgaaaacgtcagtctgttgttgttctttttgcttttgagacagagtcttgctctatcgctcaggctggagtgcagtggcacaatcttggctcactgcaacctccgcctctcaggttcaaacgattctcgtgcctcagcctcctgagtagctatgattacaggcgtgtgccgccatgcctggctaatttttgtatttttagtagaaacagggtttcaccaggttggccaggctagtctcgaactccttgcctcaagcgatttgcctgcctcagcctcccaacgtgctgggattacaggcatgagccaccacacccggccaaaaagtgtaattttatattaagtctctgacatgtttcttttgcaaaattgttttggctattctactttctttgcctttccatataaatttttcattagattaccaatttttataaaagatcatgctggtaattcgatttagattgtatggaatctataaatcatattggagagaactgatatcttaacaattttgtatctttcaatccataaataaagtgtatctctccattttttaggccttcattgattttttcatcagcgttttttagctttctaagcgaagatcttacacatattttgttagatttatacttcagtattttcaagttttgggagagctattgaaaatagtacactttcaatattcaatttctaattgttcattataaaatatataaatatgatttataaattctctatagtaactttttaatatattcttatagattttctatgtagaaaattatgtctatttgtgaatagaaagttttatttttttactttccagcatataggccttttatttgttcttcttacccaatttcactgactaatatctccaggagtagtgaagcagacatccttgtataattcctgatcttaggggtaaagcagtctcttgccattaagtgtaatattagctataggttttttgtagatgccctttatcaggttgaggaagtactcattctagtttgcagagactgtctgtcatgaatggatgtagaattttgtcaaatgatttttctgcatctgtggcaatgattacatgattttccttctttggtttgttgatatggtgaattacattgattggattttgaatgttgaactagccttgaatttccaggataagccccacttgctcataaaagtattatctttctacatattgttagatttagtttgttaaaattttgttgagaatttttgcatctatgttcttaagggatatttgtctgtagtttctgttcttgtaatatctttatctggttttggtatcagtgtaaagcttgcattaaatattcagttgggaagtattccctcctcttcagttttctggaagggtttggtagaatgtttgatagaattcaccggtggagccatctgattctggaattttctttgtaagaaagttttcaactacaatttaaattcctttaaaatatataggactattcaggttagatatcttttttttttttttttgagacagagtcttgctctgttacccaggctggagtgcaatggtgccatctcagctcactgcaacctctacctcccatgttcaagtgattctcctgcctcagcctcccgagtatgggattataggcactcaccaccatgcctggctaatttttgtatttttaatagagacagggttttaccatgtaggccaggctggtcttgaactcctgacctcaggtgatccacccacttcggcctcccaaagtgctgggagtacaggtgtgagccaccacgcccagtctcaggttaattatctctttttgattgagctttggtaatgtgtgtctttcaaagaattaatccattttatgttgtttcaagaattaatcattctatgttgttaaactaactggcatacagttattcacattgttccctttttacccttacccttttaatgtctgtagtcaatgcaatgaaaccctcttttttgtctctagtcttagtagtttttgtcttctctctttttatctataggggtttatcaattttattgatcttcctaaagatccagttttgatctcattggtttttccttattgactttctgtcttcaatttcattgatttctgctctttattattctattttttttcttattttgtcctactttttctagtttaagatattgatttgagacttttctccttttccaatatagatatttagtgatacgaatttccttctaagtgcttttttagctgaatccctaaatgatgtgctgtgttttcatttagtacaaaatactttctaatttcctattgatttcttcttcaacccacagactatttatatgctaccagcttcttaaaagtggttatcttcctgtactgggattatgtataatgtttataaaataacactctatattttatagcactttataatttacaaagtgcttcatttaatcctctaacatccacttgagaaacataatatttcacagatgttgaaaaggttatcagggtttgagtgacttactcaatgtcacacagagtaggttaggactcaaacctagattttctgtctcccagtttattattctgaagaaattgtaaagaaaggtttgaaaaataaattggaattcaccttgtgggtatttggaaagattcatagaggttctttgaagcaatcattgatatgaggcatctctctcagtttagttttaatttagatttctgattactagtgaggttgaacatcttttaatatttattctctggtatcgtttggctatgtctccacccaaatccatcttgaattgtaactcccacaattaccacatgtcgtgggagaaacccggcgggaggtcagttatgggggcgggtctttcttgctctgttctaatgatagtgaatgagtcttacaagatctgatggttttaaaaaagggagtttccctgcacaagctctcttctcttgaatgctgccatgtgagatgtgcctttcaccttccaccatgattgtgagacctccccagccacatagaactataagtccaataaacctctttcttttgtaaattgcccagttgcaggtatgactttatcagcagcatgaaaatggactaatacgttgtctgttccaatttcttcttttctgacttgcctatttctgtacttagattgtttttctattggattggttggtcctaattgatttgcatgattaaaatattccaatactaatattttgtttactatttgttcacaatatcttctcttagcttcatgcttatctgtctttattacttcaattttgatcgtcaggaaaatctgcactggactgaagaaaatttgtgtgtttattataagaggagtattgctttattttgagctagtatgatgaaaagtgggagatagaagaggatgggattagaagataaaccacttgatttggaaattcaatttaccaatcatttgtcagttgcttatgcttgcatattgcctataattgcttattgcccacagtgtactaggccatgtgatgaatagagagtaaagaataaatgttacctactttcagggactctgatggagaaatatatcatgtacaataaggcagttaacatggtatgtgctcaagtgaactgtggtataagataagctgtggctaccaaaatttctgttccagcaaaggagagtgagtggtttgagttagttgggagttgtattagtcagggttctctagagggacagaactaataggatatatgtatacatgaaagggagtttattaaggagaactgactcacacgatcacaaggtgaagtcctgtaataggccgtttgcaagttgaggagcaaagaagccattagtggctcagtctgagccccaaaacctcaaaagtagggaagccaacagtgcagccttcagtatgtgactgaaggcccgagagcccctggcaaaccactggtataagtccaagtgtccaaaagccaaagaacttggagtctgatgttcgagggcaggaagcatccagcatggaagaaatatgaaggccagaagactcagcaagtcagcttcttccaccttcttctacctgctttttctggccttgctggcagcaaattggatggtgcccatccaaattgtgggtaggtcttcctctcccagtctactgactcaaatgttaatctcctctggccacatccaaaaacacccagagacacccagatacacccagataggatacacccagaaggatgctttgcatccttcaatccaatcaagttgacacttaatattaaccatcacaggagttgtttaagcaagaattctgtaagttgaatgggagcagggactttgtataaaaattttagttcttttcgtctgcaacacttagcatattgcctgacagtgctcaaatatttgttaaatgattgagtgatgttaacatgtgtaggcaaagccaatcatagagacctaacacaatgcatcatctatcattcctataccaccaacagctctgagaatgttctgatacatccacatttcagacattagcttgcatttccaaagaaagggaacacaaccttttcaagaaaaagaacacatgatatgctccctttatcattgtaacggagtagtagttaaaattttgtattgctgactatggccttatagtatagtttgaaatcaggtagcgtgatgcttccagatttgttctttttgcttagtcctgctttggctatgcaggctcttttttggttccatatgaattttagaattgttttttctaactctgtgaagaatgactgtggtattttgatggggattgtattgaatttgctgattgcttttgtcagtatggtcattttcacaatattaattctacctgtctatgaacatggggtgtgtttccatgtgtttgtgtcatctatgatgtctctcagcagtgtttttagttttccttgtaaaggtctttctactcctttgttagatgtattcctaagtattttattttattttattttattttattttattttattttattttattttattgcatcctttgtaaaaggggttgagttcttgatttgattctccacttgattgcttttggtgtatagaagagctactgatttgtgtacattaatcttgtatccagaaactttgctgaattcttttatcagttttaggagctttctggaagactccttatggttttcaaggtaaacgatcatattgtcagcaaactgggacagtttgacttcctctttactgatctggatggcctttatttctttctcttgtctgattgctctggctaggacttccattactttgttgaagaggagtggtgagagtgggcatccttgtcttgctccagttctcagagggaatgctttcaacttttccccattcagtattatgttagctgtgagtttgtcatagatggcttttattacattaaggtatgtcctttgtatgccgattttgctgagggttttaatcataaagggatactggattttatcgagtgctttttctgcatctattgagatgatcatgtgatttttgtttttaattctgtttatgtggtgtaccacatttattgacttacatatgttaaaccatccttgcatccctggtatgaaacctacttgatcgtggtggattgtctttttgataggttgttggattcagttagatagtattttgttaatgattttagcatctatgttcatcaaagatattggtctgtagtttccttttttggttgtggcctttcctggttttggtgttagggtgatgctggcttcatagaatgaattaaggagggttccttcttgctctgtcttatggagtagtgtcaaaaggattggtaccaattcttctttgaatgtctggcagaattctgctgtgaatccacctggtcctggacttttttttgttggtaatttttaaattaccatttcaatctctctgcttgttattggtttgttcagggtatctaattcttcttgatttaagctaggagggttgtatttttccaggaatttatccatctcttctaggtttcctagtttatgtgtgtaaaggtgttcatagtagtcttgaatgatctttcgtatttcagtatttgaagatactcctgttttgtttctcagtgaggttatttgaattttctctcttttcttggttaatcttgctaatggtctatcgattttatttatcttttcaaagaaccagctttttgtttcacttatcttttgtgtcttttttttgtttcaatttcatttagttctactctgatcttggttatttcctttcttctgctgggtttgggtttggtttgttcttgtttctctagttccttgaggtgtgaccttagattgtctatttgtgctctttcagacttttcgatgtaggtgtttagggttatgcactttcctcttagcactgccttagccttatcccagagattttgataaggttctgtcattattatcattcagtttgaagaatttttaaatttctatcttgattttgtttttcacccaatgctcattcgggagcaggttatttaatttccatttatttgtgtggttttgaaggttccttttggagttgatttccagttttattccactgtggtctgagagagtgcttgatacaatttcgattttcttaaatttattgaggcttgttttatgacctatcatatggtctattttgcagaaagttccatgctctgttgaatagaatgtgtattctgtggttgttggatgaaatattctatatatatcttgtaagtccatttgttccaaggtatagtttaaatccattgtttctttgttgactttgtgtcttgatgatctgtctagtgctgtcagtggaatattgaagtcccctactattactgtgttgctgtctatttcatttcttaggtctgttagtaattgttttataaatttgggatcatggtactggtataaaaataggcatatagaccaatggaacagaatagagaacccagaaataaacccaaatacttacagccaactgatcttcagcaaagcaaacaaaaacataaatgtgggggtccttttcaacaaatagtgctgggataactggcaagccacatgtaagagaatgaaactggatcctcgtctctcaccttatacaaaaatcaactcaagatggattaaggacttaaacctaagacctgaaactataaaaactctagaagataacattggaaaaacccttctagacatttactggggaaacatgccaccaatatttcaacgtaggttctttctattttccataaatgtcaaccggctaagaaataaagagaaagagtacaaagagaggaattttacagctgggccgctgggggtgaaatcacatatcggtaggatggtgatgcccacctgagccacaaaaccagcaagttttattaaggatttcaaaaggggagggggtgcaagaacagggagtaggtcacaagatcacatgcttcaaaggacaaaaaagagaacaaagatcacatgcttctgaggaaacaggacaagggcaaaatcagaaactcctgataagggtccaacaaagatcacaactcaaagggcaaaagcagaattactgataagggtctatgttcagcggtgcacttattgtcttgataaacatcttaaacaacagaaaacagggttcgagagcagagaaccagtgtgacctcaaatttcccagagcggggtttttccccaccctagtaagcctgagggtactgcaggagaccagggtgcatttcagtccttatctcaaccacataagacagacactcccagagcagccatttatagacctccccccaggaatgcattcctttcccagagtaatccttgctaggaaaataatttagagatatcttccctacttgcatgtccatttataggctctctgcaagaagaaaaatatggctctttttgcctgaccctacaggcagtcagacattatggtcgtcttcccttgttccctaaaattgctgttattctgttctttttcaagatgcactgatttcatattgttcaaacccacatgttttacagtcaatttgtacagttaacacaattatcatagtggcactgaggtgatgtacatccttagcttacgaagataacaggattaagagatcaaagtaagacaagtgtaagaaattatgaaagtattgtttgggaactggttaatgtccatgaaatcttcacaatttatgttcctctgccacggctccagccagtccctctgttcggggtccctgacttcccgcaacagacattggcttagacaaggatttcatgaccaaaaacccaaaagcaaatgcaataaaaacaaagataaatagctgtgacctaattaaactaaagagcttttgcatggcaaaaggaacagtcaacagagtaaacaaacaacccacagagtgggagaaaatcttcacaatctatacatctgacaaaggactaatatccagaatttacaatgaacaaatcagtaagaaaaaaaaatcctatcaaaaagtgggccaaggacatgaatagacaattctcaaaagaagatatacaaatgcccaacaaacatatgaaaaaatgatcaacatcactaaagatcagggaaatgcaaatcaaaaccagaatgcaataccaccttactccttcaagaatgaccataatcaaatgcaataccaccatactccttcaagaatgaccataatcaaaaaacgaaaaaacagtagatgttggtgtggatgcagggaatgtaaactagtacatccgctatggaaaacagtgtggagattccttaaataattaaaagtagaactaccatttgatccagaaatcccagtgttgggtatctatgcagaggaaaagaagtcattattcgaaaaagatacttgcacacgcatgtttatagcagcacaatgcacaattgcataattgtagaaccaacccaaatgcccatcaatcaatgagtggataaagaaacatatagataaatagatagatagatagagagacagagacagagagtcagtatgtgtgtgtatatatatatatatatatatgtttctattgattatatatatgtgtgtatatatatatgtgtgtgtgtatatatatgaatactactcagccacaaaaaggaatgaattaacagcatttgcaatgacctagatgagattggagactattattctaagtgaagtaactcagaaatggaaaccgaacatcgtatgatctcactgatatgtgggagctaagctatgaggatgtaaaggcataagaatgatacagtggactttgggcacttggggggaagagtgggagggggacaagagataaaagacaacaaatatggtgcagtgtatactgctagggtgatggatgcaccagggtctcacaaatcaccactaaagaacttactcatgtaaccaaataccacctgtaccccaataacttatggaaaaataaaattaaatttaaaaagattttgtacatcattgtcagacaaacctgggtttgagttccatctcagcttcttactggttatatgactcttgattttccttatctataaaatgagactaataataatatctaccttatgggtcattgtggtgaggatccagtgagcaaagtatgtataacactaatcccctaataggaattctataaatacttgctatgccacttctcttgatgtataataaaatggatggaacttgtgattgcttttgaattttgtgacttggttgatgtttcctaacaggcatattctccatctccttcttcacagattcagagacatattgcatgtttcaagacaagaagtacagagtgggtgagagatggcatccttacctggaaccttatgggttggtttactgcgtgaactgcatctgctcagaggtacaatctctcatgacatgtgatttcccagtttgctcctcagcatgccgagaggctttcagtgcccaaatggccagggaccatggatgataaaatccttaaagaaagtaaagaagcagaccgatcgcactgtctcacgcctataatcccagcactttgtgaggctgaggcatgtggatcacttcagcccgggagttctagaccagcatgggtaacatggcaaaaccccatctctacaaaaagtacaaaaattagctgggcatggtggcacatgcctgttgtctcagctagttgggaggctgaggtgggaggatcacttgagctggggacttctaggctgaagtgaaccgagattataccactgcactccagcatggttgacagaacaagaccctatctcataaaataaaagaagaaagtaagaagacgattgcaagaaaaataaacattttctgtcttctgtcctctcttgctttttggcttgattttcatgggttctctgaatatttactatggacagatatttatgatctcttagcctaatgatatagggcatggttagagaaggcagaagagcctgatagtgggagtggaggcaaaagctcaatagaatgtttagattgtaagacaaagtagtttttgaaaattattttaaggctgacctttagggagaatattaggacaaattataaactggttcattgggagagtggattctatgttgtctcagccaataactgtaattaagactgagtttgtgaaacgttggcctgtacctcttaaggattagagctcccttggcttagccttggctcttgtccagtcatttagaaaggattttggttggcataaatgccatctttgcaatagataaagcaggttgttccatcttcttcccatggtcttgacccaggagcacagctgtggtccatctttctcaacaaacctctgccattatatgttaggctagagtttcttgtttgcactatagatatttgtttgggggctgtcctgcgcattgtgggatgttaagcagtatccctggcctctacccattagacaacaagagcaccaaccccaatcctaataaccaaaaatgtctccagacatggccaagttgcctggggagcaaaaatcacccctggtagagaagtggtgcactaggctaattggaaagggaggccttgtactaggcattgagaattctgaacttacacaaagaattttcaagaccagcttcttacctgagaccttttgtaaggactgcacctcttccctcatgcccagctagagcaggaacaatcacttgcaagcctgatccatttaccatttgaacataattttgggctgtcagaattttgagcatgtggaaacataattatcaggtaacatcaggcagtattaagaggctatgaggttctagaataaagacagaccaagtttccagccctgcctctgccacttatgagccactggacaagttacctgacctctgtgatattcattcatcttcctctttttataaatgggataatgatattaccatttcatatggttctgataaggattaaatttacaaatccatttaaatcatttaaaacaatacttagtcttggtaaacattcaagaaatgttaacagctgttattgtcatcattgttgtccttatcattgtggttatcatcatcatcgttattattattaatctattagctctagaacagaattcagtatatagcattaatgaggattcactttagacctcagctgggaggtgtggtttctgatgtgcttcagtgatctcaattcaagattataccacctgcctctgaggagtgtgatacctgaggagcttctgtggtgttgccaaatgcaacactccaaaaaaaattattctagaaagtacacaagaaaaggaaaaggttgggataaggcaattccaatttggataaaagaagcccgcctctttaaatggttagggcatgtattaaatagatcatttggggattgattaactgcctgggatggcctgattttgtcggattcttgacgcgacacatttcgacacgttggagatggacagctaaccattgggagctgaggctttgatgtctgcaacgcagtcaaaatgttaaaatgatcccaatgccaacagctcaagcacaaggcattttctatttctatatcctcttcactactttcttcccccacaacagcctgacaaatacaagtagcccttgctgcaaatgatttatggatggaaaatgtaaatgaaaaatttatttccagactatgtctttgttctagaaatggttgtgagctgtcagagcgaggggtcttgtaattgtaaatcaggcagggacccagtcgccccacccaggcatactacctaatcagctaaattccaaactctagctcgtcctcagaagaattttggctaaaaaggaaatgagaagaatcacttggcccactgggccaaggcagatttatatggaatccaggatccacctgctagggatgcctccttgcccagggctgggtagcagctcaggggacccattgctcattgtgtctttcatgttattggacaggtgattatgaaatcagagtaggttcttggaaaagacatgcagctagagctggggaatggtagaaatgccatggagccaggccagaagaagcctcccacaattaatgggaagctttgaaaattggaggagtggtgatctcagccttagaaaaatatgccaataaactatcaaccaacccagcagaggtgctggtgatgagaaaaggaaagaaaatgttgaatgcattcagcttcttgggaatgcattattcactgcctgggtgagtccctgcatgactgtttcccaaactggcttgatcccagcgacctttgaaagacatttattttttctcattgccttctctttttcagaatgggaatgtgctttgcagccgagtcagatgtccaaatgttcattgcctttctcctgtgcatattcctcatctgtgctgccctcgctgcccaggtaaagcaatttgtctctttctttcctagctgtggttctccatttccctcttcacccaactcaactcatctccataattccccagaagggaaacttccagacagataacaataggaacctttaggcagtccaaactggcctctaaatactttttatagcccaaatggggtacattctaggctctaataagttattgggtacccagtaacagatttttattgggcttttaatcatttgaaggtgggtgtcaatcggagatggaaattgtggcccagagattttctgctataagcagcctcttcctgccatgggcagcaggcaccaggagagttgcagcatggcggcatgtgtcttatacaattagtgctggaattgcatccgagcatagcttctaaattatgagggggccattcataaatcaaaggagctgacccagtgaggtttatgacagtataaagctgcctgcctgctgaatagtcacctcctccagactgcagttattatgtacacattgttaagtgtaattctaaggggcagccaggcagagaatttttcacacaactgttaggacatctactttcacgatttgcagctacggtatttgtctgaggcaggggctccctcaatgacactttgttcatgtctgactggggcccgattcccaccccaaaagcgtgtggagtgattcagagaatgcctgtgggcccagtggcaatcctagaaaaagctacttgacactcttgggctttgtgaagtagaagccttatcatcctgtaagttgattccatttccctttagggtagaaattcttgaactagggttcctggatgggcttttgagggtcagagaaccctttaaaattgcttgcagtttttggtgtaactatgtatatttgtaaattcctttagagaacatccgcagctttattgtcagtcccaaaggggtgtacaggaagaaccactaccccagctaaggtatagacggtgctttttaagtggtgaggaacttccagaacttataagagagaaaccaaatgtatccaggcaaaaatgttaggaataaggctgggaatggggttcaatgaaaacccagtcaactgaaatgttccaagagtggagaatttttttttaatggagaagaaacacccaaactctttttgtcactacctttataaaatatattttcctgcatcagtaaatacaccctaatgaacacaggtgattcatttccagatggcagaatatcatgccatatcacaggtttttaaattctgagtgttggtgctgatagtatatgctttgagatgtcagagattgacttggcatatgaccaacctaaaagttgttgggttttttttggaataagtccctaagccaggcttactgtttctgtatgtgtttatttgcttcttcttcctaaactggattgcaagaatgtggtatgggtgggggtgggggcgctctggtaaatgggaacaatgtttctgataaagttgccactctggagagcttctttgttttttttttttttgtttttttgttttttgttttttgtttttgttttttggttaacctgccaggtagcctgtcagacagccttataaaagctttttattcctcagaagtctccaaaagtggtctaatgtcataggaacttatctaaacttctgtgtaaagattgttcttccctgggaagaaggttgaggcatgacccagacccagagcatggggcaaaacaacatagaatagaatatggctgcacctaccccagctgcctaacaggaagcaagtattgagaaaaagggaaagtataagctagcagttattttgagagaaaaataaagtgttaaaagaactgagctcaaaaattccagaggtgaaagcgttgaaagaaataaacaccattatggttaagacttaaaaagctcattttatggtatggaggatagaaataaactattccttttcttttccttcttgctcttgcagctcacttctccatgagttcatttttcttcttgttaactataacctttaacagctctttctgtgggtagtagttctaaaattccttagtccttatatacaaaaaagtgtatttattttacaaccattcttgaatgataatttggctgggtatgaaattataggtgcatgttcatctcccctcagcactttgaagatattactaaatggtttgttggctttatgtttgtttatttgtttgtggttaagaattctgctatttgtagttcttttgcgggttcttcgttttttttttcttctagcttttaaaactttcttcttttcattgatgcacacaatgagatgtgtaagtttgattattctcttcagcctgctcagcacatgattttttcagccaaaggagtcaaatttctcttcaatttttagtcagttttttttttgaaaattatctcttcaccttcttattttttctcattctcaaaattgtctttggtgtatattattgcatctcatttaatttatcctttatgtctcctaatgtctcctttatttttccctcctgatattctccctaaaatgatatattacttcaactctgttctccaattcatgaattctttccatgcatactatttaggccatgtgttgggttttgtttgtttctttgtttattttcaataaccttgtttcccctcaggttttcaagttatttaaaaagacatctacatgatgctaatttataacctgttattgttttggggaatcttattctcttttttacttctttaaagtatttaaaagtttatttgaagtccatttcagattgttcaaatatctaaatatttttagatgtgaattgtcacctttgttgggtttcttgacagcttttcttagttctgaattttccttggttttctactttttctttcaaagctcattatccatgggtgttttgggtttgttttgtttgtttgtttttgtttttgttttttcttacatgagcccttctttgtgggatggttgttgcaggctttatagttcactttgctctaaaccaggtcatatattaatgactcggtttgggctgcctcatgcctgaatggtctatttctacctctgttttcttgtgcactactagtctctgataatgatcatggactgatctacaactgcctcatctacaactgcctaacttggacaatcagtgttttttagggaacactgagtggggagagctatgtcagcccctgtttacatgcgagtagtgtgaccctagtccccaacttcacatgggaagccacttgcaagctgtagtttctcctcagccatttggatccaaactatccatattcagtcccagctgctgatggaccatatggctttggctcccatttattgctgtactttccttctatattttattccacgaagagtttttttgtgtttctgaatataattttgcagttttcacgttttatttatttatttttctagttccacatttcatctctctttgttttgaaaataacagggagatttctcatgtgttctctttgccatattgaaccagaatgcaaccagctattctttctttctactgaagataaaacaagagtaaatagctttaaatcatagcagagaggagtggagcttgacaaaaggaagaactttgaacaccgtggctgttaaatcctagaataaatgactaaggataattttagtctctttacttaatatttctagaaataaaaaggtacccacccatctgagatagagttggcacagtcctgctttgagacagggcaatggatgtgatgactcctctgtgttccttccaccccagtgattattaggcatgaggaaactcatgccttcagggccacagaaatgtttggtcaaagaaaagggctctggttttccatcttaacccaatggaaggcactgtgatgaaaatgtcctcatttaagaagaaaatatttaaagccaagatgatgaataagctccgtataaaaagacgacaaataagcaaactgtataccccagatactggctttacatactgtcctatagcagtattgatttagagaagcttttgcctaggtggtaacagactcagtggaagtgtcctacctatcatgcttagagcttagtttccattgaaggagacagaggagccatctcatttcatttgtttatgtatttcccatggctcttgctttctaaactcgttacccctaaaatttccaaggagcccacctgtatttgaaattgtctcctacagctcctgctaaaccgtggaaatcagagtatgcaggcagctcttccagaaataccagagagaaatctatactgattcccacaaagagcaaataaattttttttcatcagcacttgtccaagtcttggcagaggtcaagtcttagtcacataccacagtgctctactgggcccaaagaggctacatggaggctggaacattcttaatggaaaagtcaagactgcataggactcatgaacgtcattaaattcatcctggtctctaagcaagactctgtggagtccctgataattaagagattttagtgatttgaaggaattaaattccctatcttctcttttgggggaatgaagtggtaatgctggaagggaaagtaaaacaacatgacttattttcataatatgtgtatgtatatatttcataatatatatattttattttatatatatgcacagagagagaattttatcacaaaaagaagaattttatagtgatcaggagtctaaatcatgatattatctaagagggctttttaaaatggtcattccactgagaatttgctattcagaattaataaatttgggttttcctggaggtattccagcattcctgggttattaaagagctcttataaaattgccaaaataactgatttgatctggttaacagagacctaatccacagtgtttccttttggctaggtgtgaaaaagtttggcactatgaatggttttaataggaatagtgacagtgtggtttgccaagagagacaccccagtcttagatattcaaggtaggttagggaaaagaccttaccagtgttgcactatagtatgtgttcccataaggagaatgtgggaagccctgtgtcatttctctttcaacaatagttgggttgtgagtgagctagcaaacacaggcatttctgccacaatacaatatgcacatatctgaaaatcctcacattctacaaaattgtacactgaaaaatcacagggcttaaggaaaaagtagcattagagaaaaccactcaaaacttaggcaactttgtaaccagaatattaacaaagcaactatactaatgaaatactaacacagtttaaaaaggcatcttacatttctaataaaatattacagtaaatatagacttctagacttcaccttttaaaatggtaacattagcttgaaggaacagtgtttaaggaaggattgaagctgctaagttatagagacaacagtaaattgcacaaagatcacggagaatcatgtaataagcacttacaagacagagcatgtggcccaactgaggcaagaggaagaatgtagggcaaatggcttcctgatttcagttgagttagtgtacttggcttttagctgctgtcacttggtagtgcaaaatattaatttgctgggtaatcatgtatgaactaatgcaatttctattttataccaacttcattcccttatttagcactcacatatgaaccacttgtgttacacaaatccacactatagcacagactgtgtaagatgaggtgggtacatggcatttgactgtagacaagtttagagtaagagttgaaaatcacttgtttactctgaatctgcttttttttgtctttaatcactgacctatctgcccttgtgttccccttttctcccatcccatgtatttatattaaaaaggagtctagagtctaggtctatgactatgtctgtctatatctgtgacttccacagttacagtaatcaagtagacaggccttttgtgtttcctccagtttttttctagggaaggttcaaaagagagatttatttatttattattgtggtaaaagatgcataacataaaatgtatcattttagtgtataattcagtggcattaagaacatttacaatattgtacaagtggtaagaacatttaccactaatctagtttctgaaatttttcaccaccccaaaaggaaacctattacacagtcactctccattccccttttcccctagcccctggtaaccatgaatctacttctctatggatttgcctattctggacatttcacataagtggaatcatacaatttgtggccttttgcatctagtttcattcacttagcatagtgttttcaaggttcacccatgttgtagcatgtatcagtatgacatttctttttagggctgaataatcttccattattatgcatagaccactttcgttatccattcatctgttggtagtcatttgggttgtttccaccttttggccattgtgaataacgctgctacggacatttatatacaagtttttgtgtggcatatgttttcaattattttgtatatacctaggagtggaaattctgggtcttatggtaattttatttttaatttattgaggaatctctcttaaattttaaggttgccccatcttcttttagttcatttctttgagtacctactgccagccatcctcatggttgctgctgatttgctgcttttgccaccatccatatctgatctccattgctctcttctctcttctattctcttctgaattctatattcgtttgtctcttggattttatcaaaacagatcaattcctttttaacagtaacagccaattagcatattgttttccctagtaaggtgactacaatagctgtagtgtgcaagatgatcaaccaggagccactcctttgcctgcaaaagattggtatatatattacacataataattacatatatatatatatgggtccagagttatccaaaagcctgaggattctgaaatgttggtgtctgaatagcagatattttgctttattattattattactattttaggttacagaggggctgccaaaggagatgttcacttttgatcactagaccctccatgtccatactgactgttctcttagacccctttaaccatcttccatgccttatttccactatttttctcatactgttggtccttggacacttgacacagtacaaggggttaaaaccttcttcaagaaagtagcatttgctgggtgcactggctcacgcctgtaatcccagcactttgggaggccgaggcaggcagatcacgaagtcaagagattgagaccatcctggtcaacatggtgaaactctgtctctatttaaaatacaaaaaaattagctgggtgtggtggtgcatgcctgtagtcccagctactcagaaggctgaggcaggaggatcgcttgaacccaggaggtggaggttgcagtgagacaagatcgtgcctacccttcccagcctctagtaaccactattctactttctgtttctatgagatcaacttttttagcttccacatatgagtgagaacacacggtgtttatcttactgttcctgacttattttgcttaacttagtattttcaagtctcattcatgttgctgtgaatgacaggatttctttattttttatggctgaataatactccattgtgtatatataccacattttctttatccattcttccgttgatggaaacttacgttgattccatatcttgctgttgtgtgtggtcctgcgataaacatagggatgtagctatccctttaatacactgatttccctttttttggatatatacccagtagtaggattgctggatcatatagtagttttatttgtagcttttttaagaagcctccatactgttttccatagtagctgtactgatttacattcccaccaacagcatatgagttcccttttctccacatcctcactagaatctattacattttgtctttttgaacataaccattctaactgggctgagatgatacctcattgtggctttgatttgtatttttctgatgattagtgatgttgagcatttttatatacttgttgtctatttatatgacagagccttgatacattagtacccattatgaatctaccagagaggtatatgggatgtaacattgtctaaatttattcagccataatacccattttttggaggcactttgcagaattagggttctttgttatgtgcttcaagaagtgttgtattttgccattcaatttctaggagcaatgtatgttatagcaataagctattggtatatacagtatcttagtttggagaagtttgttagggtagtaggcaattttagcacaagaccctaaactagtactactcaaattttaacatgcttaaggatcaccttgggagatttgataaaatgcagactcccagaccctacaccaaaaatcctgaatcatttaggctgcagtgggtgtcatgcatttcacacaagcatcccagttaattctgatgcagtcggattgaggactgcactacagtaatagggcccaggggagattttgagaaaggaggtcaagagaactgcccacagaaagccgttctgggtaagatcttgcagcagtgggatctccagagggctgtgggcaacatgacaacattgtttcgctgataatggagcacatagacactctggaaacacattttccttgtgtgacatttccccaggactaaccctgcagtaacatgtgcacaatgtgccatctggcctgcccctctgctttcccagagctcccacccaaaggctgcctcttctgccatcttccacattcagagtccttggctgtcatgtccagaaagcaagaccctccgtggggagcttccccctctaccccgcccattgttcatgacttgttgttggcgagaaatgaatggcatttctcggaattagcccaggaatttctgctgataaacaaatgaaactctcaaagggaaaagcaatcaacatagtttgaaataaaatcagtgttttcagcttagtctgtttttaacttagtttgaaataagagtcacatctagggtattttaaggaaaggattagcaaaatgtcctgtagtgggcttttcatctgagttgccagactgacccttgaaccagggcctgttttcttcttgagtaagcagaagaggcaattattaccttgatttcctgtgacctgtgattctgagacctgtccagccatcggatcagctttgcccaagcccacccccacttccctgccaagttgcctgacacctgaaattgtcattacagcttaatcttttaaatttaggccttgtcctgataaattcaccaatctttgaaggtagtaaattaactcttattaatcatttttactttcgtctgaacacaggatttagaaagcagattttgattgtagaaagaggagacaggtgttgcggggggaagatcccgaggccactaagctcagctgggcacctgaagagttacaaagggagaggggcctgttgaaggaagggcctaaggagtcaagctttacctaccccaaagtcctgcagaacaccagtagtatttaggataagttctttatttgtagcagaggacacagtggtttctagaatgagttgccagctctcaagtttttcactttagtgttgttaatttaaaaccaatatgttctcaaagtaaccagatatccttgctatctgttgcctagagccaaagagttttacttcagggttttggacttaaaatgactgtaacccaaaaggtttgccagattatttgcagccactaagataagcaattgtctttattagaatgatttttgtctgatttttgtgtttagaattttataccatcagctattccctaaaagtgattttaggaactggcagacttagggtgtcagttattgaaatctgttccaaaatccgcctcctcacaggactccatttttggccatcaaagtagtctattttataaatgtcttgatgtgttgtcttttgtctttgccacatatactctaagacacagagactgggaagtggttcagcaaatatatgtatggctacttacaaagtgttttctagagttatgctcccagaattggagataggctaagaaatatatgtactgtatctctcagtaaagggctaaatcaaagctgtctgcaggagggggaggaagagggctgcttggattttagtttaattgagaagacagagaaatacgtcaaacttgggagttgaggttattttttggaacatgaagataatgtaagtgtccccacaagctctttttcttttcttcaataaattcatcctgttttgatttcttcacattcacaagattgtgccctcagggatctaaggccaaatcagagtccacactcactatcataccttttatataatatattcttttattattttaatagagaaatggatattgagaaggagaggacaaggaaatgtggcatgctttcttccttgttttctttctttgtttcccttctttccttccctcattccttcctttttattttcattctcttttttgtttaatttgtgattattttcttgtgctaaaaatccataacataaaatttaccattttaaccatttttatgtgtacagttcagtaacattaagtgcattcacactgttgcacaaccatctccaccatccatctccagaacattttcatctccccaaactgaatctctatacccattaaacactaactcctcactttctacttcctgtctctatgaatttgactactctcagtacctcatatgaatggcattatgccgtatttatccttttgtgatgggctttttttgcttagcataatgtctttaaggttcatccaggatgtagtgtgtctctttttcaaatggggaagagagagaagaaatttgagaagaggctggtggtagaaatgaggaagtgaagtcaggagacaaccaaagagtcttagaggaatctagcaaatgttgcttttcagaacacattttttctggaagactccagagaccacactgtctttgaaaatgacaggcctgacaagcagtaactagtattactgcctgtgtgaaatgctaggttttgaaagacgtgttccttattaatgttccccagggaacttcagagagtgtcatctattaggagctgattactggcaagttttgtcatctgcttttggagaaatccataggaatagaacagtacccctgtttctctttatctggagaagtacttttccaaaagggcctcttctgcgattgctttctgagggaaattgtgtctggagccattcaacatagctttattagaaagattattaaaggattagagtatgaaacctatgaggtgatgttgaaggaaaactgtaattactgaaactggtgaaagaaagacaggggccttcaccaagtttcagaaacataaatgggtcttagaggaggctgatcagctttctccttccacttccaaagggggagaaagagtagaagtgagcttcagtataaaaaacttaggcacaaaaaagtagttccaggcatagataagggaagctgaagtcattttacagtcaatatattatattaatagctcaggctcaatgctgagtaaacacaagacacacataaatgcacaaacgcatacaatatgattccattaatatcaagttcaaaatagggaaaagtaaactatattgattatggatgtgcataaatgtgataaaactacaatggaaagtgaagaaatgattatcacaatagtcagcatggtggtgagttgacctccattggggggtggtgcttctggggtgttggcaatgcactctttcttgatccacgtggtagtcacatgggtgtttgctttgaaagcatcagtacaactctacatttatgttgtacgtatgtaagttatatttcccagtataatataaagtgggattacattttcatttgttcttgatggttctgattggaggcaaaagtaccagaagaccttgcaagattacaaccaagcataggattctgtatgtgcatatggcaatttgggggactgttatatttgtctacttgtttgcattgttttggtcttcttgatgtttggttttgtgtgtgtgtgtgtgtgtgtgtgtgttttgttttgatttttttttttttggtttttggtttttgggtctttttgtcacaaagaatagcagtaccaaaacctagagaaaggtgtgctccttgtcctctaagtgggctcttggaattagtaagtaggcatttgaggcattgatttctaagctgtagagtgcacagtgtattggcatctggatgaagccatctggctccaggattttatcactgaccagagggccagagggcatgtttggcttccaggaagtcaggctggtcaggaacccctttgggaaggaagaagggctttggacctgtggagtatgcctgccttccctcaaagtgaggttttattgtgttatcatggggggaggaaggcagggggggccaataaagagatggggcctcgctctgctgtccttccagttcactgtgggacattcacagagctgattaacctctttgtacctattttctcagcttgtaaaatgagatgataattcctgccttctcttaaagtttgcattgacagtgaacaagaaagttgatatgggaaattgctttgaaaagtataaggaggtatatataatcaaggcagtgatcagcaatgaaaagaaggtatttaaatcctgggtccccagatttcatctgggcatatctcaatatgggcaaagcctgaaaccatagcattttggtacgtgttcctctagatcccaatgatagcagcctcataaccaggcattgaccatgtgtctccagcctcagggaaaagatgaggggagtctaaaggaaacaagtgacaggtttaatgactgtcaggcaaaaggcattaaattaatggcatcacctctgccttgcctttctatttccttctgattagattttcagaggtgcctgtgtgagtatgccgcacaataatgctgatgttctcaaagctgagtgagctcttaacagaaacataaggtagtgctgagaatgcactcagagacaaggtaaaaatctctagactgccttgagaaattgaaggggatttttctgggggagggctagaactgatacctcctccctcctaaatcataaaaagagagagcaagattcaccattatgtgttgattaggctgccttactcctgtttggttcctaccttctgctaatccgtggtcttgctagaggctgtcatctggcgcctcttgcaggagcacagtgtgtccgtactgcagggggcctctcagaccactgggatcagggaaatgagccattgctgtagtgttacttccaaaccagggaggatcagcacacacacacaccctttctgcccccaccaacttctccagggctttagaaatgtctgggaactgttttgttcgtcacagtaatgggaggatgtcattggcatttagtgggcagcaacaagagatgcaaaatgttccacaataagtaggaacacaacgcatggaagaagtgtcccacacaaaattccagtggtggctctattgagaaatactggacagcagccttagtcagagaagcctagtgaagggcgtctcttcctaaccagaagttggtggtatgagtccacacattcattaattcactcactcactcatattaatttcacaaacatttacagagtataagctttgagacatagcccatgtatggtgctgaggtttcagagttcctgcctcgacgagttcacaatctagtggaggagacacgcataacaagattattaaaatgtaatgtgatgagtactctggtagaagtgtggacaagggctgtgcaggcagagaggggagaagataggcactctccaagagccaggaatcaggcacagtcccagaggggagtggacatttgagctgggttctgacagatgaatggcactttgccagatgtagaagagggaggtggggagggcacgtgcagaggcatgtgtgggatccgtgactgcagttgagtatggtctgtgtaggagggaggaggctggaaatgtcagattgatggaggcccagtctcaaaggaccttgtacatcctgtgggtagacattattttgcagagccagcccactgcaaaagtagggaggaggtgcagtttgtctttagtgttcttggatgtctttttgcatcccctttcctctcttgcagtccctcatatcctcatctctctcccagccacttacaaaggcagctgatgagactccttccagcagaaaggtcaatgcttagcttaactgtaagaattcactaaggatagatttctggatgtcaaagggagagtctttgggcagagaacctggaagaactgagcactatggagatagggcagaggagctttgttcagtttacacacacttgatgtaagtgtaagtgtatgtaagcgtgtgggtgagcatgtatgttggagtgggtgacattgtgtggtatgtatgtgtgtgtgtgtgtgtgtgtgtgtgtgtgtgtgaatgagagagagggagaaatgggacaatgatagttcctatctcaaaggactgttgtgaggattaactgaattaaggtatctaaaggagttagcatagtgccctgcccatagtataccctcaataaatgcaaggtattgttggtattattttagaatgcagggccagaattcagtctggagaagggggaacatgcttactaccaagatggagatgaagattttacactaaggcttagtggctacgtctggctagtttcaaatatgtgcctaggacacattctatcactgggataatataatttttcagcatgttggcttatcagaatgtacatgttcccaagtggagccatagcattacactgtatatatttgggtactttctccatctctactcatggaacacatggcaggtagaaagctgttgttttacaaatgacgtggacctgtcttgaggcccagatcagctgatctgtcctcatgtatagcaacataaaatagaagaaccacagcactagggccagagccagggagatgcattagaaaggaattaacttgggaggatctgaattagggaacaaaagtactagccagagaaggaaggaagaagcaaaaagggggaaaaaaatcactaaaaggacaggatacataagatcatccagctgcccccaaactgaacttacaatgttttctgtgttctctttggaagaggagttggcttgtccagaattcaatggaaacttgttgattgacactgaattgggcacaagttcaatgtgagtgcgcctgcagctatttatttgattttttaaaaatgcaccctttgcagtaagactgtttagtttctactggcgccctggggcagtgagtttagattgttaaaatagcagccattaacactctctgtgttatgacactgtccttcctaccccactttagaggaatcaggcatgaggttgtttgacaaaagtttaattctcctctccccaccaaaagaaactgagattcctcctctgagtcagaggcacgtttgcccagccctaaccctgaaaacctccaagtctgcctacccgcctcaccaccatccccacaaacacacacacgtgactctcatgtacatctggaacacacacactttcacatacactctcacaggctcacacccacacccatcccacaagctagaggaaccctagggagcccttgtgcttgtcttgctgttcttttgttttgctttcctgtatttgctttgttttgatttgaaatcagtctttgggattacattggataattttttcatgttattaatagtgctgtgcagggagcatgtaaggacttcctcctcagtcctggccatgcttgcttccccaaatacaatgctgactctcattgatcaatcaaactgatctttgtcagactttgcatacaatacctcatgggcaaatagctcagggagctctaaaagatgcctgaattctgggattatctagattattcatgagtctgcttaaaaggaaattttttaaggcaggactggatagctatggctttcccaaaggccctggggaaaaatcaaaggagcagagacaatgtggaaagtgtggaactgctcagctcccagagcaaggcaataatctgaccaaacactaagcccccacccaaagtcagcattggtcaggctgaacagccatcatgagcacaagcctaggaggcatggaagggaagttctgtgttctctggacatctgtgatacatgttgtctataccagcactgtccaatagaactttttgcaatgatggaaacattctatatctgcactttccaatgtggcagccattagtataggtggctgttgaacatttgaaatgtgactggtgtgagactgagaagctgcattttaaattggatttaatgttaatcggtttaaatatgaatagacatatgtgactagtggttactgtggtgtatggcacagctttatcccattcgctggatacttctgtgcggcagtgaatttaattttgtacctcctctctgttcagtgtcttgcaactacatcataaactttttgagggcaggaatcatatattgtacaactacagaaagttataccttgaaaagatattttttttcagctgcctctccccatatttgacaaatagggagactgcgaaagactctgtaactttcttgaagtgacagcactcattagtaacattacctgagcctggaacccaggtctccttgcctcccggactgtgcttctaccacatctcccttgcagacaagttttcgaaagaggaagagttttcttcctctccactttcttcactgtttatatctgagattcagcccctgatacttggaaataatttggatctcaagtctacatttatctcctcatctgccaaggcacaaaataggctctggacaaatgtctgtggggtgaaaattctctgaggtctttctgttgtctgttatcttctatatttttaaagaaaatctttttctgcctcagtgtgtttgagacaaccattacttatgctgtttcagcccagggagatggggcctctgtagatgtggccctggcctgtgcaggtgctcaggtatacattagagaagcctgtgcaacagcctggcaggctgataaaaaagctgtagcagtttgggacctgggcccctctgtcttctaaattctctagacttgatggtagacaaggatgccatcagacatagcgccctcccttcaccacattttcatagtaacctagaactaaagatgcttcagggaggagtctagggccatatcttactggttactttagaaagtaagagaaaatacccagtagaaactaacctcagaatcacctgctaaaagaaagaataattcaacttgtaggtccaagtaaagtatcctttcatctctcttctcctttctctgttttccaccccaggcctttgccctcaacccagagccaacctatggtaacacagcaatagctgaattgaagcaaaacctgttaacagtcaccaaaggctgagtttcggccaagcagatagctcctccaggcagcccttcaaaagccaggcagaggcaagggggtaaatagcctgtggcctatctgcagtagaatggccagatggtttgctggtgccaccaaatgaaggagtgatctggtactaagatagaaggcttccagggaccctcccagccctaaaaatcttaagcccaagtgtagtcatcagatgccaaggacactggagaaagtctttggagcatgtagaacaccaagccaattggagtgcctgctaggacagcacaggattcctagaattccggccacaccatatacacccccacccccagagggcagccagtggccacagcagaggccttacccagcaggctgagaccctcatcagaccctccaagagcctacttccttacttagggcctgcctgcttgcactgtgctgagttcagggaggtggacaaactgtacctcccactttagcctaagaatctgacttgccatggactctccaggcagtgaatcattttgagcaagcacttaagcaactttccactgagtcattctgaggactgtcaggtttgctaatcctgatatatactgtgtataccctttgttcagatcctatacccatcctgatattggaggagaggggttataaacaacagaactttaaggatgtgctcattagaagtcatttgtattagggttccctttgccctactgactctaacagggcctgaagcactaagagaaatcctgctggtaccaacttttgatttgtgtatgcttttggttacatagctatcaagagtatgtactctttacctggagtggcagtgcacattggatttcttttccagaccctccatggatctgttttcctttggcttcttctagactaggggccagcatttctttttttctgtaaagggccaaatagtatatatgctagcattagcaggccttgaagtctctgctgtagcaactcttgcattgtaatgtgaaagcagtcataggcagtatgtaaataaatgggcatgaatatgttccaataaaactttatttacaaaaacaagttgcaggtcatatctggcctataacccctgttctagacacaataggctaagtcaaattagtagctgagacttagtttcagctgctagagtgcttaagcatatcacattggggaaaaaatcactcttatcctccattcttttggggaagagaggtagaaattgcaggaatattttcatctttcccattttgaatatcaaagcccattcctcatcaaatattacatactccatagtaatcagaattggctaaagtatgatgcagtagcaacctacaaagttcaggacttaaaacaacaaagatttatttcttactcatactacctctttgtcttaggttggtgcctgtcattatcaccaacagactctggctgacagtgccgcaccatcgggaatttagttccagcactatgggaagggaatataacacactgtggtctggctgtttaagacttttggccaggagtgatacagattacttctgctcatctggcattggccagagcaagtcacactaccatgacttgacttctacaggacagggaaatgcaatactaccatgtgcctggaaggaggagaatttgaatattgatggaaagccctaatgacaatcacacactctaagaactccttttcagtttcttcttcatgtcattccttgcctacctttaggttatctggcctagttgtatcttttgtccaaccctacctggccttcctcagacatgctggtcattgacattgatacatgggggagggacaacttagggactaaagcattgggacagtaattattccctaaaatgctgtgtagaccagcatgaacatgaagtcaggcctcagagccaggtcttacatgccgttggatccaagggttgattgccattgggcagcaagcctgagaaaaattggacctcccataactctggttttgatttcactttagtttacttttaatgagaatttgaatcagagaggaagttctaagcatattgactttaggcagtgccttcccttagtgctatggagagcagttatcaagagggaagaggaatatggaatgtgaaaggtagaaagtataggtgatattaatgcagtattatgggctaaagtgaaacatatggcccatgattttagaagaaggaatatatctgcaaagacaaaataattagttgggataagcccattgctctaacaatccccaaatcttagtgactaaagacaatgaatgtgggagtggaggggcctatggagagggagggcttttgctccatgcagtcattcagggacccaggcccctttcactctagtggtctttctttcctctagagtctcacagttcatcactggagcctctggtatgtggtccttagtttagggaaaagaaagcaaggagagttttgcaggacgttttataggtcagtcttctaaggcatgtttatcatttcttcccacattcaattgactggaactcattcacatggctccacctaactgcaggcgagactatggaatgtagtgtagctgggtgccaggagtggaggatggagatgggtttaatgagcacacaacattgtgtattccgctgcatacttgtcttgagcaagggtgattttttgtaggaagggttcagtctgactgagtcttaactgaagtcttcatcaacatactctcaatattgaaatgttttccccttacagagcactgtcggccttggttgaacagaagactagtcctgactgcagaggccttagataaatgcaattttgccagtccttacattttacttcataattcacatggcctctggacagatatgtaagagcacttgcattctcattggtacaggtttgggatatgtatcctggggcaggaacgtgaaatagatgacattcaatggtatcgtgagcaatgatcctaggaaattcattctgaatcctaaactgggcgtaaaccattcttaaaaagtaaaaggaaaccattaaaattggaactacataactaatctttgttccatttttggcctggctaccagggcattcagagtcctttaacacactcacatagaatacatagaataattatgttaatcctattcattgtttttttttttttttgaaggagtctcactctgtcacccaggctggagtgtagtggcgcagtgtcggctcactacaagctccacctcccgggttcacgccattctcctgcctcagcctcccacgtagctgggactacaggcgcccgccaccacgccgagctaattttttgtatttttaggagagatggggtttcaccgtgttagccaggatggtctcgatctcttgaccttgtgatccacccgcctcagcctcccaaagtgctgggattacaggtgtggtatttcttatagctacttctcggttcaggtgttttctattttcaattacttcatgatatatgttgtttgttgagaacaggagaaaaaaataaggcatggcttcttcttgttttatttaggctcggtttgaagactggcatttgtgaaaaagatttttctgtgtctatcgtgacttcctgagcagttggttttatatggtgtagttttggagatgaacttcagctgaaagaaaggctcaactctaagtttgatgtgagccaaaggagtgcatcacctcttcaaggacagctagatctttgctgtctaatctaaagctgttcaccagaatggagaaagcacttttatgttccttttctccctagctatatttcaaacatttagggattagatgatttgtatctattattttttctagtccagagcttcgcaaacactttggggccagataattctttgtcatatcgtctatcctgtgcattgtgggatgtttagcagcttctctgacctctacccactagatgccagagtacccttctcaactcgtgacaaccaaaaatgtctccagacattgccaaatgtcccctggggaaaagttggccccagttgagaactactgtagttgtaaatttttttttaattgggggtagataccctcactttcccagaatcctgttctgtatttgacatttcttgcagagatgggagttggaaacaaaggttatggatgtcagggagctcagttctaagattgcctgcatttatacctccctggggtgtggactcaggccatatggaacaaatatgacatatgtttgtccagtacgggcagtaaaaaggcttctcaatactcattaacctttgagaagctgacttgtttctacagcattattgaaggttctgaataagatgaactcttagaatctgaatcactgggaatcttcctgaagtgcagatgatgtttcagtaggtctggagtgtgggtgtgagattctgcatttctaactagctctcaggtggtattaatgctgctggttcccataccacactttgagtagagggttggtggtctctggagaagaggagctggctaactagacactatttttaggttctgcagaaggaattgttctttccaagattattccattggcccagtaagtagtgaagtaatctgcagttcttaaacattccctccttctcctctcaagaaggtacaacccacagtgatagtctccctgctctctctttcattctctgcagccatttaaggctaatatgaggtaagctagtcaagtacttccttttgattagctaccttatattttttggaccttctgtgtgtccgtgtgtaagagagagagtagtttcctttccagaggaaatagtggggataacttcggaaaagccattacagtgtcagaaataggtggctattttatcctagctggagtttcagataatggaaaatccatctctagaacaatgtagtatagctccacttctgggatcacttctggttggccacttcctagcctttgtttcctcatctataattgtagataatagcaataatcaccttagagggtggacatagggagaaaagaactaatgaatatcaacctgaagccctgagcacagaaccagctcagtgtaagcatgagccagtaaatattagttcctaatcttattggtgtggttattgtcattattggaactgggatcctcagactctttttgcctctaaattgtttgcatatattgtactcctatcagtgacatctttcatcatgtgcagtgattctcaatcagggatgaggtggtatgtggagtttgaaaccactcccaccagacaccatggtctccttgttcctcttttgagggttattggtctaagcaatgactgaatctcatattgtttttccagccttggtaagtccaaagatgataatataccttatttatttgtttgatctctgacccctatcatcacttttcactctaatcactttaatatgagcatctggctgccaaaagaagcccagtttcaaactggaaatttttattaatatttgacatatttttacttttcacacctttctttcctaaggaattgtcaccatcccatggcaatcaatggtggagttctttagaatccagatttcctaacaccttccctttcctttctgtgtattgtgtagtcttaactaaataactctccccacatcaggaattttggtctgggttcttaaagaatttcctaggagaagcaaaatgatactttgtcttttcctctagtagttccatgacatggcagatgagctgcctccttggtcgtcaggaagaggtagactggattttcctaacagcgttcccactgctccagcagcctggagccttgtgtgccaccactttccttgcaccctctgccagtggcctccagggaccactttctgaagccagctgctaacagttttccaaacaaaataatatgtgcattgggggataacttttctcaattaatcttcaagtaccaaatgcctcttttcttcctttatgcctaatgtgatagcaatgggctctttcagtcacctcctgacatatcctgtccccgagctcattatctcttttccagtcatctcagaatagtttttcaaaaatgtaaatctcatcaaatcatttcactacttaaataacttccctggcttctcatcatatacaggaaaaataccaccccctggacttgacttctttgtgtctccaggtgcctgatgtcattgggctgttgttgcaagtggttctggttattagcactatacagtatttcacaggggagcattttctcttgatttatagggcttgctaatgaaagaaaagatactggagatgctatcagccatctaggagtaacgtgttaggtcttagctgaaggttgagtgtgactgaagttgggagtgcggttctggattcagcagataatagtgtccatgagatggcgaatatccagatcctcaaaatatctaggttttgatgtggtgcagggcagtgctttccaaggagtgtttctggggcattcatagttgttacctaggtgaaaaaaagagtctggtggataagtaaagtcagagaaaatgctgagttatcattaaacaggtttctttactatgggacttgtgagatccttttaacatattgaaagggacactgaatgttgaatgtggatcttttcccaactttatttaagcacagaattttgttttcacagagcatcttgtggactagtagtgctctgcagagcagacttgggaaatgctggtgtaggcaatacaaaggaatgcttgactgaactccccactgtctcatccagatgcctcacattgtttctgtaaatgctgcttgagggtaatgactaatttgtccatttcaaagggtcattgaccttcaaaaaaaaatctagttctcaaaggattagaactaaccaagtaatagtagaactcattcttaatttattcagggagaagaggaaggcagtgagtgacaacattaccacataacctgttattaacaatgaggcatcgtgaagaatcattgatttaacattacacctcctggtaattagaggtttttaaaacccatagtacagtagcaaaggaataatacaaatctatcagattcaccatggaagggattctttttgttgggctacataatccaagttcacatgaagatttgaggttgaggaattagcctctgaaaacagagggatttgtgttttatcttccgcaattattagactggattttagtgggcttctctagccctcacgttttgctgctctaggtaaaatgaagagacctaaatttgaatctttgctttggcactaaatagcagtgtccccttggcatctctgggcctcatttccacctgtcaaaagagaaggccatttccagtttcctcttggagatagaaccctaggaggcttatgtaatgagattggaatggtccatgagctgaataatggagctgatgataaagctgttcagtaaagtggaagaagaaattttgacaggaaagaacatagaggttgcctctgaagactggattatgagaaacttccacaagtaagtactctcagcacacagaaagctgaaaacaagtgtgcataaccttagagccacagaatctggacagagttgtttgcagagatctcatactgctgaagtgaaatcctcagcccccctgctttgtatggcaatagagagggtacttcttttgggtcatgaaatcctgagaatctgattgaacccacagacccttttcccagaagaaatcgattctgtaactcacttctgaatcacttttgaaaatcatacttatttctctccagctatctgcccttaaatgaagaatcaccttgcctctagatatgcatatttatatgttaatgaaattaataccagactcttaaaattagcatgtatcactatttgaatatttgttccttcttgccatgctctgttccttttttttttttttttttttttttttgagacagagttttgctcttgttgcccaggctgtgcgatctacagcacaggctgtgcactgcagcagtgcaatctcggctcaatgcaacctccgcctcctgggctcaaccaatgatcctgccttagcctcctgactagctgggattacaggcacctgccactacaccaggctaatttttatatttttagtagagacagggtttcaccatgttggccaggctggtctcgaactcctgacctcaggtgatccacccacctcagcctcccaaagtgctgggattacagtcatgagccactgcgcccagccagcatgctgtgttctaatgctagagccagcaggagatagagaagtagaaggcatagaccctgtctcctttgcacttattgatcacttaaaaagcggcacactttatattaggtgctagatggtaggatgcaaacaggcagaccatgagagttgctgcagaaaatcagagtgtgtttgatgggccctgggggctggatatgagtaagcaaagagtagtctgtgggggcagttggggctagcatgagtcagggcagaattggccaatcagaggtagagcattctttagccaagtggcacatcctcaggggatacatctttgacatgaacttcatgaccctggctgggccatgctgtggtgtgggtccgtacatggaactccagtctttggggtgtgcttactcacaagcagttgactgacactgcaagactagagttgctacctataaggcagcacatcacaagctgaagggacttttctaacttctatgggatgtagtaactctggacactggaccatcaaagcagacaaaattatacatctctttttgccttcaggtagaatgcatttggtaagcagggagataatcataatcagttgactttgttgtatgttgcttctttactccctgaatctttttgaaaaacataatcatttttgttctttataatatatccctgtgaaagagaagcaggtgaaatgattacctctgacacacacatacacatatccacacagaaagttctttagaaactgaagcctagagatgcaaagtgatagcagttccatcacacagcaaacaaatagtacaacttagctaagaatacatgggccctccccctgccccccaaaaaacccccaaatctatgccatttgcaagcactctttgcttcacagagacatggccctttcttgcacactctctcctcaagccatccttcctagccatctgtctgacaagacggcatattcaggcagggtcagctactgactgacagcagctgaaacactgacggaagtgggatgaaaaacagcctgcagatggggtccggatgaggagggggagagctgggattagactaggatgtgagctttcagcgccctcttccactctcttctcgccagctggagcagcagatgactgtttcctctcactcggcaccttcttggttgggacagagtgttgtgtctgtctgtttagctgcagagtgatctgttgaatctgctacaagaatttcctggcctgggacctcactgggggttgggccaagggtagaagtagggaggccactagtcttgttgaaggtgtggtcccacagagtctcctggaagctttcaagcaggaaaatcttccccccatcaccccctcctttagctgagctgtctggctgacccactccatctcccaaagtggatacaccacggctggggacactaggcaaaattatgacttgagattgactccctctacccatttgtgattctccctttctttttaatttacctttctcttcttcaactgcctatcacctacaaaacaccttcatttttttcaggcccgctccgctctgatacccagtctttgtgtttgtattgtataacgtttggaggttattttttttttttggtaacgctttattgaggtatacatacctcatactgaggtttacatactgtaaaattcacccttttatgttgtaaagttggttttagtatatttacaagatgttgcatccatcaccactatctaactccagaatattttcgtcatctctaaaagaatcccatacctactagtagtcactcccattctccccttcccccagctcctggcatccagtgttcttctttctctctctatggatttgcctattttggacatttaatgtaaatggaattatacagtatgtggtgttttgtcactggccttttttttcacttagcagaatttttcaagtttcatccattatagcaataatattacattttatggatataccatattttgttcatccattcatctactgatggacatttgcattgtttccatcttttaactattatgaataatgctgctataaactttcatatacacatatctgtttcagttccttctttcaatttttttgtgtatatacctgggagtggaattggtggcttatattggtaactctatgctcaactttttgagagactgctagattatcttccaaagcagctgtactattattatttttttttacattctcaccagcactgtataagggttccaatttctccacctacttgctaacccttgttattattgtcttttttattatagccatcctagtggatgtgaaatggtatctcattgtaggattccccccaatagcgcctttctctttactggggaatagttccagtcttgtgtattcatcactgtgaagatattaaacctctgggaaagatagggcccttctctaactaatgattgaatctgggggcatatcaggcattctggcagggtggagaggaagagagtttagggacatggtgaacttgccacctttggaagctctaccatcgcagaagcaatctgctctattgattgctttcccttcccacaaagagaccatcaagtgcagaagtaatcaagtgaagttttcttgaaaaggcaagacaagagctgggcaacgaagggtgggaggccaaaggatgtatgaagggggaaatggagaggcttcctaaactaaaaaatattaaatcctttctgaaaagcaccttcagtagtgacctaaaacaaagatgaaagtcaaaccaatcaacaattacttttgtttagcaattctggaaaacatgttgcaggagaggacactggaaatgatggttaaaatacggtgggagccatggcagttcaagcctgtaatcctagcacctcaggaggctgaggcaagaagatcagttgatcccaggactttgaggctgcagtgagccatgatcacaccactgcactccagcctgggcaacagagtgagaccccaactctaaaaataataataataaaataaaatacaatgggagtgttggccaaggagttcactttttctctctattccatgccctttaggactactcataatcacaaatacatttgtgacccttctgagcgtaaatccacctgtctggggtgctcaataagtccaaagtagagtctatgtgcttggtaaatggctctggctagaaagcaactgcttggctaaatcacacctgacggtcttcccactgagatgggaaaatggggcagatagtgtttgcccaggagctggggcataaaaggattcttagtggatgtgatggctcagaagtgaatctctagttaccacttgggatctgacagtttttgagaagttctacagggctgtgaaagactgcacaggggtaaaaacaaaccttgtcattacattacaggtgttgagaatttctaaaatttacagtatataatactgattgaaaagtaaatgtcactgctactttggagttcagcataagccttatacagaggcagggtctgccagtgtggtaagaggatggccactgtaagggttaagtagccccacatctctttccctaccagcctgctttctgccctccagaaaccctatcatttatagctagtagtaaaagaacaacaattgcatttattgggcattaatatgttcctggtactatgctgaacagattatgtcttaccttgtttgatcatcccaacaacctatggggtaggtaccattatcatcccaattttatagatggagaaactgagactcagagatgctaagaatttgctcagctaataagcaataattagcaatggagctttaatttgaatccaaatgggacactctgaagtaaggcttctcctctccctaggacaggtcttggaagctgcatttttagcaagttccctcattcaggtcttaagttctagaaagtttcacactctttacccggtgctctacagcctcattatgaataaaacatcaaaggcctatgttacaatataattatctagaaaaggaccctgttttaaaacattatctaccattttcatttcagtatgaattacttaacgggattagtattaaggcctgccagcatgacctcaatgtgatgggccacaggagagttaagttcttatgggggaggagagtttggggaaaatctagaaatcgttggactctacccgaggaaagcagatctagttaagtcatcacatcaagaggcccaggggaaaaagaagtgatggcagttgaagtgctgaaaaaaaaaaagaaatctaaaggtaggcatcattgattcaactgatgggcccatttgaagcagtacctctgatctcagggagcatcccaaggaaaatgtcgtctgaatccacatagcctcagaatatgagcattgttactttttggaggtggggggaggctgcagacacccactcttctttgtttttgtttttgttttgagatagagatttgctcttgttgcccaggctggagtgcagtggcgcaagctcagctcactgcaacttccacctcccaggttcaagcgattctcctgcctcagcctccagagtagctgggataacaggctcccgccaccacgcctggctaattttttgtagaaacggggtttcaccatgttgactaggctggacttggactcctgacctcaggtgatccactgccgtcgcctcccaaagtgctgggattagaggtgtgagccactgtgcccagcccactgtttttgatacattcatcctgcaagatgtgttgcatcctggatgtatgctcttactttgcctgactgagatgcagctagctcccagctgctcctccctccattacagcagtgctctggtagaaggccatgggtgatttcccactagcaaccttatttgtctatgttccttccatttgggccaaggactaaaagccagctcagatttacacaattactttaacattgtttaagaaagcaatgtaacaacctccactttgcccagatggacgggctcaatgatgtcggtggagagaacccattattggaataagactgggaacacaaagtcatagctaggatctctcccactagtaggaatacagccgggcttctgatgaccagctttgtaggattgattttctatggttggaatggacccaaaatgttcacctagtctagtctacggccttcaagtagaagttttttcaaacgtagtcttcaaatttaatgaggaatacatttatatcattcaagaatatgaatgcatatgtatatgtacatgtatatatgattatatatctaggtatacatataaaagaatgcaatagaatatcttattcaccccgtcccacactcacccaattcttatcttctccctacaacatgtagttcccccccataacttttagtggttatatatctttccagatttttatgaaaatgtaagcaaatatgaatatatatatatattttaaaaatattttttcatttacataaaaggtagtctattgtgcacatcattttaccccttgttttcatcatttaataatatatctttctgtattagtgcacagagaacttattcttttatagaactacataatattttgttataataatgagccatcatttatttaaccagatttctatcaatggacatagaagttgtttccatattcagccattacaaacaatgctgcaatgaataatttttatatgtttcacacatgtgcaagtatatctgtagaatgaattcttaaaaataggattgttgggtcaaatatatatgtatttttaaatgaacagatattgctaaattgcccttcatcatgttttaatcaagtcttcacagacttaccaagagagtgttttattcaaacttttggatttttctaaatctgctaagaaaaatggtatttcattgcagttttaatttatatttctctaatgaatgaggttgattttttcatgtctaagggccacttgtagttccatttctgtcaactgtctatttatatcctttttccatttttaccattgggttatgaatctgtttcttgtcaatttatagaagctctttatatattagggacaaataggattttaatccccaaacagcaaatatgtgaagagattctattccagtgttttacagtgtcttatggcagcaaactctttcttcaaatgaaatttaaaaaagctaataaaaacacatttcactaacaaagtaagaggtattctgttgaagtagaaatggggaagggattttttttttcacatccctcaagtacctctgaagaatcctaaagcagcacagaacctagtttgaaaataatttccctacatgcctagttggcctgtggttccagtttctaataactctttcagcaaggaatcttttttagtatctaacctgaatccttattgatgcagttgatactcctccccacttaacattggcaatttgtgattatttgacctctcttccattatgaacctttatgtgttatttaaatacattatcatttaacacctttttgtgccttcccctccaatgaaagcaggattttacttgaagtcaggggaatgtcctatttatctttgtagctttaaggtaacataatgccaggtattgtcaatgtatagtcaaggatctattagtgccaggtatagtcaaagacctccacaagtgcttgttgaatgaataagaaaacaagagagaaatagtgttttgactcatgtctccatagcacctaccatacacatcagtgcaaagcaaatgcctttcagttagttatcatctatggaaattgggaaaattccttcatattcttcaactttactgctttcctctctgtgacctctttctagagcaagatcatctaccatttattgtgaatgttatgtaccagatacctttgggctttttaaaattaattatcgctgaacctcacagccacgtaaagtagaaggcatactcaagccttcctaagatcacagaaccaagacatgccaaagctggtgtcttagtctgtttgaactggtataacaaaacaccacaaactgagtagcttataaacaacagaaatttatttctcacagttctggaaggtggaaatccaagatcaaggtaccatcagatttgttctctggtgagggcttggcttctggttcagtgatgataccttctccctgtgagcctatatagtagaaggggcgaacaagctcccacaggcctcttctattaaaagcactaatctcattcatgaggatgttgcccttataacttaatcacctcccaaaggccccatctcctaaaagccatcaccttgggggttacgatttcaacatatgaatttcagaggcacacaaatattcagatcatagcagctgggaccccagagaccaatgtttgcagaccccagagaccaggctcagttatcttctcttgcatcactgtgagatacgcacatagaaacagcatcctattctaggggtttctttcaaggcctttttgtcattctctcttcccatatatttctgagacttggggtaaagccctttagatgatgtagttttactttgttggatgtgtatgtctctctgtgtgtcatgggcaattaaagggactataacctcttctttctagtctttaccttcatttccatgtcccttctccagccacctcccaatagcctgcaaatgttctaggactctatcagtagaatgacagagaaccaaagaaatgctagcatcaggctcagccatcagaagaaaagtaggaaccaaagtaatggcagcaatggcaaaagaaaagatggcttggcgtcaaggagattagcaactgatctctgaaagctctggggaggtttgtatttataacactgggagcagatttgtctcctgacatacaagctgcttttctgactatccaagaactgtcctactatggaaatgatcattttatagggtggggagagtggggaagagagcagtcagcatgaggacttggttccagagtgtgggaagaagggtaacaccaggagaggagggaaggcgtacaaaaagaagtgaagtggaaccacaggcttcttggtaaaatttgccagttgctctgaaggacaaaaaaaaaaaggcctgtggcagttattcagactgaggtgttagttagtgacaaggtgtaagtgtaccctctcatataattcttgggattacaaaatctgattgcaaaaggtagccatttaacctagaggaatggacttccaatagtggcattttaagcatcagtgtgagaaaaggtggtaagagacatttgggataagggggtattttctgagcatcccggaaatcatagttctgcttacatatgagatcatccctcacttggggagaagaaacctcctctttcccaacacatctgtggtcacatgacttagtgcttgtctgctcaccctacaatggttttttctccagtcctcctcttagtgctaggtgggaatttgactggaaacagaagagatgggggaggttagaagccacgcagcctggtcattcctattgtagcattccctgaggggccctgtagccagctttgctttgaactgattttctgctagttttcagtcaggaacactgaatgtgttccaaggatatttgtttactagcccagccaccttggaaaatctgggagaggagaaggtaaaatatgaggtggtttttcttccttctgcagttaggaagcatgctgtgttggccctctaaagatgcaaggggagatttgagtccatatcgcattcctagaaatattgaagcttaaagaggtaaagtgccttgtacaagattgtggggagtcagtaccattgagttgggattgtgactcagtgatcctgctctgaagctttaacacccattctgtgaagagcacaaatttgaaagcaggaaagctatatttctgagttggctctcttgttaaacagctgtgtgacatgggacaaatcttttggagtactagtagcctcattttcagtaattcgccccccacccccgagatacacaccattaagggtgttgcaagaatgaaataagaatgagatgttaagaattttattgcataaaactagccttaagcatgaccataattggtttctttttctttgattctactgtgtcttcctctctttctctttctccctatctcctgttgagtagaataatagactccagtgccaggttactcagaagactattgcaaggaagattctcaagatcattcttccactggaaaatctcaccctgcagttgccttgccattgattccttggtagaaggcccggttcaaaaatcaagccacattcttttgaggcaaaataattccaaacttcttttttgttgttgttgtttgtttggtattccaaacatctgccagctcccataagagccgtgacaaatattattttgtaggtcactgtagatttccttcaccacaaaatgctgagatttggaataattagagcccagggggcaaatgggcctgcttctgtcctttctctgatgggtttcactcatgtctgccagctgcagctgtctgattgtatacgcttgtgggcaggggcagggcctcttagcccagacagagttaattagtatgagttaaactctttctaggagctaaggctgtctttataaggcaaaagtaaggaactttctttatatcctctaaagggtcattaataagtagttaacaccctgagagtgaattactcagaaattgatgttagatcgacttatatagcaaagtatagaattgagttagttacccaaatcgctgaagccaaaagaagtgcattgtctgttttctgggtattttaggccacaacattagggacagcatagccttcatgttctagtggtttgggttttggtttttaattaaatggtcccttccttattataggtttgaagtgattggcactttttttgatagtggttatgagggaaggttctagaatcagtcagacatcaagttatatcttagtgctgccacttgcaagttgtgtcaccttgggcaagtcaatctcttaagccttagtttcttcatctgcaaaatgggcataatcatgtctacatcagaacattattagtaagagccaatgagattatgtatgtaaaagcactcattcctgcctggcacatagctagggcttgataaatggtatctattcgtgtattattattattattatggatgttattattgttagccttatcattttcactacatactgagaataatttcattctttttgcttgtttgtttgtttgtctgtttgtttgttttttgagatggagtctcgctctgtcgcccaggctggagtgcagtggcgtgatcacggctcactgcaagctctgtctcccgagttcacgccattctcctgcctcagcctcccgattagctgggactgcaggcactcgccaccatgcctggctaattttttgtattttttagtagagacggggtttcactgtgttagccaggatggtctcaatctcctgacctcgtgatccgcccgcctcggcctcccaaagtgctgggattacaggcatgagccaccgcgcctggcccattctgtttttttttaaacagttgtattgaggtataacttacccaccacaaaatagactcatattcattacagttttgactgatggaaaagaaaggatggttcaactctctaagcctctccctaatgaaacacacagctcccctgatttctctccttccactgtcttatggcaggcactttccaagctctggttgtatcttttgttggtttcaattccttttttcaccactcactagctttgtgacttcaaataattcacataacctcagcaatcctatttccctcaaatgaaaatgaaggtaagaatttaccctacttgattcacagggttgttatgaagctccattgtaataatatatgtgaaatctctttgtaaatggtctgctgggttactataattcacaaatatgagtttcaataatattcaaatgtcatattgtgtgcttcagacattagatgccttgagagatccagattgtggctggagttatttagagaatgcttcgtggaggaaaggcggcataagctgaaccttcaagatcagataggacctcaatgggtggaaaagagtcagggagtgggcagtctcggtggagggattaaaaaaaagcaaaaccacagaggctggaacaaacagataagcacaaaagtgatttaaaatgtaggcggtggccgggcgccatggctcacgcctgtaatcccagcactttgggaagatggggcaggcggatcaattgaggtcaggagtttgagagcagcctggtcaacatggtgaaaccccatctctacttaaaaaaaaaaaatagccaggcgtggtggcaggcgcctgtagtcccagctacttgggaggctgaggcacgagaattgcttgaacccaggaggcagaggttgcagtgagcagagctcgcaccatgcactccagcctgggcaacagagtgagactcagtctctaaataaataaatgtgggagggaataaagttaccagggcagtataatagatgggtccccttctgaagcaactgggggaaaagattaaatgagatagcatggactccttcctttcaggaaagataatatcttattcatctaggaatattagctccatctaggcagggaccttgtccatgttctctgatccctctctaacacatattacaattcctggcacatagtaggtgctcagtaaatggtcaacaaataaaagaatggatggatggatggatggacggatggatggatggatggatggatagatcataatgtcagctgctgtacttgtctggctgttttaacattattcaaaatcattggtcactggagcggggactgtcttaaaactccctctatgtagtacagccccgtctgctgttgggatttatgaaattcttgtcaatgatgccaatactcagtgtggtttttctccaccctgttctagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggtaagaccctacatcttaacattcctgctaggccctactcaaatacaagagcttcctctgtacttgtactttcatttgtgcctgcactgtaaggtgtttgaataaaacatgacttgcattaaatcataagcctccttgacaatccaaactccctgatcttcacccaccctgaacaactctgttgaagggctcaggcccaatcatatcccagtcttaaagctgtaggactgcttaaatgggcaaaggtgagctgtttgtgttgatcggcgctccttttcataataattataccaccaaagcctccatctgaaggactcacaattatttgaagctttgggaatgctatgggtggaaaagtcactttgactatctagggccactcactccaattaacaagaaaatgagttgtctgttagttcccatatctgaagtattttactaaccagttaattcctagtgccctgcaatgagaaaactctctataaatgcttggtcatgatgactaccaggacattacttgtcagaagaactgcatttactttacaaacaacgtatactaattacatcttatctaatatgcagtccggagaatataatcaatagaactagaaaatggagtaaaatgagtgtttaaactgaagcaggaaggaatgaagttagatgtagtaacaacttttctgcctgcaagtggcattaagcactggattgtcaagggaagctatagaatctcttccctttaggacttttagtaagaatatagtatctcagtagtttaggagaattttcgtgtggccttgctttcttaatggccttccaggaatcattctagccccaaaagaatgtgcttctaagaactaagaacaaggtttaaggaataacatttgaaagatagaaatttaggaaatcaggattattgcaaagacagatgtaaccagcaagtaaattttatcctctcccttgccttgtgctagactgagctgtggccatcagatcatcttgtatagttttgtattaccccagagagcttgttcctttggtttggaagggagagtctagtgaatattacaaatggaagctatgaaataaatcttcattcctttaaacccccaatccagctgggggaccaagggtaccatgaacagagaagaaagaaacaagactataattcatggttcagaggctcatggcatccctgacagactactttgtaccaccttagaccatgatgctcgactaggattgctaacttttctgtggcttagtctctggcatggaggaattgtaggagaaaaaaaataatgcgtaataaaatgtaggaagtaccgagaactgacgatgggagagctggggggaaggacatgccgtgttttgagtccctgctctatttcaggtattaagtgaagcctttacacttatcctagatgcttctaatcttaattctgtttctccttggcaggagggaaacgtgtattgtggtctcaagacttgccccaaattaacctgtgccttcccagtctctgttccagattcctgctgccgggtatgcagaggtaggtgtgttatatcccaagacccctgggtgctgctatcctgtgtagtagaatttagaaaggaggaaaatacctgtctaatgtcctagggaaaggtaatttttatggtagccttagtttttaaaggtggtttaattaacaaagggaaaaataaataaagcattgattttaaaggccacagcctttaaaaaaaaaaaaaaaactacaggatggagtgctgtgcttcaggggaggatgggaaagagtcatcaaatgtgaaagtgaatatatttatttctccatccttaatcccttctagcttggcccttaaattattgtatcataaaacacagactattttcattcatagccttagaaggaagaatggaccttgcaaggaattgatgtggccattttgaagactgtgcagggcaaatttaggtatactttttaaaccccataataagatggtgacaaactcaataaaagcaaaacagaaagcattttctcaaattatattcaaaattgaattgtcttctcacattagtctttttttctttaggttttattttttttataatggcaccagttttttcgctaggttcctgggatcaagtgtaatcccctttaatttctcctttgttacctcttctcagattaccaaatctttcagcagttatctgtatctctcccttttcccactttcccactggcaatatccttattttgtcctttttccttctatccagtcaacatattttttgaccatctactgtatgctcagcattgtgctagaattggggtatttatattgataaatacagtagatatatagggtggtgctagaccatatggcatctttatgtgagttacaaaaaggattcccttacataagatactttattgccatttttcagaaaatcccagggaaagcacctttgtagctgtggcatccttttgcagcacacaacctacacaacaatatatatagcatacatagcagccaagatatgttctttgctcttatggaactcaccagaaaagacaaataataagcaaacgtggaaatacagataatgcaagtactatgcagaaaataaacataggactgagattaaaaataagtagtttatttaggttgagttgtcaggaaggcctctctgagaaggtgacatttaagctgagacctgaaagataaaaagaagtcacccatgcaaagatcccaaagaagaacattctaagtagagagaaaagaaagttcaaaggccccaggcagggaagagcttaaagcattcaaagagcctaaggaccagtgtagctgaaatgtagtgattgtggttgaaactgacatgggatgaggctgaagaggtaactaggaattagaccatgcaggattctgaaggccatgggaaggattttggatttccatttttaatacattgggaagctattggaaggttgtgagaaagagtatgaagtgatccaattaacatattaaaagatctcactggctattatttccagactagactggagggaggcaataatgcaagtggagagactagcaagatggttagggtagtactctttccagtgtgagaaaaagggtgcttggactgagaacacagtagtggttcagagtggagcctttggagccaaactgccttggttctaatcccagccttgctactttgtagttgaatgaccttattcaacctttctaccaatctttaaagtgaggataatgttagctcctaccttcaagatgtttgtgagatttcaatgagataatataagagaaggacctggcacagtgtcttgtatatactgaggacccaataattaaaagtggacaaatttgaaatacatttggagccgtggttctcaactatgggtgcatattggaattaccttggtagatttataccagatcagaaggaggaggatgtgattccaatatgcagctaaggttgtgaaccactgagttagaggaaaaaaattataggatttgctggtgggggatgtgtaggtgacttctatacattactgccattttaatcttccaaaaagcaatccatcaccgtgttacacccctgttcaaaaatttttatgccaacatgtatttggacttactatatgtcagtcccagttctaactaagcattttacagatatgaactcacttaatctcatgacaaccctatgtgaggagtactattgttctccctgttttatggatgaggaaactgaggcagagagcggttaagaatcttatccaaggtcaggtagctagtgagttgaggagctaagatttgaatcctggcagcctggctccatatttcaggctctaaccacagtgttctgccactgaaagggatgactccctgtcgccactcaaatacatgtcaacccccgactctgatagtgaaggcctttcatggtctaacctcaagttacctttataggtcaatattcttccattcatgcacctcagggcccactgcattgttcctgtgctctcttacctttttacctttgctcagtcctcttcctgtcagtgtttctcacactttagtgtgcttcagaattgctcagagaacttgttgaagttcagattcctggatcacacctgcagagattctgatttagtggccttggagtgggacccaggaatctgcatttaagcagaccccatcgttcattctgatgcagaatggtggtctgtggactgtcactttgagaaaccattcctgagaccatgtagataacctggaaccaaggatttgttttaaaaaatctgagtttagtgcacttaaattgagcacattaaaattctgaaacctgagtgaaccagtggaaaagcaaccaatttcagttcctgattggttaaagcatctaagtccgaccatatggcaaccaatttgagatgaatgagtggtggccatttcatgataaggaactgggatgaaaaggagacaaaagggctgtctaagtaacaactgcacatgtacaggttggatggagaaaatgtttcctctttctggaaaattctttttctccatccctgcctgtggaagtcctgctagtccttcaagacctagcacaaatgcagcttcctcagattctattgcaggccgtcctcaggtcgcattttgataagtagtagttggaaggcctttcttttctgccttcccacttccatccctaatttctccacccataaatcctgcttatccttcaaaatccagcctaattgccacttcttccatgaaatgtttttaaatcctgcaaactagaagtaaacctgtctctactctaggactcctcagcacttaacctgtgcttcttctggagcatttatcaccttgtcaacttctgttttttattatttgtgcccatgtattatcatccctattaatgcataagctcttcaagacagatactctttttcatttatctttatttctcccactgtgccaggcagagtaggtgctctttaaatgaatgcacactagattggaatgattactagaaatttagtcaggatttgaattaggtgctaccaaaaaagaatatggttgttgtgcatttttccccctgaattactgattgactgtggtagatggtgttgactatacattgattcctcgtcaataggaaattacttggtctcattcctgatctccaagttgttttcttcccctataccactttaggaaactacagttaacattgctttttggaaggactgagcttgtttggactaccagtgtatgctcatcccttttaatatgctatttgcatcagccctcataagtcaatatggatttagttacagcctaatttgatttatgctttggtaaggccctggatctttccatacatgtttctcacaatgtgtgtgtgtatatgtctgtactacagtgtagctgttacatttcagtcaagaaagatggatattttgttcctcacctcctttcttgtcttggccccaacttaatttcagtgtggctcaaaagaaagtccatactgagcagaggtgtacatgtggttgctaatataaccagttggtcactataatccagctgttaggctgatattattccctttggggaaaaggatatgtgaaatctaaactggaaaacaattgataatagaaaggaaaggcaacagtgaaaagacatgtcactgcaacctaggggcaatacggtataatgcaaaggacagaggctctgaagccagaaggtcatagatttgacattgcagggctaccacctacgagtgctgttatcttggacaaactatttaaccactcaaaaccttggttttctcaggtgtaaaaatggagattatgcttactacgtatgaaatgggttgtgtagattaactgagatggcgtagagtgctaggagatggcctaatacagagttattggtttataagtaacaattactatattttatatagtaattactatatttattacccccgagttaagtatcattgcaccttctcctctatctttgatagttttgcctttttaaaatgtaatctccatagacagaactttagttctagttcttcttgtggtaacagatcctggaactagctattttatgtactgttctatcgttacaatttaaatttcttttcttttttatgtcctcagaagcaacagataaaagctagttattactggccatgtattgtccctttatatacttgataattcattaagttctttctttgcaacctctcatccagcctaaatgcacaattttctttcatcttcctttataaagactaaatcctacacttttgtaaaaattgttgttctttcattgcctccagtttctttgcatctttcagctgtatataatgtggttgaaactcctttgaagttctaacttttgaagcacctagttattttttcccatggaaatgacgtttttacaatactgtatcttatataagcgtattactcatacagcagggaacccagaaacctctcccctatgctggccaccctgactgcaggccaaatactgaagaagaaataatcttttgactgctgaacttgcaaaccttcatataaagggcattgaaatagcctctctgcactgtccccaaacactaatgtgtgtctttcttcctgggtcagacagcaatcctagacgcggattgaatctcagacctagccttcattggctagacgtgtctttgaggctgggacagtcaaggagagcgttggcagaatgtgtgtcattgctagcacttcagcaaacctcattaggactggaagcatagtgcaaacagccactggaaccttaagggaaattttatcagaagaaaaaatctcttcagatcctgtgttagtttgctaaggatgatagcctccaactccatctatcttcctgcaaaagacatgctctcattcatttttatggctgcatagtattccatggtgtatatataccacattttctttatccagtctgtcattgatgggcatttaggttgattctgtgtcttcagaattgtgaatactgctgcaatgaacatttgcgtgcatgtgtctttttttttccccaaatactgcatgttctcacttataagtgggagctaaatgatgagaacttacgaacacaaagaaggaagtaacagacactggggtcttcttgaggatggagggtgagaggagggagagaagcaggaaagaatctgtacaacaaaccctcatgacaggagtttacctatgtaacagactttcataggtatcctcaaacctaaaataaaagtttttttttttttaaatctcttcagagattatactactgccacattctgggaaggcaggcttcaaacccaaacccacacccagcttccctccaccattgatcatttccacttcctgtcccctgctcatcttgccaaaacaacagggaaggctatgtacttggactctagacaagggaaaggtatttggggtaggtattaactgtattgaaagccaagtatgcatttagtaaatggtgtctaaatgtagcacgtacaatgtgccagacaatgttctaagcacttatgtgtggaatagctcatttgatcctggcaaaaatagtagcaactatttatatccccattctacagatgcggaagctaaggcagaaaagttgagtgatttgtccaaggacaaatggtagtaagtggcagagctagaattttaacctggtcagtctggcttcagagtttcaagctcttaacttctatactacctgttgggacccattcataggagtatgacaaggatatctcctagtacaggggagtaaaggggaagacgggacatgcatggcacattgttgtgtgcagatactcctaagagagtatcttaccacactgcccatgttttcccatcaaggccttaacttacccttctctcactctaggcttaaagtgtcttgagtgtaaatgtctactttctttcattcagcaaacattgttaagcaatcactaagagcctggcactgcaccagtgctagagatacaatggtgaacaaaaatggacatggaacctgccttcatggagttttagtagggaagatagacaccacgtcatgatataagtaattataaaattgcaactgtgccacatgccacaaaggaaagttgttataaaagccaataattgagaggggttgacctagtcagggaggtgaaggaagacttctgagactgtctctccagcctcaactcgcaccacatccctccttgttctctgcactccagggtgaggaaagattggctcaaaaattagggagataactggtggcagtcatacactcctgggatccccaacttctgatcccaccatgaatccagtccctccccaggctgtaggggtctataatgttctttctacattatacatgctacataataccctaatctaggaattttcttttactcttctttcttttggctgtttcctgtttttcagagacagggtctcactctgtcatccaggctgtagtgcactggcacaattatagctcactgcagcctcaaactacaagctacccttctgtctcagcctcctgagtagctgggactacaggcgtgcaccaccgtgcccaaccaatttttttttttttttagagacatggtctcgctatgttgcccaggttggtctcaaactcctggtcacaaatgattctcctgcctcggcctcccaaagtgctgggattacagacatgagcccagcctaggaattttctttttgagaaactacttgatcatgctaccatttcttaccatattatccaatctgaatttttcagcttgtttttaaagaccctctgtgaaacagtctgatccttccttaacctactttccagcctcatttctctgacaccaacacacacatctcctttaggctggctggctgatctctttgttctgttacatgctatgtttcttcctaccttccctcctgttatgtgcttcacttaaactgttatttttcacaagcttggaatagcccccgctcctcttctacctattcgcatcctactcatctttcaagggtccagttgaagttgcacctcttctaatagttttgcccaatcactctagttctcattgatcttctttgaccaccttcaggacttaatctggttcaaaaataagcattcagaaatatattcttgcactgttattgctttgtgtcttcctgtttcccctggcataacataatattaatcatatatcatgctgactggtttatttaatacaaaaagagccacagtcacaaaaagctcttgacagcattccaagtacagatgcagtagggaggcaggagaaatggtggaacttacaatttgctcaacccaagcccgttcatccaacatatctcaaatgagcccagggagaaaatggaagtcactttttatgaaattttgatatttctgctaactccttcaaggtaaatgaaactggaagcaattgtttaaaagtatattagtcagtgttcaagataagtgccattttacctaagacacttgatttctctttccgaaagagcagcaaaattgcacctcagatcccatctcagctagaatccgggatcttcagggaagtggtatgtgagatacttcattgattttaaacatcataaaaattgaccagtttttcaaagttttcaaaatcaaagaaaactgaagaaaataacagcaaatccaaatatagattctcacaaattagtctcaagttgtttatgttttggcccacattttctgcagaaacaccaccatctcctggtcatgatgataggaaagaaacattgttaatgagaaacactactttaaaaaatgaaaattcatcttgtataactgaaaccttatgcctgttgattagcagctccccacttccccctccaaggtgaacaagttctaaagatctgcagtacaacattgtgtgtgtatagttaaccatatagtattgtatacttaagtttgttaaaagggtaaatctcgttaagtgtccttaccacaataaaataaaaaaaattaaaattaactcagtaatttttgagtttatacattctcacctaaacttcaaaatacagtccgccctctatattcactggttgcacatccatggattcaaccaactgcagatagaaaataatttttaaaaacacgttaaaagtaacagtacaacaatctaaaaattacaaattttagaaaccaatatagtaaaatgactatttacatagcatttacattgtattaagttttataagtaatctagagattatttaaagtatatgggagtatgtgtgtaagttatatgcaaacactatgccattttttatcagggacttgagcatctgtggattttggcatctgtggggggtcgtggaaccaattccgcatagatactgagggacgactgtgtattgatatactctgatattttcatagctatagaagagtctcgctgtcattaataataccttttcaaaagtgaatcatttatgttcatgtgtatgggaccattttagagatttgccatcctcacctacctctcctcatctaaatcccaactggatctccttccatggaaatgttccagattgtttttgctttctctccatctcttgtgctcaaaattcatccccacgtacttgctgactgtcccaggaccccgtccctctaaggtcatcatgttccttcttggcatgtttcttacgtctagaatatttcttcttgaatagaaagtcattcagacagtggatgggacagcgttgactttcacattgagtttaacaaattaatagcactgattcctaatcggccatctgggttgtcctgtcagggtcagtaataccccattctgtttctgggattggaggacttttttgtgtgtatatgaatctgtttctataataaaaataaggaattcccagtgaagcatttcagagcaattatttcttcatgggtggttaaagccactctttcttcaaccttattctttctaactccttcaaggaattccatagctgcccagaaacaccattggatgtgcccattactcacattataatagtctttatgagcttagactccaacaatttatagaaatcaacctggtttgttgactgacagtgcaaacagaggtaaaagatacatgagaaggaagagcagtgtatacaactgactgcttttcattttcaggttgaccagacagtcagcatgggtaggtcattgagtttctcctctctgtcctgctttttattttcagttcatggatgtggtagcacagaactctactttatttggatacttggatttttttttttaagacagagtctctgttgcccaggctggagtgcagtggcatgacctcagctcactgcaacctctgcctcctgggttcaagtgatcctcccgcctcagcctcccaagtagctcagactacaggcgctcaccacatctggctaacttttgtatttttagtagagacggggtttcccgatgttgtctaggctggtctcaaactccttacctcagatgatctacccgcctcagcctcccaaagtgctgagattacaggcatgagtcaccgcgctcagtgggcacttggatttttaagacttcactttataactttgtaaattgtactcctaccaatgaagcagatatctttcctgtcaagcctcatttttagccaagagagaaaagagattttaattaagatgcaaactcttttttaaaaaattggaaatagaggactagcataattatgagaaattctaagccagtttagaaggtgtgagccgaagaaatctctctagccatttttaaaaatatctccaggaccctgtcttccaatgatttagagatgaaatgattccttttcaatgtgcaggcatgcagttatctttgctaggctttgtttgcttgtttgtttgtttgtttgtttgatccaagcccttttctttgttaaatacacagcacacttgtgggagtcccttaagccgggtattcccccatgtgtaagctacccttgaggagaaggaggaaaaagaagtggaggcaaagaatgggaagaaaggggattaggaatagcagctaacatttagctgacacagtgtgccaagcacaattctaaatgctttgcatatactaattcatttaatcttcacaaccctataaggtaggcattattgtctccattttagcaataaggaaactgaggcacagagaagttaattcatttgcccaaagtcacataagtaggaaggagcagagccagaatttgaatccaaactgtttggctccaatctgttctcttagccattatattatactgcctctcaacttggggaagcaaagcaaatttgggaactcttatttctgaggctaccgggaggaacagactgtgtgatgaccatctttccaggggccagatatggtaacaatccagcagatgcattgggactgctctgagaagcaaagattctgtttctcaccataaacttggatctgtttagccacatctccattgaaagagcagagtgtggatggtgggtaccatccagctcgtagtttctgtattcactctcttctgatttcctcctggaaacgcatgcattctcacaatgcactttttaaaaagtaagtatttatgatttttctggacaaataattttgtactcttcttcagatttggcttgctactgttggcaggaattccccccgttgtgtgtgttttggtatttctcaaggagctattttgttaaaaatactaagatcttatattgacagcccaaacaataaagtacttcatttgacaaagaagtattttttaagaaaataactgtctgatcctttttatggctgtatagtattccatggtgtatatgtgtcacattttctttatcccatctatcattgatgggcatttgggttggttccaagtcttgctattgtgaatggtgctgcaataaacataccggtgcatgtgtctttatagtagcatgatttataatcctttgggtatatactcagtaatgggattgctaggtcaaatggtatttctggttctagatccttgagaaatcaccgcactgtcttccacaatggttgaactaatttacactcccaccaagagtgtaaaagtgttccaatttctcatcctttccagcatctgttgtttcctgactttttaaggatcaccattctaactggcatgagatggtatctcattgtggttttgatttgcacttctctaatgaccagtgatgatgagctctttttcatatgtttgtgggccatataaatgtcttcttttgagaagtgtctgttcatatcctttgctcactttttgatggggttggtttttttttcttgtaaatttgtttaagttctttgtaggttctggatattagctctttgtcagatagatagattgcacaaattttctcccattctgtaggttgcctgtgcactctgatgatagtttcttttgctgtgaagaagctcgttagtttaattagatcccatttgtctagtttggcttttgttgccattgcttttggtgttttagtcatggagtctttgcccatgcctatgccctgaatggtgttgcctaggttttcttctagggtttttatggttttaggtcttacgtttaagcctttaatccatcttgagttaattcttgcatgaggtgtaaggaaggggtccagtttcatttttctgcatatggctagccaggttttcccaacaccatttattaaatagggaatcttttcctccattgcttgtttttctcaggtttgtcaaagatcagatggttacagataagtggcattatttctgaggcctctgttctgttccattggtctatatatctgttttggtaccagtaccatgctgttttggttactgtagccttgtagtatagtttgaagtcagatagtgtgatgcctccagctttgttccttttgcttaggattgtcctggctatatgggctcttttttggttccatttgaaatttaaagtagttttttctaattttgtgctttataaaacttgcagatttcttgtattgttgtatatcatcattggaagctcaaatgcctatcagtggagaatccttatactagtttccttttaaagcttctctcaaatttcagcacacttgctccctcccagcagaatttatagaattagatgtttggcagaggctccctaaagtcatctgcttctactcacttcttcatctctagcttcggtatggagcactggcattaaagtgctcccccatggaacccagctcatggtaaggagagacttcacaatgggtttattcctccctgctctcttccactttgccctgattctgctcatttcaacttctgcctcaaaaaatacagagaacatttcccctgtctcagggatttgtctcatgtccctttgccttatgattagagtgactatgtaatttactatctcaaccgaggcacattttgaaagcaagagctgcaatcttaataattatgcctgccagaaaaacaggcaataaaactgagttgtctgagataaatctgctctatggctaccctatttatgatgtatggttcaaaagtggccacatgctggcatagttttgctctctgaggcttatcttcatgggtatctcggaatctcattgtacacttagtccttttgagaggacagtttacctctctgacctgctcaagccaccagagattaatggaagccacaggagttataaacagtctgaatttcagcctagcttttggccatttttcaaatacttgttctccctttctcccactactagaaagccaacccattacagcttcatagggtaccactcagagagagtatgactgaggtttgaataaacaatacatgtggcttttagggttaaatgaatattgtttgacatacagtacactacacttgtttttatttcagttcaaaaaattggttaaaattatatcttgttgcttctcaaaattaattagaatccatctgaatccattagaatctctgttttttgttttgttttgttttttacaaaaagacttggctgaatgaaaaagcctccatctcattcagataatctttccagtgatcagacaaaaagagcaaagaaacaggttttttagggtattggtgcctactttttttcaaagtatgatatctaaggttgcaaatggacatacctattttcagctatccagacagactgtacccaggtctagagaaccacttatagccttataaaatgtcaacatctaagaagataattccagtttaattatgggttaaattaaatagaataattcaaatgttaaaacgtttagcagctacttaatagacttaatagaacattgaagtttagagaatgcaattttgatgactttgaaagctcagaggcaccagaaatgctaacagttcctagtatttatatatttaatgtatataatttataatgtacatagtatatcttatatataaatatagtgtatatatacatatatgtgtgtatttatatacaggttaaatatcccttgtccaaaatgcttgggactggaagtatttcagatttccgatgtttttggattttggaatatttgcattgtacttaccagttgagcatctctaatccaaaaaccccaaatccaaaaatgctccagtgagaatttcctttgagcatcatcagcactcaaaaacttctggagcattttagactaggaatactaaaacctgtatgatatatataacatacagttttagtatgatatagatgatatatatatatatatcatacagttttagtatgatatagatgatatatatatgtaatacaggtttagtattcccccattacttgtttttgtcaggtttgtcaaagatcagatggtatatatatgtgtctgtgtgtatatatatatgtgtgtgtgtatatatatatatgtgtatatatatgtgtgtatatatatatgtgtgtgtgtatatatatatatatatatatatagtctccattactttttaatgaagtgctgaaatttaggtatgcattcttgtctgcaaatgctcatcaaatacacatcacgacacactcatctgatttgtgttacagggtattagtattcttctcctatgcctgatagtgacttgcctccttgattttccatcttacctctctgctcatttgtaagaggcgctatgtgcttctataatgctttgagattctgactggactataagtatttaatgacactctttaattaaaatccttttaaaaactctagggtataaattaaataaactgaacttttcagaaggccagctaagtaaacattttatgtcaataccaatcattaaatctacattttaaaaggacatttgatgaagagaactagtctatcatttttcttttgcaacttgttttctcccttttgactacttaaattaggcttgaaaccacattatatagcttttacattttgttttgccatttgctggtaaatctttactggtttctattcgtctctctagtcccatattttatttggcccagacccactactgcccactgaaacaagggggacaagtaaatctaagctcatccctgctcaatcactgtccccagctctccagatttgcaacccaagagttgtcagatactgatttcccctttgccttccttccccatcatcaaatcttccttcagggtcttatcagtttcttttcatctgtaggagtctcattcaatccttcttgtgtgttattgcacagatgctcatggcctattacatattactatagcagcttcctgtatggcctcctgcattcgagttactccccaactagtctataccccattgccagaataggcttccacaaatatcagttttatcataggaacccctacagaaaaattggcaacataatcaaatgtgaattcttcagccttttacaaaattttatatttttttgaatttttactgtttactttttacaatttaattattttcttaaaattgtgtgggtacataataggcatatatatttatgaggtacatgatatgttttgatacaggcatgcaatatgaaatgaacacatcatggagaatagggtatcgatcccctcaagcatttatcttttaagttacaaatgatccaattacactctttaagttattttaaaatgtacaagtaagttattattgactatagtcaccctattgtgctatcaaatagtagcacattatttactacccctatttacctcaacaacacaccccactgtcattctccctccctccttcgctctccctctcctccctttctctctacaagttcaattaccagcgtaatttctcttgttttcatatctgaagtttctactcaagccacaccttgcttgctgtctccagtatgtgacttgctgtttacaaagctctggtcctttgccaatgtcactccctttggttgaggtactctctgcccttatcactgtcggtttatgctgtgcagtatctacttctaaaaatgtgacttaatggttctttcaggaagctttctacgattacatctgactgctcactcatcccattcagtgtctcctaagcatgtgtatttcatttgtatttgctttttttgtgtgtttttaggctgtttcctatattgatttcccatcacctccaacctgggtgtaaatatcctgagggcaagagcccagcctgattttctcctctttctgctgtagtatcaggctcttcacccaagaagtgttcaaagcatgttaactgactcttgggcataattttctagttataaacatagttgaaatcatctttgttttacagtagtcagtcagggtttccacagagttcagcttgcagtctacaatctttactcagacatggaataaaacaggcagaaaagagtatatatactattgaccaagcacttaattctgtatgttttactgcagttcaattcaatacatatattgagcacctgatgtgtacgcagcaatatgctaagtgctccagcctggttattcacaaactcctgcatccatcagaatcccctggaaggcttgtcaaaacccaggatcaccagcccccatcctgagtttctgacttagtaggtatgggttgggatctgaaatttggcatttctaacaagtttccaggtaatgctgatactgctagtccaggaagcacattttgagaagcagtggtctaggagatacagaggtggtctaagacataatctctcattccaaggaatttacagactctctagggagacaaggaaggcccagaaaacatttaacagtaataaatattgtacagtgttttagtatttattgattcgacaaatattgaataagtactatgtgcccagcactgccccagatgctggagttacatcagtaaacacaatagacaaaaatccctgctgtcatggggggattctaatatgggaaagcagacaataaacaaaataaataaaatataagaaatataagatagtaataactgctaaggagaaaaagcaaagagcaggcataaatatcagatgggggttggaactatagatagggtggtcagagaaggcctcccagttccatcatttgacaagtatttattgagcgactactatgtatcaggcactgttatagatgatggtgatatagtaacacaggtaatgaacccttttcttatggaatggacatacctatttgggagccaggtaacctagagttttggtgttaattctcacaaactcattattagactctgaatggctacttcccctctcagccatggtttcttcatctgttaaatggagcagttggacaaagttatgcttgacgtcctctatacttctaaaacttcaggatgcttagtcttttaggcaatcagaaatatgtaagagtgtttgaagaagactttgcagaggagagaaaacttaaatggttttcacaggcatgggggagctatggggtgtgggagatggaaggtaatttcagaagaagaataacatgagctacagcacggaagcaacaatgggagtccagtattcagtgaagagcaagtagctcaaagggttcccattgaagagtagctgagatcattgggtaggcagtagggggtgattgtagagagtcttggttgggaacccactgagggttttgatcagggaatgacacgattatacaatcaaagtggtgttttactgttttatgaagattaacctagcaaatagttaaatcctcaaaattcattatttttcatcagataatatttgaattatgaagatttacagtcatactctgttataagtcactgcctgattctaatattgctatcaaactaatttttaggtcgttttcaagcccttaaaagcctatgatactacctaatttcccctaacactactactacatgcttgaactggtaacatgttactctttttgtgtgtgtgtgtgacagggtctggctctgttgcccaggctggaatgcagtagcatcatctcggctcactgcaacctccacctgccaagctcaagcagttcttctacctcagcctcccaagtagctgggactacaggtgcacaccaccatgcccagctagttttcgtattttctgtagagacagggtctccctgtgttgcccaggctggtctcaaactcctgagctcaagtgatctgcctacttcggcctcccagagtgctgggattaaaggcatgacccactgcacccggcgtgttactcttatgaaggcttgagagagtaatcagaatagaaaattcttagtacttacacttttttgtgtttctggttatcttataaaatatatgttgaatattaggtttatcttcagccatatatataatttaaatagtactcatttcaagtgatgcaaacatctctaagacaaggctcttcccattcgcttgcttggtcagaggtaacacaagggcaatattcttggaaatgatcctcttgttttttaatcagttgaggtatatccacagctcttgtgtgtttgttgctctagaggctgaaagtagaatattcttcctataagcagttactttagaagataatgataaggagttctctgtccaaagagtgggtcatgtagacctagagaaaggtgtgtcataagaaattatgacagatcaaatcctcaaaactcattattttaatggtagtttaaacagaagtgaattatgacctgcaaaacacttaactgtcacgaagtaaaatgagcaaaagtgacagtgatggttaaattaggtggaaagtgattattttccttttattttccaaattctgcataatgttgctaggacatctatttagaaagtggcaactttcttcagagttgttttgaaaaatgaggcacacccagagaaatctttcacagccgctttttgaaggacagccacaaaagcaaaaacacttcaagaactttgggatcatagtaccaaaaatgttgctgggtcacaagggtgataactttcccttttatgaatgtatgattttctccttatttctttttaataaacaggagatggagaactgtcatgggaacattctgatggtgatatcttccggcaacctgccaacagagaagcagtaagtgtgaatagctcaaataattcaacactccacagcatcaggccaagctttcctctcctcgtggctactattctagcaaatccaaaaaaaaggcccgatttctaacaccatttttcttcccttttctcaaagtttttaatgtcatcaccaactggaaaccatttaagtacactgtaaaattggtaactggaggcaggaaatgtgcacaaagaaaccatagccccagccctttgtctaggtcagaagttggtactctttcaggatgacttgccaagtctttatgtgttctctaaggaagctaggtcactcctatcctcaacagtgaggaccttctgtagggttgtaggatacaaccatctttttggtgggatttggtaggtacttcagacatgtccacataaactctttcccaagccttaggctctcagtcatacagttggaaaagaggaaaggtagcagtctggattctcctctcttcagcctggtgatgtctcccttctgttctctgcactaatctcagaataagcctcacaagtaggcatctgtctatgtaagtaatagcatcttttgttcttttgtattttgaaggaatttataaaatagcattcctctctaaaaatatatgtctaagaagctttacactacaaatttcttaaaatctgaaaaggagatgttccgattcaaagaatctatcatacaaaatgcacagtggtgaccattgcacataaataggtgttcatcacatccttgtacaaaaaaagtatgcaaggacattcactgcgttgttgttttcataaaaacaaaacaaatggagacaacctaaatgtctactagggacttggtgtgtacatccaattaatgggacactgtgcagttgttaaaagaatacggtacatctaaatgtagtaaagtgaattgagctccaagatatgttaagtaacaaaacaaggtgcagaatgaaattgtacactatcacttctttatgtaaaaattgtatgtgcatgtatataaatgcatataaaccaatctggaaggtcacataccaacatgtcaggtgtgctaatcttaaaggagtagaagtgggcaggaggaaaggtagattttgactttttactttatattttctgtataatttgatgttttcctataagcatcaattagttttgtaataaaatatatttgattttctaaaaccctagaaaaatctcagcaaggattgaatatgaggcaggagtccagggaattacagggcaagcctgaggatattgagcatgtgaggaagatgttgataggggatgcagtagaatgactcatacaaacatcacagtgctgctgaggctgggcttcctggtcatcacatgggccacttctaacttgcatgctcccagcttgccaacacccaacccaaagcttcagcagtgagatggaaccatttctatttgtcttactctctatcagtattattttctgaacactgctgtttctgaatagttgcagaagaattggggaaaggggtttggagaacagtactctggacatctcaaaaaatcagcatcctgcaagagagggtaggcttccctgtttgctggttaatataaaccctgaggaaagattttctccacccaactctatctgctttatagtaagtgagattccttccagagcctgacaggagatgatgtcagtctcagttttctgtgttgtctgttcctctttttctcagcccctattttttattgtggtaggtagttgagagtggctgaattagtggctgtcaaccagatgtcattctaaaccaaatttagagtttagtcaccttaagctatgtgacttattccctgagaggcccccacactaagcactatggccaccttagcagtcttgctggtaatgccatgaattagcctttcttcttgacttcattttacactgccctcaattccagcccttatctttcagcttcattgacaggcctagtgataggcctggacttaatccagtacttcctgtagcaaaaaaggtcgggtacagaatgtgggcccttgaaatagttattgattttcaaaggagttcaagacctatctttagaaacaaacatttgtgcctggtagaccaaaatggccatatggtttcactttattataaataaatatttccctttgttctaaaagggatagatattgtgggatatgatttgaataataaatagcatctgtagtaatggaaaaatatatacctggcacatagtagtcacccaataaataaacattgaatgaatgggtgtgggaggtggcgtaaaatgtgtgtgatggtggagtggggagggggttcctcattaattttaatgcacaggaatttgtctcaaatcagagataaactcttcaaatttgttgtttgctcttgaccagcctaaaatgagaaaataggagaatcccttctgaatatcctttgcaggcccaacttcctcagggcaagaagaaaaggcagccctaacaacagatttcttatccaggagactgtccttttcgtaaactgttcctatttaccgggaaccagcaaaacctctgttcaacagaaatacagctgactggtttcttttgccaggtggtctgaaaaccatcggcttagcaagttttatgaagtgcacaggaagaggaaccagtggttcaaatatgactcctttgtaaaaacctgaaacagtttttgtttgatttctaagttgtaatttctcatgaattggtcctcgtgccattggtggggagtgtgtctgcgtgtgtgtgtgtgtgtgtgtgtgtgtgtgtgtgtgtgtgtgtgtgtgtgtgtgtgtgtgtgtgtggagtggtgtggtatgtggggaggaagaagtaggtgcagactagaaagccaaaacatgaaagcatgcataattttgttttggacaacagccaagccctgatttttgccccctgtagattacgttgaaatttaccattaaaaaaagtgaaagcgtttgggatagaaacgacatgaaacagataaaaatccatgtctcatttgtactgtcagaacaatggtttgggaaggaaattggcctaagtgtcttccagccagagatagtcctaggttggtagtgattaagatacaatgttttaatggctgtatggattagaatatattctgaagccgctttttaaattaaactttttttattttgagataactatagattcacttgcagttgtagcagaaaatacagagagatcccatattccctttgcccagtttccccaaatggtaacatcttgaaaatctatagtacagtatcacaaacatgagggccctttctggaccctgatgttttcttgtctacaccaataaaactcttatattttagactttagaacatgaaattcttgggggtcctctacaatagtggggatttttcaacactggaaaagaactgttttagagccacctctaaagcctgaaatatttttcagtctttcaagtaagtaaatcaaaaaataccaaaatactgagcaaaataaaagatcatagctatatggtcatttctaactggttttgacccgctctctcaagcaggctagttgcagctaatttttaagataagctccaatttcacttacaacttcagggcgttaataacctttttctcctttgctctgagttacaaggtcagaatggcccctcataagtctctttcatttgtttaggggaggaactctaaaagaaccattacccttaaatcaaaatcacacaccaccaccacccactccagcccccaaacagaaaatcctttatgtcagtgattcccaaccttggcttcaaaccagagtctcttggggagtatataaaatcctaatgcccaggccttcccccaaaccacttacataaggatacctcagagcgggacccaggtatgagtattttttacagctcaccgggtgattttagtgtatagccaaagtggagtatgtggtatatgtggttgtgaacattgtagctgaatgaacttttgtatctgaaagaacttctctttgcaccagcttttagtcaaatggttatagaccactgagtttgattggacattctttcttccactttctccttcttctccttctcttcctccttctattcatcttccccctactcctacactcctaccatctccaaaaactcaatcttcattatcaccatgagtaaactgcctctcctccttggcctcagtttctctgtctgtaaaacaaaagacttcaacaagattaggttctgggggactgactggtctacaatagggcctgtgatcaaaattcttgaggattttgttttttcatcatgatcattttcctaccattattatatgtcccaggtctgagacgttggtgctaaagaatggcttttcattttgtgttcaccatcatgagtcagagaacttctcgtacttgcagcttatcctgggtcaacaaccttccctctctaattctatcccagtccaactgcttctttttaggatcagtgggacaccaaccagccaaactgtcctctatgtgttcctttggcaaaactttgccaaacttcaaaaaggacagagcaacctataatggcctttgtggaatgtgagtgattatggcagaaaaggacatatgagccattgtgggaatgagaaatatttgaactgagaatcctatccatgtgcatgaaaacaaactgatgcaaatttttatttgtgtgaattttgatagcaatgcaccaacataggctcttcttagatagaataacattgtctttcaaaaggctaaaaaaggtcctcttacttcagctcctgtttactctccctttcccctaccagtggccccttcctgccaagagggcaataatacttcccaaagtgaaatttgcaacatgcctgtctgtggcccataactttaaacagtgttttatgggatatggtcaggggaccccataactatcttcccaaggttcctcactatttctgtcactgaatataaagaccttccttttcaattgcctgtgaaagagttttttaatgggttccccctccttcacccctaacaattgcctataaaatacaattaatcttacttggctttaagccttaaggttccattcttcattcatttcatcttcttgtacccccagcctactttagctcctgggagaggggtgggtagcacaatagtctggtcatcacgtgtgttgaacccttgctgaaagattacttgtatgacaagactctaagcttttcttaggtaccagagttttgttcactcaacaagtatttgatgaacaccttctagatgcctgacactaaaatctaggcactggagatatagcagtgaacaaaaagtccttgatttcgtagagcttacatgccaatactgtcatgtactatcaattcttctacctataaaatacctagggtatttgtactgcattgtatgatcttatgccattacctgtctttagagtctaagtacatcttatcaagactatactcgaatctcatcttttcctcctatccagttcaccctatgcatgatcaggattcaatgctttgaaacagttctgattacattatttctctaactttaaaaaaaaaaatccctcaaagccttctatgccctcacctctattgcttaccaaataaagtcttcaccccttagcctgtcatttaaagtcttccatgatctggcttcaacccacttttggaatgttattctgcaactgttcccttttatggactcgatgttctcttcttcaccttctcaacttgtaaacctctgcctggactattccacttaacttctgcctgtaaaaaagtctacccatccttcgtggcccaggtcacaagccctccccaactagaagctctctctttctccttctgatttgcacaggactgcttacttcttctgcagcctctattcacattctgccttgcgtgcagactactgtcttaactcttaaactgaaatgtgagagtcttggcagcaggaaggacgctttagcctttttggctcttttctccctgagaagtttgcctgtaaatctagtcctatcttttagaagaagagagataaaccttggcaagttgtcattaaaaaaaaattttaatgaaaaaaatgtcagctgcttgtacatgaccacatccctatttctattggtgtaggtaagcatgcagctgaaatcagagctcaccactataaatcaaaattattgaatgacttctagtatataacttaatctctgtgatctcattggtggcttttggactaaatttgttcttgttattttacagagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaaggtaaggggcatccttcttttgtatacttccacaacaaggcttcagcagccctggtctttgcagggctggagctgggaaaggaccctttctcccaggaatagcccatattcacttgtggctcacttagcatcaagtctgtgggtatagtcaggtgactccaggagactctttggacttccttaaatgcagccaaaagagcatagtccggtcccttttgtaaacagcctcttgtattttctcaattatccctggggattgtaggtcatttgggaaaatttcttgggtctttaacagaatgagtgattgtctgtgttttagtaggggacccaacattcaaaggtactcagtgccaaacatcactgaagctcttatctataccttagaaatagcaattctcacacctcaatgcaccccagattaccctggggctctcgttaaagatacatattcctagccccacactcagattctggttaaatgtgtagcatatgagactatccttagaaacgagtaatccaggtgcagtggctcatgcctcacagcactttgggaggtcgaggcaggaggatcactcgaggccaggggttcaaaccaggctgggcaacataataagactctacaaaaaaaaatttaatgaaaaaatattagccaagtatggtagtgagtgcctgtagtcctagctacttgggaggctaagacaggaggatcacttgagcccaggagttcagggttacagtgagctatgattgtgccattacactccatcctgggggacaaagtaagaccctatctctaaattaaaaattttaaaaaggaaaaagagtaatccagtgagaaatcccaaaaccacctggctgagcaccaggaagactgatcaggttaagactgacatgctgtccacttagttgatcaactggctacagcaggcacccatagacttccatagcttccaatgtcttcttacacagcattttctggcctccacccgccccctgcccccacccccacacacaccagtagcaggagtcagggaggagaaactcaatcaaacaattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaaaaattaaattgcttttgaaatttgcaggcttaaaaaaacattcgaaataaaaccattaatggaaaatggtgatgtagtagaagaattggaaatacttactatcgatctgtgtttgatttgtattttattatttttaagttccaaggatttctgataaaagcttatgaaatcaggaagaaaggtaaagatagcttgattttcaattctaaattgcctccaatagattccatttgctgtgaaagtatttcaaagccttttaaaagtgtagggaaatggattttgaaaatcctaaatcccataatttccacaaggtctctttaatttcagggcagaggctcatcccttgattttctccatgtcctacaaaaaccccagctggtttacatttattcatttgcccccactgatttggatgcaacagttctgttctgacctttctaatatagctcactgaggaatcacttgtccccacccccaactcccaagctggatgattcaaaatcatctcgataatttttggggtaaggagagggctatgtttccctgtccagaattaacttcaccccattccactgcagagtctcatccagtctagactattcctttagtccaaatgttcaggggagatggagcctagctatataacactgggaatcctgcctgccctgctcatcatggatcgttcttttccttacatctcttgctaataatgtggtcctctgatatatctacttggctccttgttagcatcaaataagagaaatgataggaatccaccattttgaacttgaatccagcctaaattttcttgaagcatactgtgtgtccacttgatcacattgtctagaagggaacgttactgtttggggagaaaaaaaaaaaaagaggtaagggcaggagagtgaacagcacatctggcctgtcttgtgtgatcctgtccacagccctgacctcacagttgaggtgtcagctctccattttgtctcattgtaacattgtgagccactccagtttaggttattggaaatctttacgtgggttgaccagttagagtgtccagtattctagcagctcttgcaaaggacaggaaaaggcagctaacattattcttatttcttaatgtgactcagtggacttgatgagaaagaactagcccagtgattcatccttctgaggccattgtcttgcagccaaatcagccaattcctagaaatgcatcaagtgggactatttctccccaacagcccagcctgaagtgatacaacccaccctagagatgttgttgattgggatgccaacaggtttccctgggtgtgatgaggtgatgggaataataagaaacacacccagtcctagtcatgacttgaaatctccacaatgtctcagcactctcaaaaagggagataactcatcctcggacttccccatctgcagccttgtgcagttatcttggagcctagctccatgccttatagtaggagccagatatatttggtgttgatttgcatagaaagatactcctgtggccccttccctttataggcccctcagcctgcatcctagatgcttgctccttttttgggtgggtctggggagggaacagggtctcactctgtcacccaggctggggtgtaatggcgccatcacggcttactgcagcctcgacttcccgggcccaagtgatcctcccacctcagcctcccaagtagctaggactacaggcatgcactaccacacctggcgactttcgtattattatttttgtagagactggggtctccctttgtttgccagctggtcttgaactcttgggctcaaaggatcttcctgcctcggcctcccaaagtgttgggattacaggcaggagccaccacacccagccagatgcttgctcttttaaggtccttcagaagacatggggccaatgacttaacttcccacttaacaaatgtcagactgccaaaggatatctgtgaagcaagcagtgatcagctgtagccaaatatctatagccagtatgaggtgggagactgaggaaattgcctgaaattagaggcataaaaggctatcccttcacaagttacccaggagggcttggtcctttccctctcaatcttgacttatcactttccttcctacaccaaacagtgccgaacaccattaagctccatacttatatatgttggtggatcagacagactcatagcatttgacattctgaatggatttgcttcaggatccggaagaaactgtccctttgggaagagcagtaatttttgcatctagcctccatggaaagcaaatctcccaaggaaattttcatgcctggaagcacatccacttgaggcatacaaattttctatagaactgaaaatattaacattacattctactagagatagaactctgctttcatgcattcatttattctcatatatatatatgagaatatatatatatgtggctgggcgcagtggctcgcgcctgtaatccaagcactttgggaggccgaggcaggcggatcacgaggtcaggagatcgagaccatcctggctaacacagtgaaaccccgtctctactaaaaatccaaaaaaaagttagccgggcgtggtggcgggcacctgtagtcccagctactctggaggctgaggcaggagaatggcgtgaacttgggaggcggagcttgcagtgagccgagatagcgccactgcactccagtctgggcgacagagcgagactccatctcaaaaaaaaaatatatatatatatagatatatatagatatacagatatatagatatatatagatatatagatatatatagatatatagatatatatagatatatagatatatatagatatatagatatatatagatatatagatatatatagatatatagatatatatagatatatagatatatagatatatatagatatatagatatatatagatatatagatatatatagatatatagatatatagatatatatagatatatagatgtatagatatatatagatatatagatatatatagatatatagatatatagatatatatagatatatagatatatatagatatatatatagatatatagatatatagatatatagatatatagatatatagatatatagatgatatatagatatatatagatatatagatatatagatatatagatatatagatatatatagatatatagatatatagatatatagatatatatagatatatagatatatagagatatagagatatatagatagatatatagagatatagatatatagatatatagagatatagatatatagatatatagatatatatagatatatagatatatatagatatatagatatatagatatatatagatatatagatatatataggctgggtgcggtggctcatgcctgtaatctcagcactttaggaggctgaggcaagtggatctcttgagtcttagagtttcagaccagcctgggcaacatagggagaccccatctctacaaaaattaaaaaaaaaaaaaaaagcacggcatggtggtgcatgttagtcccagctactcgggtggctgatgtagaaggattgcctgagcccgggaagtcaaggctacagtgagccacaatcacaccactgcaacctgggtgacagagcaagatccggtcttaaaatatatatatatatatatatatatatatatatatatatatacatatatatatttatggactgcctactatgtctgaggccatttataagcatccagaagctgctgctgaagaatctggagaagctcctgagagtagaatatggcccaagctgttttttggtcacagatactactcggtaaacatagccccatggctatgacaagaacaaaggatgcttgatatgttaagtagttcagggcttgggttctgaatatagggttccattttagctccttagcttttaattgctaattctgcattctctttcagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaaggtgcgttggttggaggccctgcttttggttgactgagattctcacctagtctttctaaactttctttaggcatcagaaacataacctttcatataattgtaatgataatatttctaataataatgaatttcattctctcttctcttgaaagactgaaaaggcagttgcttggaagaaatttactacccagaaatatgcttgtgtctaccacacctctcatgtatccctgagtgttgaacttacctatgcttttctaaatagtagagaatttaggctatcatgatgataaggaagaatagtagcagctttcatttatatcactattaaacccatcaaagtacaatcacatccattgcccttttaagacaggacgagaggcaggtgagttatagtggaaggagaccaggttctgatccaagcctaagatgttgagtgatcttggaaatgtgccatatccattctgagcctcatcagccttatctgtacaattgaaagtttagaaaaattatctctaagctcccttctaacactataatcctataattatattattatttattttttaaagataagaaaattgaagtacaaaaatcaaaggacttgcccagattcattcaactaatcaatcataaaaccaaggcctataacccaagtcacttccagcccatcgttttttctatgccagtagaaaatattgactgataaaaaagacaagttaattatttaaatggtagtttttaaaacatgagctaaataaaaatatagtccctaatattggggttgacagaatataggatgggtaatcaagcattctatctctgtcttgccacaggtttcctgtgtgatctataacaagtcacttcacccctctgagcttcagtttccttctttgcagaatgagagggttagagtagattttttggggggcccttacagctccaacattcgaagagtcgatgatttagtcaatcccaggcacatgaatttatcatttcttatgcttctgcaaagcatttttataaacacagatgaaaattcaaacattttaaaaagtaggtagagagctaaattatatacttcttcaacttagtccctcatgactagtaggcaaacatgccctgaatcaatgtgtatttattgagcattttcctgcaggccagtggtactcaaacttgtctgaacattagaaccccttggcgagcttctacatatacctgtgtcccatccccagagactataatttaattgatttgaggtgtggcctgggctgtggcatttttaaaagatccccaggtgaacattgtgtgcagaaaagtttgagaactactgctgtaggcccagggtcatttatggtcttgctactcaaagtgtggtttatggactggcaacagctaggagctggttaaaaatgttgactctcaggcccccactcaagacctactgcatcataatctgcattttaacaagaacctcaggtgattctaatgcacattacagcttgagaagcactgatttatgacacaaaatcttcctcaatgtaacaacccccatcttccagagtacacagggggcagcgtgtggacaggaaggacaggagctatttgataaggtgtagagaactggggcattgaaatttatgagaaaatgtatttattacgaatacagagagaacacattctttttatttttttttttattttttgtttttttgagacagagtctagctctgtcgcccaggctggagtgcagtggcatgatctcggctcactgcaaccttgcaacctccacctcccggttcaagttattctcccgcctcagcctcccgagtagctgggactataggcacgcaccaccacacccagctattcaaactcctgagctcaagtgacccactcgcctcagcctcccaaagtgctgggattacaagcgtgagccactgtatccggccaatggagagagcacattctaaggatgatatggacatccgggccacccagcaacaatgacctattatgacttccaagtctgtggtctcactggatcctcaaaccttttagtatcacatagtggtagtttcatgaacacaattttctcttctgtcaggggtctaacacttaatagtttaaaaagtaatgcaacaagataatttcagacaaaaactaatatttacacaaattacccatgataacataaaccctctcattgtataatattccaatttgaatctcaggccttcagaccaagtcttatttcattgtgtgcttaaaattttattgatgcagatgattcaattaaaaaattaaataatcaaaaagctgtgagaacaagacaaacaacagtcattgcttttaaaacaattgtcctctcaggttggtaatgtttattaaaacatttggtggccgggtgcagtgactcacacctgtaataccagcattttgggtggccaaggcaggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctcaaaaaaaaaaaaaaaaaaaaaattggctaaaaaattccacttctaggaatcctaagaaagtaaccacagacatgcacaaagatatacaaataagaatttttgctgcaatgctgtttacaatactgaaaaattggaaataatctgaaagttcacgaatatgggaatgattaaacaaattatggtgtatctgtaccgtggaatattaatatagccattaaaactcattatagaccaagattgaatggcagagaaagatgtttgcaatgtatttgttaagtaaaaatagcaagctaaagaacaatatgtatattatgatccaactttttgtgttaaaaaagaaagcgttgaccaggtgcggtggcccatgcttgtaatcccagcactttgggagtccgaggcggacagattgcttgagcccaggagttcaagaccagcctggacaacatggcaaaaccatgtctctaccaaaaatacaaaaattagccaggtgtggtggcatgtgcccatagtcccaactactcctacttgggaggctgaggtgggaggatgggttgagcccgggaggtggaggttgcagtgagccaagatcgcgccattgcactctggcctgggcaacagccagaccctgtctcaaaaaaagaaagaaagaaagtgtttatatatgctaagacaaaaaaaagaaacaaaaagactggaggagcatacggcaaaatgttaacagtgaccattttcttgtgactgaattatgggtaactcttattttcttatttatttatttgtattttccaaattttctatagtaaatatgtgttacttttgtatttagaaaacataataaaatttatcatgtaaaaaactgccctccagtatcccagttggcagtatattgaagtctgaatgattaaaccgatttttctggaagagctgcttttcccactttcccactctgctcaagtttgtggagatagacgattgattgagcaacatggaagaagagaatttctgtctcattctgtgtatctgcctctcagtgagccagacatgggtgtctgcatgttgaatcactccttagtcacattgcctgagagtcaatagccacatagccaagggcacctgctccaggtactctgcaactgcagagcatcaggaggcatgcacttgctcatgcattcaatctggaaatttgttttaagtacctactgtgtgcaagacacggttacatgcactgaggacagagatgtgaacaagacaaaggctacttgccagcatgctctttacattctagcagaaaagaaagacagtgaacccaaatcaataaggtaattttagattgtgatgagtgctgtgaagaaaaaccaaacaggatcaagagagagtgaatggggcaggaagcacttttaaaggagtagtcagggaaggcttctctaaagatatttgaatagagtcctgaatgacgtgaaggggtgagaaatgggatgatcatgacattactggcctcttaaaaaatgacacatgacacagaagaaaaggaacaaggcagtgaggagagaagtagatggaaggaagaaagaatggtaaattcagttatgttgaaaagggaaaagagataaataaaattcactgataatccagccaaaagtttcattgtaacaagtgattgcagcctcctacaataacaaactaggaccaatattaaagatgtgagtttcatctctctcttccctttgctctggtagaggctgaccttgctttgcatatcaatggccacctacagggttgggtaagatgtccacttcctgaagattccccaactcacttctcacactgtcgtgccaaactcctattaacctcagtagggaaggcaccagatttaagaggccgaagaaaagatccagagccagcaaacaagacatggggttttattaggggctgacatacaggggagagagtccagtggaggtgggctggacaggagaaccaccttacatatagaaacagtccagtggcagcaggttgggcaggaaaactgcaaccacttgcaaacatcatgcagtttatatagcattttcactgaacactctccccttaacgacctggcaaccttcatctaacccaaaactcaaggcctctatcccctgtgcagccccagggatgagcctggggttcagatggtcctcacagacaaggaaataatctcccagttggccacgcctggattcccaagctcagaacacacattcagatacgtctgccatacagggtcattctaagggtacacttaagttattgctatcatgagcatttactgtacatacaaccacaataccatcccaataccttgaatttccataattacatactccttttaggttatggcattaaaagtccctattaagacttaaaagttgtcccagctggaataatacttctccttcattaccacttctgcaaggaattctggaaggctcaggatgggaacattctcttgggctgtggaaatggccagaaatgacatcaagcacattgtcttccccaaaagaaaatgagagtaggtgaactatagtgatcagaaagcaccttgaagtgcagagtgtgaaaaacggcggatgttgctaagtaggtagttctaaagacaaactttgcttttcttagcattttcaagtaccagccagagttaagtcaataatgagttttgttgtttgtagatcccttcggtcaagtaaattaagctcttgtagggaaggaggtagtggtgcaagatgactcttcaggctactggaagaacttttagcatattacaggtactgccagtgccatcatggatttcatgtcagctatagctgtagccaatattaagctggtgagcaaagtttgagaaatgaatttggctgtcattctaaaggtgataattgaatacacagaagtctctgtacactcagtgacctcttccctctctccaacccatttaaaaagtgctagcacgtggcccttaattacctatcaccaaaaagactggcccaccaagtaaataaatagctaaaaagaaggacaaaaggaggaaaacaaaaagcttgattccacaataatccacaaattgagtaattcagtctggaatcaagagaagactatggttttgtccttacaatgccaaatggtggtgggggtgggaaagctaatcaggttaccaagagacatacaatagcaatttgattacaacttctagtccaaatgtgtctgattggctaacagtgagtctccctaattagagtcacagatccaaagcactcaacactcagtggtttcatcctcaacaattcagatattcttacagatggcttctgttgttctgatttgagtgtatgctttaagtacgcagttcaagagagtactgattacaaggccagcaagcaaacttaactcactgataaccaacaagaagaaactttttaaaacaggggactgaggaaagaggagggagggtggagtgaaatgtagagcttgtgcctttatgcctgcgagctgaaattcaacagtttagtttacacattaaatgatccatcgctgagggacttgaccaattttttgtgtctcccaaccattcatttggcatagcatacatatggctaatctgacatctagattttggcactggtgctgatccggtattattgttccccttacaaacaaatcaaagagcattcagaaatgtcaagccaatttggatggatcctttgggcaagtatatgcacataaatgagtgtcatgaatgttttctaagtataccaaaatgatgtcaggggatgttaaccaaggccctttttcagcccattccctgggcctctcctggcaacactgagctggacagagcatgatcctgaccctgtatggaaattcctatgttctcttaagtgcctaggagatttgtacctggctacatttttcctcatgaaagtccacttctcagtgacagtagtaggggtctagtgttccgaagaactatggattctgtcaacacatggacttcaatcaaagttacgtgctcctttgtgatttgtggcttaatctgtggcttgttgcagtggcagcctaagctgggctaatgaagtatgggtggaatttctgtctctcgaagaatgttcttgttaattgtccacttttgataagtgtgagatgttatgaacaatgagatacataaatgcagaagttcacttctagctttagaaaaccatgacaaaattctacttgcttcctgattccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggtgagcaagacaacattaatttctcatctttgtaagggggcacagaaaaggatgagaggactcactttaattttgcttcaacctgttccctcatttggattaaaagttctttttgattgcttagaaactgacatatctaacactattgtcattatggcctttcaaatttaacgatggcctgtgctaaagatcaagtactgacccttgggtttccaaagctgcctatttcacaccaccaaaagctggagaagcggttctcaaccctggctgcccatcagaatcatcagggagagttttggtttcctttaaataccaaatatctgggccctacccccagagattctgattagttggtctggagtggggcatgggcatcagtgtttgttcataatgcttctcaggtgattgtaatatgtagccaggattacaaactgtcaaactgtagtctgtcattctttccagaataaagctcaacaaccatgaaaacccattcattcagggcaaagctaagtccctaatatcacgatgtgtcttctggggtaaaacaaatttaaaacatcatccctgccctcaagaaggttatagtcttactggagaaaccccagtcacaatgttcaattccttttctgattactcacagtgactaccacagcaagccacattctgttcattgtgatcctacagctcttctaactttttgtaggctcaagactagtgcttatttagtgtggtcaaggttcctcacaatccaagtggataagtgagatttcagctggaaaatatacacatctttttgctattggctctcacataaggctcaagagtactcgaacttctgtatgcatcaccattacacagggagctggttttaaatgcagatacctggccccatcccagagataggaattcagtagaccttgggtagagtccaaacatttgagtgtttaacaaatagccagatgattctaatgcaggtggcacttggaccatgctttgaaaaagactgctcagtatttatgaggctttttttctctccctttagacaacagcctttatctaaagaatgcatttctccctaaaaaaaagatgcttgaacatgtatatattcactcatgcttatttttggtctatgccttggagtgttgatttgccatctttaactccctagctcatccataacaggacacctaggactaggcactggtttgttgcgtttccccagcagtgggcccactattcgtcatcccacatctttcgcctctcagaggtgtgcagatgaatttcaacttgctaatgtagcgtctaaatatcctcttgttcacagttctgggttatcaaggtctatgcttggtggacacagaaaaagaggcttaatctacttcgcccatttaagtgggctggtaatatgttgctccttcagtataaggcagttgtcagttgtctacctgttattgtgataaaagctattcaggcaaggttgagactgtggagagcactctattttaactctccccatttatgaataaggaaggctaaaggatctgtgaatatttcccaaaggaaaatatgcttttcagtgagttcaagaacaagggtggcttctccatttacaaaaccaacctgcctgcaatcccactgcaggctctcagtgcttagccaggagggcagcccagcggtttggcatggacacagtctatccaggttgggggcaagtgcagaatttctaatactgcctatggctgcagaagctccagtaagcacttatgctagattccatgtggctttccctaggagagagtcccatggtcagcagcactatctcccttatctccatccactggagaagccgaggggaagccagtaagccaaggaaacaaatggagtcaattataacccttgagccatccaagttcctggttaagcacattacacagcccaactcgatactcttaagccctagtaatgaaatgatatgctgagcctgagcagaaaaaaaggagttgatggttccagattgagtgcctgaccatttgctccactttttgcttggccctaggcattctccagcacttccatattgagaagatctccaagaggatgtttgaggagcttcctcacttcaagctggtgaccagaacaaccctgagtaagtagtacttctcttgactgctccctgaaaaacacattcagttttcaatttagcatagccacagctaaagtccctccgcaatctcagtgaacattagcactgctcagtatcaacactaaaggatgttccatctctcttctgggtgacttagcagtgaatggggtgtctgaatgtaatctgaagagcttggacatggtgaatacaaacccagatgtagtctgagcataggatacctcaggtcaaggcttcctgaatgtctttaatgaaactgctaagcacagagtctcaagagggttggagaaagctcataagattccaggtctggtatatttatggagacttcacatctggaagggtgtatcctctggtggtgggtatgagaggcaaagagaaattaaaggcatatcaattcctgtgttatatgaaagcacttttactcctggggaactgcccctgggtggtcatgtttccttaaaagcattcaggcactcaaaaacacttgcagctctcccactttccacactagatggagcctagggactaagatacttctaggcattggggcgggtgttgagcacttctaatgggataaaaggcacacagtttctatccacagggaattataatggatgagacagaacatgaaaatgacttcagtatgaattagtatagttctgaggagttaaatatcaaagtgctcaggggaatctgcaaagaacaatgagatgagagccaggtgggcttagtcggggaaggcttcggggaggaggtgtgttttgaaagagaagggtatgactgggcaatgggtcaggaaatcagtccaggaaaagagtgcagcctaagagaagactcagacaggagcaaacaggaaatgtgggtaggggagaggaatgatcacaaaggccacagaaggtgcactaaaagattagaagatttggaggtagaaagtagtcatagggcctgaaaaaaagccagtaaaatgttcaaatgtaaggcaagtagcatctgtagttgctgcaaatagcatagagatatcaacatggtgctttggaaagatgtctttcggctatcagatgcatatattacattaagcacacactttgacgaagccagattatgaagtgcccaatttatcatgctaggacattggacttgatctccaggccagagaatgccagtggaggtttttaagcaagtgaatggtgcattcagatctgctttatttatttttttatttttttagaaagaggtcctcgctgtgtggagtgaaaggtggacccttattaagagaagtgggatagtctgaattaggaactaattatactatattaaatcaatgagacgggaggagacgtcactgtgagaaacatttctgaggttaaatcaacaagatcagcatcaaagagagaaacgagtttggaatgggtccgatattaataactcgactgggtgaatagtaataccattcaccaacagggaaactgtgaagaataagcaggtattggtgaaaaagagtttcacttggaacatgtttaaattaatatgcttaagagccatctgagcagagttagggtccaataggcagctagaaaaagagccaaggcagtcagttgcttgtctttggcaggactcatagaaaataacaggacagtatgagaattcaaatggaaaagttgggagtccttacatgtgagtaagaaaggaggcagagtgtaagatcctaggatcaattatgggacttctgaagttacatgttttagttcatactgtgaacaaggctttgttctaggttccaggggacttaaaagatgatttagatatactctgtgcccatggcaggatttggggtatataatggagtagaaggtatgtgcctcaaactgtgtgtagctgaaagaagttggtatgatcctacagggtcacctaggagcaaagaagaacaaacccaactcttttatataatgtgcctagcagagcccagcacattatagggcttcagtaatagctggttccttgcccaaatcctcttcttgtttttttgtttttccttctatcttcccattgagtcatagagaatggggaaaagggagaaatccaagggagaaaggagcagagaaatcaggcccatagggaaggtgggtcattattctcttgtggctaaggaaaagaaaaagaggttcaagacaggtttgggcttaagaggagttggcttaacttggactaggagttctccaggttgcagtaccatgagcacaggaataaaaagaagacaaaacacagtatccagggtgggcagagacaacaggggatggaagggctacagccaagtttactctgcgtggaaagggattccatggggtatatgagaatggatgaggaaccatgggaagggatttagggtgctaagggggtataaggacagcatgtggacgtaggagaaagcaacgtcgagaagtttttaacaaaagatagcaggaatagaggaaagagtgatatataatcaaatagtaatcaagtaacccaaaccaatatttggggaccctaagggtaagcaaagccccagtaatacagtaggtgccgttttccaaagtgcctttttgacctggtgccaagtaagctgcctaaatagctaacaagcagatattgaagcattttgtaaatgctaaatatactgtaaaaattccaagaataacacttaggttttgctcttgaggaggggcagttctatattattcttgggattcttacaaatgctatgtgttgaaatgaaaacttcatttcccattttccatatctgctactagaaaagtgttttggggccattttttgaaaccaagtgatatttgtattccaaattccctggtaggtccatgagtaagtgggtaagcatggggtatattggttctattcctaatttgctctgctttcctcttacacactcccggccactttgcgtttgtttgccttttaggccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctcccca

SEQ ID NO: 3636 - DNA, 119762 bp, human
ccagacctcggacgagagcgccccggggagctcggagcgcgtgcacgcgtggcagacggagaaggccagtgcccaggttagtgagcagtgcccggcgcccgcttccctcacctccttttccagcctttgcacaggtgggttgccttctcttggccggagccgtccctggaagtttccccagggtgccccaaattcccctgccaccccaacctgttctgtgctccagcagttagcaacctggatggaggtggggcccaaggcttctgaccaaagcaagttgggggtctctgaattcgaactcacagctcgtccctccccactcggcctgcatttctttatgctctggcgctttgagaggtcacttaggtactccaccctgagctacccaagggactctgcagtccccttaatcactgcctgtattcctgagcctgttttctcattttgctgatgaatacatggtaaagttaatgtagcagggtagatgggcgaaaggctccctatcctatcctctggccatctgcctcattttttgtccctgactacgggggtcagaatttgagacactaggctctggaagcaacgtggtatattgccagaacatagggcccggaaagcctgctttccagtccctcccagccctgccactaaagttatttgagttctctgggtccccccagtgcccattttgaaggtggagttgtgtggaatgaaatgaaatgatagaaaggtgttttgcaagccaaatgcgaggcattgtttgtcagtcataagcagcaatgaaagcatttcctccaacaagagataccctgggttaaaactgccattttcagtggcaacacaccaccagttaactgaacttttcttgctgggtggtagagtggggagaggatttcagctgatggacaagggcctgggactccagtgtctttcttattgtttgtcggaaagaaaattgctaccctaggggctgtcccacagatgatagtcaatgtgagattacaaggtcagtcaagcctctcaggaggattaaagagacactgtggggcgtgaagaactggctgacatgtgttcatcccttagccttcctgtggggatgtctctttgcttctgttctacccaggagacctgttctgaaagtgggctcctgacacttgatggcccagattgccttgcagtcacagctgggcaaggagcagttggtccctttgcttaacgcagatgaacaatgtgaatgcttgtttcatggaagcaccttaataaatacctttcttttggtacttgatacatttctctttctcttgtaaaacacaggaactctcccatcccacctccactacctgtgttagttgcagggttttgtttttttgttgttgttgttgctttcttgttgggtcctggatcccctgaagcatgtcaatggctacatgtctaagtaacctgtaaaagagccagtgcaagttcaatggcacaacagcctgtgtgaagcagacagagagttaatgcagaaataactccagttaactgggtcaaagtataatttgaaaaattaaggacagtttggctctttgcaagaataagagtcggctaagttcgctgagcaatgcttgctagtgtttactgctgcagtcccaacacatgttttgaaccacccccttccctaaaagaaaaagctgaagagataaagagaaattgaacagtgaggagatctggggagggaactcttcttggttcatatttctgcacagaatacaaaggcaggacttcaggatcttgtaaatcaaaagtgaatatttataaagcgattcattttctgatgttctccatcacagcctgggaggccacacagatgacaggaacgccaaaggagattaattgctctctagttaccaacttttttatttgctcataatattagttgggacctaagaaaggcaaaaaaatctatgagctgttttcttgccaacttgagttatgaagcaatgctacagttcaccgaatcgcccaaccattatacaagaaaagcagccctgttgattctcgcatggggagaccctaaaaccatggtttcagaaacacccgttgaaatccatatatgaatgtgataaattggatttcagtggttaaaaatctttctcttttggaggcttggggaataaacttattagaataggctcaggaagaacctcactgaggtgggtagctgtgttaaattgttaatgaaaatgatttgtttcgaataaacgtggtagccctcaagggacagtaacattctgagtgattgtaagtgggccacaaactcacagaggggaccaagacatcagaactcaggtctttagatgggtaggaacatgtcctgagagaatttggttctttaaggagcagggaggaggtaaagaaggaaggcagacggtgctgcaaatcttgtttgatagcacagattactctatcatcagttcttccttggttatgcattcataattgaaacagtggattttgaatgacccaggcaacttcatagcatttaagtaggagctgtagcatctacttcagagcccaaagatattcaactctccaaaatgatcgttttgcattccttcaagttctttatgtgcaatatttaggttggactttctggaaagatcaatgagttcatttcccattcagattgaatctggtgtttttagaacatttcaatattttcagatcacccattggaggaattttgcaaactctaacatctgtggaaatgatccgtgactagatgtgagctacagcaaactttctgtgttccaaggttcaaaaggtttaagatttctaccccttatactgggaatgccaatctcatgttttgaagaactgtagttgttttaatggtcttttgcatggtggtgcaaggtgaacaaattatctatttaatttgcccaatttcccctaaaaatggcccatttaaaatttccattttacaatggacttcttgggggaggaatatgttggaaccattttaagcagtaaaacttttcaggtgtttaattgcatccatttgctaattacatctatcttttgcaatattagttgccaaaccaaagatccttgtagatctcatagaggacacaggagaaactgatcaatttgtacttcattccaaaaggattaaaagtagtcttgaagctaagattagttaactttcatttcagaaattgcttggtctcatgcttgttacttttaccttgtttgctaaaataaccgtttttgcaagctaaagtttcccttttctcccaaaaaaatctcttgagaaatcaactttaattcccttagaaaggaagatttcaaaatttattttcattttcctataacttgcctgtaaggacttagcctcagctttggataggaatgcaccctcattcacttgaattttcacccacaagccttgcaagacaggagaggcaagtcctttatcttgtgcaggcagacaatacttacacttatgtaaattctaggacattttttttttattctagcaggttagaagcctgagcatcagtgacctctatcatttccagaagatctgtgttaagtcttttttctgctttcttcccaacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacgtaagtgtcttgcatttggaaaataatacactttttataatttctttgaaaatgtggctataatctgtagcaattatgatttagcccaaatgtggccgtgccattattctaagagaagaaagtgaatgttactggtttatgcatgaattgataaaagaatgagagctttgaatcaggccaactaaatttggggctgtttttctgattatcatgtagtctttgtctcatagaacatatgacacattagcttattttctcttccctgttctaaactatacaaatctcattacattttacgtaactctagaaatatctgacagatgagctggaattttcccaaatttcagactcttcagcaaaggctttcagtttatgaaaaataatgacacagaaaagaaaaaaaaagaaaaagaaaagcaggctctgcctattcccttatgccgaaaaacgaggaaggacgaaaccttcctatgaactgggctcagatgaaaaatgttttgaggaaattgagattccagggaccgttagcaaattggatgccatttattgaaaagaacatccccgcaaagccagggaatatttctagaaagtcagcgatccgtgtaatgggctaacacattggagaaagcagagagtggcaggaagtgggggcgggggggataattaaccctccttgctgccacgtttaggagatttatgagtaacggtcgacatatccgttcttgctgcctttgcacaatgtgggtcttaccttctttgggccacttgcagccatctctgaggtagatgcttgctctaaatttgaaggaaaagcctaagctctagttcccctttttgacagcatcaaaaaaagcacaaaatggaattggtccaagaggggcattctctgcttcactgaacttattcatgagaaggagctgtgaaaatattcttggtaggaactgaagcagcatctgaagcccttcacttaaacctttatctcttttatcacataagttaaatagatcaggcagaaggcttgctgacaaggagaacagtgccaagcctattccatccttaagtgtgtttctgtcccactacaattttcatagtaagtgtagtcttcttcctgggagaaacagtgtttaatagtgtttttgattatgcttttgagcatgagcggtgtatggtgatatctagtatgattgggacacaaaaggaagtttagtggggcatgatctcagcaaggaagcttggatcagcctctactcttgtatccctcaaattgcttccttcttcttccacttgaatatagttcatctcagaatcctcctcttccagaagccttccttgatttaagtggatgtgacagaagcatccatgcattctcagctcagctcacaattagctgggcttagggatgaaatattactcaataagtacaatgtacattatttgggtgatggttacacttaaagtccacactttatgcgatatatccatgtaacaaaactgcacctgtaccccttaaatttatacaaaaaaatcttcctgtcttagagagaaacttcccttatagcctgttaatgatgacctcatggggaaagcttgtaactctcagaagaccatctcttatggaaagcctttcatatttatgaagaattgaatattgtccatgaaacttagacaaagaaagatgtgacttaaaaaaattacaaacccaaatctactactttctaatatttccttgtgctgatgaatttgtcccaagcccttttgatattcaattggtgccaaagtgattatgtaacagatggcctagggcaccagatctggtccagtgtttcaggcttattgtcagatgatgacgctaaggtcatggtccttcccttagtgagccactgagcatcattatgtgtgtccatgcccaagctaactgttctgaagacatgcaaaatcatctctgctaaagggaaaacctcaaagcatatgtcctatatatgctgtcttgatatatgcatgcacatacacaaacacacacaatatgcatgcacagagatttatattgcagctctaacagtgagaagtcagaagcagtggaaatgtcagttcatagataaatagttacaaaaatgatccaggtaatgcaatataatgctactattaaaaacactgtttattgaaaatttggtggccctgggaaatgcttgttaacttatttttaagtttcttaaattataaaattaatatatatgcttattatacaaaacaacatgaaagcatctgagcttcatatggaacatgtgtccctaaactctcattccactctcctgggataaccattattagtggtttgctgtgtgatcttccaaactactttctttgttttataaaattatatatacatgcctgtatgatattttattttacaaaaataggatattatatacacttttctgtgatttgcttttgctcaataatgtgtgtaggacatccttccatgtcaatacattgcaatgtaatagtgccatattctttctaatgcttgcatggtttgcagttgcataagtttgcattggtttatttaaccagtctatatttgtagatattgaggttgtttccggtttttgctattaaaagtaagacatttatgaacatctttaggcacttattcaagtatttgtgagaaatagtcgaagtgcatgttcagttttaatcttcataagtactgtcaaattgcccttcatataagttgtattaatttatgctcccaccatctatgtatgaaagtccatttctaattccttcaccaagattataatcaatctttgtattttggggccattttaataggagaaataatctgtaagttttgcttggtatttttctctttctgcagcatcttttcgattatgtactagttcaattttatttcttcagtgaattgtctatttttagtttggttgcttgtgatatttatttgttaaaaacttacttattaaccttttatattttaaatattatttttgatatgccacttgttttaatctttaagttgtatttttcccatatagaagttttaaaattttacgtagtcagatctgtcattcattttctgtatggcttctggatttcttattcctaggaaggtctttctcaccctatatttttatattttcttctactgctgccataattttatgttttacccatagttctctattccatctgaaatttatattcctgtatggtatgcaatggggaactaattttttttaaatctccggatggtaggtttatgaatgttatttttgctcacttttatgcttctgtctattccaaaatttccacaattggcaagtttcacttttaaaacaggagaaaagctctttttaaagtaaaagtacatcttatttcccatatttttactgtgcaactctagagacaagttggtatgtgagtagatgaagaaacagaggggttttctaaaattaaaaaggaaagcaactggaaaaacttcagaaaatgggtaagagtaggcctgggtcataaacccttcacgtctctccttgtctgacaccattttaccaaaagaaggcaaagttttttatcttgcaggggctggttagaatataagcttttaggtcaaggaatgtgttttgtagcctgtttgctctcctatttggggcatcacaggggaatgacgggggatgccattatggtcaaagatgctcactcaattgattcagaaatctgaagaggtgtggaaaaaacgctttgtttgtggaaagctcatcacaaggaatggtgaagatgggtgctgccacttgctggtagctaattagccatagttacaatttctcttataagagagaagacaggctcaggaaacccgaaaatactgatagtgcattgcaatggatgaatgagccatttgttgcttacataaaagtttgttactgtttagcatcagcaaggtttgagttctttagctgggaaaaggtccttgtgtataactccattatgctctgttgttaaagttgtagtcaatgaggccaggaaactcttttgaagttcaaaggagcgtaacattcacagcataatattcatgcaaatatgggataaatgggctgaagagtttgcccatttggcagatctaacttaggtaatgaactattgatcaaagtgaggttgaagaattgaattgttaagaatattcaattatgtatttctaatagaccagcctgtgccaagtctggcaaaggttctggagagagaaattgttcatgtatttcatgcagtccactcctgctttacaaggtagttaactggatcttcaaggagctagattgtcacttatttttctcctcaagagaaaagcttccaatattcagatttggctaaaagtgggcctctggacttctcaggaaaggcaagccaccaaaagattgaagggaaggaagaagatacttagaaagtttgaaacatgtgaagcccacttagaacttctctattgtgagagccagccaggaaggcatgggttttcctcctccagattctcccttggtcatttgaggtgattattgagcaagcaaatgcgtggacctgttcacatcttagaagtttaattaagtggaattagacgaaaggaatacctaaaattagatagcttaatgcttttcaaagtatattcttaattgttttttattttggtgagggggcagtaggttttgtcatggaggctctgtagttagcctagatccaatccccagctccttgacttacttatgtaccttgggaatgttacctaacctctccagctttcgttttcttatcagtacagtgggggaaataatagcataatgagcgtgagcattgtcatttgaagaagaaacgagattgtgtacaccaagtgctttgcatagtggctggcacatagtaagtttttcataagtagttgctattagagcaactctcttacaagccaaagatattatccccttaattttaaggtgagaaacttgaaactcaatgaaatcaagtgactttgtacaaggacaagcagcaagtcccagccagagctagaaccaaaacccaggtctccgaattaagtgttctgttcactatacccatctgcctcttggaattctttgaggaagtcagttcattgtcttgaatagaagcccagtcctttatacatggcagccacttaacacataagagatgatccaagtaaatgaataaaaattttctaacccaaattcctaagagggatagtatactatttgggagttaaaagactgagacaaggactaaaaatttttcaggaacctacatttgctaagccaaaggaaagtagtgaggaaggttaaaagtatgtgcgtctatgtctatgcttcttatatttccctgacttctcagtaggattggaatgtcttcatagtttaatggaaagaggactgtgcttaaagtcaagagacctggtttccggtcagtcttcccttgtttgccgtgtggtattggttgaatcattcgtgttctatgaagtaaagattcactacttacaaattgaaaagaattcttgccttctggactgaaaactaaaggagaatagtataggggctggggaggtggaacaagggaaacgaaggccctggttttgtgtacttggagcaaaccacatggatatttaatattgtcacaaggtaattgcaaagaatattttatccatttaagatttatagcctgtctgcttctagaaaggttagatacacattagagatgaaagaataggggcaagataatgtttttaaagatgaaataaaatagagatcatctgaagaaaatagaaggaatagatgtttttaacatttggtttagtagattatagcatttataatgtaaatctggcttatgcctcccaaaaggatgaaaagagaaactttgggtttgttgtcaagagaaaatttacagtttcatctacagagattattcccacctctaacccactcaagcagtattgatcctgggatgtttgaataaggcacattctgggtaaccttggtttcatagaaaaaagaattgtctggcatttctttactgatgctttgtaaaggaagaaggcaaatattaaattataattcaataaaggactttctataagcagtaaggaaatgcattccaggtactttccctttgaatgatctaaattggagaatagaacatggaaatgttaaatagatgtttaatatgtctactagactggattgtcaactatcagatgccctaagcaagctttctattaacatgatttgtttctgattttaaaaatagatgctcattgttaaacattcaaaaggtacataaaagtatagggaaaacaaaaatgaacagtaatcacaacgtgtatggataaccatagttaattgatatatatatatacttgtagtctttttttctaagctcagttatacaaacatattagtttacaaaactgaagcactttttaaacagtatggatcagggtttgtttatttatttatataaacttaggggagacaagtgcggttttgttacaaggatattctgcatagtggcgaagtctgagcttttagtgtagccatcacccgaattgtgtacattgtatccaataggtaattcctcattccccatacttcttctaccctcccacctttccacatctcctgtgtctgtttttccaaaatgtatgtccatatatacacattatttagcttccacttgtaagtgagaacatgcagtatttggctttttgtttttgagttgtttcacttaagatcaattcacaattggagtctctaaaatgcacttgtagtaaagacaacatcccatgttgtctgtaagtgaaagctgggcggtttagacacgagttgcaggatatgcaaatttgattctattgtgagaagttcaagagctcaacttttattctctaccaaagggaacaaaagtattcctgatcaaacagaaagcctcccttcacagagatttgcaccgctaaagtgctgataggaagaacagtttggttttttgaacaggcatttttatttttgcccaaagttctatgccatatgacatggaagagatgatattagcctgaaaaaatattcaggtcaggtttcatcagcttagcagcctttctgtaaaaggatctcctcatggcctcatagtagacactaatgagaatatcatcaactcccagttatttatgctaatgaaagatagaagggcacaataaattgaaatttcatggaaaatctccagttctcatcttaatggtgtcaccttgcttgactgccaaacttctttgaattatggacccttttcttttcgatgggtttgcccacctgctaataggaaagtaaaataaccacaaaacaagtagtgagagggccatgctgtgggaggcccaggcaggtgaatcacgaggtcaggagttggagaccagcctggccaacatggtgaaaccccatccctactaaaaatacaaaaaatttaggtgggcgtagtggcgggtgcctgtaatctcagctactcgggaggctgaggcaggagaatcacttgaacccaggaggcggaggttgcagtgagccgagattgtgccactgcactccagcctgggtgacagagcaagactccatctcaaacaaaaaacactcagtatataattttgggcaggtgatccagcaagtaggaaaaagctaattaacttctgaatgaaggaaaaagctgcatacacaggacggagaatgttgcttcttcatgactttctttttttctctggcgtctgcaggctggaaatgaagtcttaaagtcctgagaaaacatgaaacagagtcttcaactctagaaacccaattgtcagtgaaataagaaacgttttccccttaactactacatcttgcccttcctacattctgcttcaagtttgataaatgacagaagagacgtacttatgcctttattttttcttcactcttctagtagccttttaaagaaaaaaataattaaaaaggaatttgtttacttgatgtgtccactcatataatgaatagcagagattcatctttttttccactgaccatgtgttataatagaataaatattattgtaatactgacatgacaatgtgtctacagtaatagcgcttatcaaaaacagttcttgggaatgttttcttgattttggactggtgatgaagttactgacctttgcctaatcctgggagctagtcagtaatgattggcaaaacattgatggcatagtgacacgtatctgttgttgtttactttttgtcatcattgttcctattaacaggggcccctaaagtagcagagatagccacctctaatgagggcaagctgatacatttgaaaaatagctgtgatgttgcaggttgaaggtccatctcacaagttagttggaattcctttgggaccaaattctactctcagacaccattagttagcagtaagtcatgcatctgatttgtgctttttgtccaagatgatatactgggattttatgtgttattgattatactgcataactcattaaattctctccttggtaatgtcaacaatttttaaaatttcaaacttataagcatatactgaaattggctttatcatagtttctcaaatttggtgattgtccaatgtgttcatggtgaaattagtataattgtgctaaccactcaatattggacaaccatgctcaaacacgtcttaaaaattatggtgttccagcacttttggaggtgaggtgggtggatcacctgaggttgggcacagtggcaggtgcctgtaaccccagctactcgggatgctgaggcaggagaatcccttgaacccaggaggcagaggttgcagtgagtcaagattgtgccattgcactccagcctggacaacaagagcaaatctccatctcaaaagaaaaaaaaattataatgtttacttttttgatatgctataaaaatatcagtgtcagtaattgcagaaacattgtttaatagcactaatggcgtgaccattcagctccttgtctgccttcagttcctaaatttgctccttccaggagttgtaggtttctgtctgggtcataattagccaaatcccatgttgctgagataataagaccaatacacttgatgaaataccattatgttttcattttagatcaggtttctatcagcagttagtgtttgagtaagatatttgcatcctcaagaagcatagtttggaagacactggtacgtgggataaatgccacgtgaacaaatgaggaaagtgctgttaggtttaaagagaatgaaaaataacttttagctggggtaatcttgtcttcccatcaagatttcaaagcccttaaaagcatgagcactattttatacattatgtgttgtcactgatgtaaatacaaaaatgcaaaatagtctctgccagctgcactattttatatagtctttgttgagtattacttgacttcactacaaacaacattgatttttaaaaggtgattaaagttgtgttaaaaaggtatagtggaaaggtaatttgagaaaaggttagtaaagaatatgtggaagctctttactttccaagttctaaaaacagtgacctgcaccttaccaactacgtagcaggagaggcagaattctgtaaaggttatagtctttggttctaaagctacaagatataggtttgaattctatttccataccttgattagtcatgtcaacttgggcaagttaccaaacctctctgtgccattgattcctcagtggtaaaatggggccaataatgagacctaccttgtagggttgttgtaagaatttagtgaattcagatatgtacaacccttagagcagatcctgcctcataggaaatgctcaacaaatataacttgttgtttttgttattgttatcaccgttctcatctggctctatatttttcttgcagttggttccctggctgctttttacacttatcatctacctcctagcctttgagctaaattcggggcagaaaattcagatggctcagctttcaaactttgtctaataatactccttagaggctgaatttgggggaaaatgtaatctattggctgaaatcagttagttgggttatctgtggttttcaagaataatggtgaactcacatatactgaagcgatccatttaatagtgtcagtgaaataatctatcttaaatattttttagagaatagatagcaacttgcctgaaagttatatattaagaataccttcctcatcacatcaatatatactgtccttttggaaacagactttcctgcaagtcagaatcttaaacagtttggaagagagttttagaaatgtgcaaatgaacttgaaacccacatttgtatagcttgttttatttcagtgcttgagtagtcttttcggtggtctttatcttttattatcccctttcttctttatcaagtaagaaaagggtaggtcattcaaccatgcagaacatatagctgataggaaaacatattcagtttcatattttaaataggtaaatattatgtcaacctctgattgagctaatctaagcaagaaaaataattcagaatcaaacacataatatacagttatagcttactctgcaatgtggatttaaacctacaaagtaacttttagcttacctccattcaagttttagtggccccagactcatataagtatgaatatttatgctaacctagtaatgccatttgaaggagccaccttgtaggatttgcttccacatgtatactcagattctttctgaaatgttgaaataagttgtatatgtgaaatgcaaatcacttaagtgtttgtcagtgagactatacatttattgtacagaaacagtaactctcatcccaccgaaatggtagagaaagatgccttatttagatgttagtcttgggaaattcataatcatctctcatcagttaaatatactgggattattaaaatatttaaaatatttcttaccatgtccttgaatgttgtggagcagaagtttaatttgtatctataccaaaaaaaaatgtattgctaagatttggctgaaaaacactaacattctgccttaaaagtatgttctgttttctttcaattaataaatattttgagcacctacttttagctcacaaatagagattaatataacaatgttgacgatgatagtatcataaaaggggaaataaaaattgttactaaaatgaatatatattcaaccttgccgataagaaaaagaaagaaatattggttccattttcccttacttaaccaagttgccaaaactttaaacagtccattgctgggcattctcactcactgctaatgggaaagtaaattactgtggcttttctggaaggttgtctggtaatgtaaatcaagaatttgaaagtactcaaaacatttgacccaagaaatctacttctaagattttgcattaagaaaatacctaatgttgcaaacagaactttatatgtaaggatctttgtcataatttatttaatggaaagaaatggaaacaacctaatatcccaagataggggattggttaataaattatggttcagctgtgtattggtgtagaactatgtaattagtcatgaggtatgggtaaactatttaatggcacaggaatgttctgatatgttaatttataatgtagtttataaaatgtatataatatatgctgttaattttgtaataaaaccttaatacacataacccatggaaaaaaaagatcagaaagagcttccagtttccagtctgataaatagtgatcttggaggttgtcattcctgttgtcaaaagaaaaaaaactgaatgaactgaaaatcaacaatagatgcagtaagatgggaaatggaaataaaaggtatacatattgggaaggaaaaaacagtattacctttgttcatagatgacatgtttttctgcatagaaaatcccaagggatcaacaacaatgacaaacacactcctgttactaataagtgattattgcaaggttgaagtatacaaagttaatataaaagtcaattgcttttctgtctaccagcaattaacaagtggaatttgaaataaaaaatacaatattatttatataagcagtcattaaaatgaaacaggtgtaaattcaacaaaatatgtacagtatctatatgatgaaagctataaaattctgatgaaagaaataaaaaactaagtagaatggagagatactccatgtttgtgtttaggaaaactcgatattgtcaagatatcagtttttcccaacttgatgaatagatgcaatacaatatcagtaaaatcccagcaagttattttgtggatgtcaacaaactgactctaaagtgtatatggtaaggcaaaacccagaacagccaacacaatattaaaggagaacaaactcactacccaacttcaagacttactattaagctatggtaatcaaagttatgagatattggcaaagtaatagaaaaatagatcaagggaatgtaatagagagcccagaaatagacccaaataaacatcatcaactgatctttaacaaagtaattcaatggagaaaaaatagtcttttgaataaatgggtgctggaacaactgggcatccatatccaaaatgtaaataaatctagacatagatttcacacccttcaccaacatttactcaaaatggaacacagacatgagtgtcaaatgcaaagctaaagaacccttagaggataatataagagaaaaatttaggtaaccttggatttggcaatgacttgcttttttaacttttagtttaggttcagggatacatgtgcaggtttgttaatacaggcaaatgtgtgtcacggggggttggtgtacagataattttgtccccaaatactaagcatagtactcaataggtattttatctgatcctctctctcctcccaccttcatgcctcgagtaggccctagtgtctgttgttatcctctttttgcccattggttctcattatttagctctcacttataagtcagaacatgcagtatttggttttgtgttcctgcattagtttgctaaggataatggccttcagctccatccatgttcttgcaaaggacatgacctcattcttttttatagccgcatagtattccatggtgtatatgtgcacattttatttatccagtctactgttgatggacatttagattgattctgtcttttgtattgtgaatagtgctgcagtgaacatatgcacacatgtgtctttatggtagagtgatttatattcctttgggtgtatacccaataatgggattgtttggtcaaatggaagttctgtttttaggtctttgaggaatcaccacactgctttccacaatggttgaactattttacatcctctccagcagtgtataaccttcccttttctccataacttgccagcatctgttattttttgactttttagtaatagccattctgatgggtgtgagatgatatctaatggtgagtttgatttgcatttctctaatgatcagtgatactgagcacattttcatgtgcttgttgactacatgcgtgtcttttgaaaagtgtctattcatgtcctttatctgctttttaatgaggttatttgttttttgcttataagtttgtttaagttccttacagattcttgatattagaccttcgtcagatgcatagtttgcaaatattttctcccattctgtaggctatctgtttactctgtggatgctttcttttgctgtgcagaagctctttagtttgattagattccacttgctaatttttatttttgttgcagttgcttctggcatctttgtaatgaaatctttgccagttcctttttctagaatggcatttcctaggttatcttccagggtttttatagttttaggttttacatttaagtctttaacccatcttgagttgactttttgtacatggtttaaggaaggggtctagtttcagtcttctgcatatggcgagccagttatcctaacactacgtattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctctttgatactataatagtggatacatgtcattatatatttgtccaaacccacagaatgtgcaataccaagagtgaaccttaatgtgaattttggactttgagtgataatgatgtgtcagtgtagattcatcagtggaaacaattgtacctctctggcaggggatattgataactggggacactatgcatgtgtggcagtggtaacagggggtatatgggaaatctctgtaccttcctcccaattttactgtaaacataagactgctctaaaaaattaagtattaatttaacatataaaaatacataaatactttaaagtatttatataatactttccctccccccacagtttatgggtacatcaaatttctcttcagcaactgcaagcaaagaaagaaaggagtgaaatatttaagttgttgaaagaaaaaggctaccaatctggaattctgtatttagagaatttatttttcaaaaataaatgataagtaaagactttctcagacaaaaagtgagagaatttgtcaccagtagaccttccttgcaggaacttttaacaaaaattcttcataaaaagggctaccaatctggaattctgtattcagagaatttatctttcaaaaataaatgataaataaagactttctcagacaaaaattgagggaatttgtcaccagtagaccttccttgcaggaactattaacaaaaattcttcataaagaagaaaaatgacataggtcagaaacttggatctacataaagaaaggaagaacattagcaaaataataagtgaagtaaaatatttttctttttcttaattgacataataaaggacagtttgttcaaaataaaaatagcagtgatatcttacatgtctgtagcttatgggaaagtggaatgagtaacaggtgtaataaggaatggaagggagggattgggaaaattctgttagaacatatctgttctacacatgcagtggtatagtgttatctaaaagtaaaagtggacttggattaatgtaaatgtatattgtaaactctagggcagccactaaaaactttcttaaacgaagtataattgatatgctcagagaagagagaaaatggaataatataaaatgttcagttaaaaccagagaagacagaaaaagaaaggaagacaaaaaaaaaagtaacaaaaaaactagggcaatgaatagaaagtcattgcaaatacggtcaatattaaactagcaaatcaatagtcactttaaatgtgaatggtctatataaaccaattaaaagacagagactgtcaggggattaaaaatccccaaaatccaactatgtgttatctataagaaaccactttattttaaaaaatatttctaataagttctattgtgtacatttaaggtatacaacatgatgttatgagatacatataaaaattgtaactgtactgaaacaaattagtatatttattcatcttacatggttatccattttcccccacaagagcagttataatcatattaattgaacaatttgtcccttcaagtcaaattcctcagttgtgatgggtcagattcctcaattgtgaccaaccattgcaggtgaaattcaaattttatttttttagtggttttatttttgagaaaaattttatttcacctctcccaatggatagacatttatttcaagatacactgcatcctcttattgtcaacacttcaaacctaccagctactgacatcttgaaacagcataatttgttatccatgactcctgaaagttcctcatgtcaccaacccttatatgatacaaatgtaaagatggctattcgtggaaatgtgttcaccacattgccaagtgtcttgggtctccttttgaaaagaatgttttttcacaaaagtcaacatttccctgaaaatgcagctccatcttctattggtatggtctgtggaagtcacagagactgaaatttcggtccatattatggttgataactacaatttctgttgcaaagtatgcaagcattactttgaactgcatctgatgcaacttggtggtctaggccattacttgcaaattgccaaggcctattttgggaacaatgctttcaattcccttttattgcatgtatcagaacaatatcctgttaactaatatgatggttcattttactgcatatatgagaagaatgtcctgttaaccaatatattttgacttttggttttagtatgttttagtacaaatatccagggacaaattcttcagttgaatacatccaagagacaatttgttcaattgatctgctataatctaatcatttagcaaaaattctgactacaatacactatcattagctatggttctcatgctgcatattagatctttagacttgttcatcctatatatctgctgcattgtattttttgacctgtatctcccatttccacacccctacaccaatcatagtcaccactgttttattctgtatctctgtgaagttgacctttaaaaaaaaaaagataccacatataagtgggatcatgtgatatttttctttgtgtgtgtggcttatttcacttattgtaatgcataccaaagaatattttcagctatacaaaaggaagagatcctgtcattgccataagatggattgacttggaggacattatgctaaatgaaagaaacctagtttaaatataaagacacagatgggttaaaagtaaaggaatggaacaatatatactgtgctagctctaatcaagagaaagctggagttgttatattaatttcagacaaagaagactttaggacaaggaaaattatccgggaaaaatggggggcattacatattaataaaggggtatattctccaagaaaacataacagtccttaatgtgtttgcacttaacaaagcatcaaaatatgtgaggcaaaaactgatagaaatgcaaggagaaatacaaactattagagctggaggcttctatacccctttattagtaatttatagatccatcaggcagaaaatcagtaaggacatagttcaatttaatcatcagtcaactggatttaactgatgtctgtagaatactccatccaacaacatgagaatatacattcttctcaagatcacatggaacattcgccaaaatagaccatattctgggtcataaaacataccttaggaaacacaaaataatagaaatcatactatacttttttttttttttttttttttgaggcagtctcactgtcgcccagggtggagtgcagtggcgcgatctcggctcactgcaagctccacctcctgggttcacaccattctcctgcctcagcctccctagtagctgggactacaggcgcctgccaccacgcccagctaattttttgtgtttttagtagagacgggatttcaccgtgttagccaggatggtctagatctccttaactcgtgattcgcccgcctcggcctcccaaagtgctgggattacaggcgtgagccaccgtgcccggccctacaatatatacttctacaccatactggaattaaactagaaatcagtaacagaaagctgtacaattccaaactatttagagattaaaaaccacacttctaaatcgcacatgggtcaaagaagaagtctcaagagaaattttaaaatattttgagctaaaagaaaatggaaataccacttatcaaaatttgcaggctgcagcaaatgcagtgcttagaaggaaatatatagcaaggaattaatatattaaaagtggaaagatttaaactgaataatacagactaccaccctgggaagctagaaaaagaagagtaaatcaaatccaaactaatcaatagaaaataaattttaatggctacaaaaatacagttagatagaatgaataagatgtagtatttggtagcaaaatagagtgcttttatggattgtgacattggtcatttctaaactttttgcctaaaccagaatcacaaagatattctcctgtttgttcttttagaagttttaaaaaattaggttttaaagtctataacccatcttgagtttatttttatatatagtatgtgatatggattaaggttcattttagtttatgttttgtatattactatccaaatatttaggcagcatttgttgaaagtactatcccttttccattgaattccctttgcacctttgttgaaaatcaattgaccacatatgtgggtagattttgaatctattttattctgttgatctatttgtctaacatttcgccaacaccacattgtcttgaaaacgtcagtctgttgttgttctttttgcttttgagacagagtcttgctctatcgctcaggctggagtgcagtggcacaatcttggctcactgcaacctccgcctctcaggttcaaacgattctcgtgcctcagcctcctgagtagctatgattacaggcgtgtgccgccatgcctggctaatttttgtatttttagtagaaacagggtttcaccaggttggccaggctagtctcgaactccttgcctcaagcgatttgcctgcctcagcctcccaacgtgctgggattacaggcatgagccaccacacccggccaaaaagtgtaattttatattaagtctctgacatgtttcttttgcaaaattgttttggctattctactttctttgcctttccatataaatttttcattagattaccaatttttataaaagatcatgctggtaattcgatttagattgtatggaatctataaatcatattggagagaactgatatcttaacaattttgtatctttcaatccataaataaagtgtatctctccattttttaggccttcattgattttttcatcagcgttttttagctttctaagcgaagatcttacacatattttgttagatttatacttcagtattttcaagttttgggagagctattgaaaatagtacactttcaatattcaatttctaattgttcattataaaatatataaatatgatttataaattctctatagtaactttttaatatattcttatagattttctatgtagaaaattatgtctatttgtgaatagaaagttttatttttttactttccagcatataggccttttatttgttcttcttacccaatttcactgactaatatctccaggagtagtgaagcagacatccttgtataattcctgatcttaggggtaaagcagtctcttgccattaagtgtaatattagctataggttttttgtagatgccctttatcaggttgaggaagtactcattctagtttgcagagactgtctgtcatgaatggatgtagaattttgtcaaatgatttttctgcatctgtggcaatgattacatgattttccttctttggtttgttgatatggtgaattacattgattggattttgaatgttgaactagccttgaatttccaggataagccccacttgctcataaaagtattatctttctacatattgttagatttagtttgttaaaattttgttgagaatttttgcatctatgttcttaagggatatttgtctgtagtttctgttcttgtaatatctttatctggttttggtatcagtgtaaagcttgcattaaatattcagttgggaagtattccctcctcttcagttttctggaagggtttggtagaatgtttgatagaattcaccggtggagccatctgattctggaattttctttgtaagaaagttttcaactacaatttaaattcctttaaaatatataggactattcaggttagatatcttttttttttttttttgagacagagtcttgctctgttacccaggctggagtgcaatggtgccatctcagctcactgcaacctctacctcccatgttcaagtgattctcctgcctcagcctcccgagtatgggattataggcactcaccaccatgcctggctaatttttgtatttttaatagagacagggttttaccatgtaggccaggctggtcttgaactcctgacctcaggtgatccacccacttcggcctcccaaagtgctgggagtacaggtgtgagccaccacgcccagtctcaggttaattatctctttttgattgagctttggtaatgtgtgtctttcaaagaattaatccattttatgttgtttcaagaattaatcattctatgttgttaaactaactggcatacagttattcacattgttccctttttacccttacccttttaatgtctgtagtcaatgcaatgaaaccctcttttttgtctctagtcttagtagtttttgtcttctctctttttatctataggggtttatcaattttattgatcttcctaaagatccagttttgatctcattggtttttccttattgactttctgtcttcaatttcattgatttctgctctttattattctattttttttcttattttgtcctactttttctagtttaagatattgatttgagacttttctccttttccaatatagatatttagtgatacgaatttccttctaagtgcttttttagctgaatccctaaatgatgtgctgtgttttcatttagtacaaaatactttctaatttcctattgatttcttcttcaacccacagactatttatatgctaccagcttcttaaaagtggttatcttcctgtactgggattatgtataatgtttataaaataacactctatattttatagcactttataatttacaaagtgcttcatttaatcctctaacatccacttgagaaacataatatttcacagatgttgaaaaggttatcagggtttgagtgacttactcaatgtcacacagagtaggttaggactcaaacctagattttctgtctcccagtttattattctgaagaaattgtaaagaaaggtttgaaaaataaattggaattcaccttgtgggtatttggaaagattcatagaggttctttgaagcaatcattgatatgaggcatctctctcagtttagttttaatttagatttctgattactagtgaggttgaacatcttttaatatttattctctggtatcgtttggctatgtctccacccaaatccatcttgaattgtaactcccacaattaccacatgtcgtgggagaaacccggcgggaggtcagttatgggggcgggtctttcttgctctgttctaatgatagtgaatgagtcttacaagatctgatggttttaaaaaagggagtttccctgcacaagctctcttctcttgaatgctgccatgtgagatgtgcctttcaccttccaccatgattgtgagacctccccagccacatagaactataagtccaataaacctctttcttttgtaaattgcccagttgcaggtatgactttatcagcagcatgaaaatggactaatacgttgtctgttccaatttcttcttttctgacttgcctatttctgtacttagattgtttttctattggattggttggtcctaattgatttgcatgattaaaatattccaatactaatattttgtttactatttgttcacaatatcttctcttagcttcatgcttatctgtctttattacttcaattttgatcgtcaggaaaatctgcactggactgaagaaaatttgtgtgtttattataagaggagtattgctttattttgagctagtatgatgaaaagtgggagatagaagaggatgggattagaagataaaccacttgatttggaaattcaatttaccaatcatttgtcagttgcttatgcttgcatattgcctataattgcttattgcccacagtgtactaggccatgtgatgaatagagagtaaagaataaatgttacctactttcagggactctgatggagaaatatatcatgtacaataaggcagttaacatggtatgtgctcaagtgaactgtggtataagataagctgtggctaccaaaatttctgttccagcaaaggagagtgagtggtttgagttagttgggagttgtattagtcagggttctctagagggacagaactaataggatatatgtatacatgaaagggagtttattaaggagaactgactcacacgatcacaaggtgaagtcctgtaataggccgtttgcaagttgaggagcaaagaagccattagtggctcagtctgagccccaaaacctcaaaagtagggaagccaacagtgcagccttcagtatgtgactgaaggcccgagagcccctggcaaaccactggtataagtccaagtgtccaaaagccaaagaacttggagtctgatgttcgagggcaggaagcatccagcatggaagaaatatgaaggccagaagactcagcaagtcagcttcttccaccttcttctacctgctttttctggccttgctggcagcaaattggatggtgcccatccaaattgtgggtaggtcttcctctcccagtctactgactcaaatgttaatctcctctggccacatccaaaaacacccagagacacccagatacacccagataggatacacccagaaggatgctttgcatccttcaatccaatcaagttgacacttaatattaaccatcacaggagttgtttaagcaagaattctgtaagttgaatgggagcagggactttgtataaaaattttagttcttttcgtctgcaacacttagcatattgcctgacagtgctcaaatatttgttaaatgattgagtgatgttaacatgtgtaggcaaagccaatcatagagacctaacacaatgcatcatctatcattcctataccaccaacagctctgagaatgttctgatacatccacatttcagacattagcttgcatttccaaagaaagggaacacaaccttttcaagaaaaagaacacatgatatgctccctttatcattgtaacggagtagtagttaaaattttgtattgctgactatggccttatagtatagtttgaaatcaggtagcgtgatgcttccagatttgttctttttgcttagtcctgctttggctatgcaggctcttttttggttccatatgaattttagaattgttttttctaactctgtgaagaatgactgtggtattttgatggggattgtattgaatttgctgattgcttttgtcagtatggtcattttcacaatattaattctacctgtctatgaacatggggtgtgtttccatgtgtttgtgtcatctatgatgtctctcagcagtgtttttagttttccttgtaaaggtctttctactcctttgttagatgtattcctaagtattttattttattttattttattttattttattttattttattttattttattgcatcctttgtaaaaggggttgagttcttgatttgattctccacttgattgcttttggtgtatagaagagctactgatttgtgtacattaatcttgtatccagaaactttgctgaattcttttatcagttttaggagctttctggaagactccttatggttttcaaggtaaacgatcatattgtcagcaaactgggacagtttgacttcctctttactgatctggatggcctttatttctttctcttgtctgattgctctggctaggacttccattactttgttgaagaggagtggtgagagtgggcatccttgtcttgctccagttctcagagggaatgctttcaacttttccccattcagtattatgttagctgtgagtttgtcatagatggcttttattacattaaggtatgtcctttgtatgccgattttgctgagggttttaatcataaagggatactggattttatcgagtgctttttctgcatctattgagatgatcatgtgatttttgtttttaattctgtttatgtggtgtaccacatttattgacttacatatgttaaaccatccttgcatccctggtatgaaacctacttgatcgtggtggattgtctttttgataggttgttggattcagttagatagtattttgttaatgattttagcatctatgttcatcaaagatattggtctgtagtttccttttttggttgtggcctttcctggttttggtgttagggtgatgctggcttcatagaatgaattaaggagggttccttcttgctctgtcttatggagtagtgtcaaaaggattggtaccaattcttctttgaatgtctggcagaattctgctgtgaatccacctggtcctggacttttttttgttggtaatttttaaattaccatttcaatctctctgcttgttattggtttgttcagggtatctaattcttcttgatttaagctaggagggttgtatttttccaggaatttatccatctcttctaggtttcctagtttatgtgtgtaaaggtgttcatagtagtcttgaatgatctttcgtatttcagtatttgaagatactcctgttttgtttctcagtgaggttatttgaattttctctcttttcttggttaatcttgctaatggtctatcgattttatttatcttttcaaagaaccagctttttgtttcacttatcttttgtgtcttttttttgtttcaatttcatttagttctactctgatcttggttatttcctttcttctgctgggtttgggtttggtttgttcttgtttctctagttccttgaggtgtgaccttagattgtctatttgtgctctttcagacttttcgatgtaggtgtttagggttatgcactttcctcttagcactgccttagccttatcccagagattttgataaggttctgtcattattatcattcagtttgaagaatttttaaatttctatcttgattttgtttttcacccaatgctcattcgggagcaggttatttaatttccatttatttgtgtggttttgaaggttccttttggagttgatttccagttttattccactgtggtctgagagagtgcttgatacaatttcgattttcttaaatttattgaggcttgttttatgacctatcatatggtctattttgcagaaagttccatgctctgttgaatagaatgtgtattctgtggttgttggatgaaatattctatatatatcttgtaagtccatttgttccaaggtatagtttaaatccattgtttctttgttgactttgtgtcttgatgatctgtctagtgctgtcagtggaatattgaagtcccctactattactgtgttgctgtctatttcatttcttaggtctgttagtaattgttttataaatttgggatcatggtactggtataaaaataggcatatagaccaatggaacagaatagagaacccagaaataaacccaaatacttacagccaactgatcttcagcaaagcaaacaaaaacataaatgtgggggtccttttcaacaaatagtgctgggataactggcaagccacatgtaagagaatgaaactggatcctcgtctctcaccttatacaaaaatcaactcaagatggattaaggacttaaacctaagacctgaaactataaaaactctagaagataacattggaaaaacccttctagacatttactggggaaacatgccaccaatatttcaacgtaggttctttctattttccataaatgtcaaccggctaagaaataaagagaaagagtacaaagagaggaattttacagctgggccgctgggggtgaaatcacatatcggtaggatggtgatgcccacctgagccacaaaaccagcaagttttattaaggatttcaaaaggggagggggtgcaagaacagggagtaggtcacaagatcacatgcttcaaaggacaaaaaagagaacaaagatcacatgcttctgaggaaacaggacaagggcaaaatcagaaactcctgataagggtccaacaaagatcacaactcaaagggcaaaagcagaattactgataagggtctatgttcagcggtgcacttattgtcttgataaacatcttaaacaacagaaaacagggttcgagagcagagaaccagtgtgacctcaaatttcccagagcggggtttttccccaccctagtaagcctgagggtactgcaggagaccagggtgcatttcagtccttatctcaaccacataagacagacactcccagagcagccatttatagacctccccccaggaatgcattcctttcccagagtaatccttgctaggaaaataatttagagatatcttccctacttgcatgtccatttataggctctctgcaagaagaaaaatatggctctttttgcctgaccctacaggcagtcagacattatggtcgtcttcccttgttccctaaaattgctgttattctgttctttttcaagatgcactgatttcatattgttcaaacccacatgttttacagtcaatttgtacagttaacacaattatcatagtggcactgaggtgatgtacatccttagcttacgaagataacaggattaagagatcaaagtaagacaagtgtaagaaattatgaaagtattgtttgggaactggttaatgtccatgaaatcttcacaatttatgttcctctgccacggctccagccagtccctctgttcggggtccctgacttcccgcaacagacattggcttagacaaggatttcatgaccaaaaacccaaaagcaaatgcaataaaaacaaagataaatagctgtgacctaattaaactaaagagcttttgcatggcaaaaggaacagtcaacagagtaaacaaacaacccacagagtgggagaaaatcttcacaatctatacatctgacaaaggactaatatccagaatttacaatgaacaaatcagtaagaaaaaaaaatcctatcaaaaagtgggccaaggacatgaatagacaattctcaaaagaagatatacaaatgcccaacaaacatatgaaaaaatgatcaacatcactaaagatcagggaaatgcaaatcaaaaccagaatgcaataccaccttactccttcaagaatgaccataatcaaatgcaataccaccatactccttcaagaatgaccataatcaaaaaacgaaaaaacagtagatgttggtgtggatgcagggaatgtaaactagtacatccgctatggaaaacagtgtggagattccttaaataattaaaagtagaactaccatttgatccagaaatcccagtgttgggtatctatgcagaggaaaagaagtcattattcgaaaaagatacttgcacacgcatgtttatagcagcacaatgcacaattgcataattgtagaaccaacccaaatgcccatcaatcaatgagtggataaagaaacatatagataaatagatagatagatagagagacagagacagagagtcagtatgtgtgtgtatatatatatatatatatatgtttctattgattatatatatgtgtgtatatatatatgtgtgtgtgtatatatatgaatactactcagccacaaaaaggaatgaattaacagcatttgcaatgacctagatgagattggagactattattctaagtgaagtaactcagaaatggaaaccgaacatcgtatgatctcactgatatgtgggagctaagctatgaggatgtaaaggcataagaatgatacagtggactttgggcacttggggggaagagtgggagggggacaagagataaaagacaacaaatatggtgcagtgtatactgctagggtgatggatgcaccagggtctcacaaatcaccactaaagaacttactcatgtaaccaaataccacctgtaccccaataacttatggaaaaataaaattaaatttaaaaagattttgtacatcattgtcagacaaacctgggtttgagttccatctcagcttcttactggttatatgactcttgattttccttatctataaaatgagactaataataatatctaccttatgggtcattgtggtgaggatccagtgagcaaagtatgtataacactaatcccctaataggaattctataaatacttgctatgccacttctcttgatgtataataaaatggatggaacttgtgattgcttttgaattttgtgacttggttgatgtttcctaacaggcatattctccatctccttcttcacagattcagagacatattgcatgtttcaagacaagaagtacagagtgggtgagagatggcatccttacctggaaccttatgggttggtttactgcgtgaactgcatctgctcagaggtacaatctctcatgacatgtgatttcccagtttgctcctcagcatgccgagaggctttcagtgcccaaatggccagggaccatggatgataaaatccttaaagaaagtaaagaagcagaccgatcgcactgtctcacgcctataatcccagcactttgtgaggctgaggcatgtggatcacttcagcccgggagttctagaccagcatgggtaacatggcaaaaccccatctctacaaaaagtacaaaaattagctgggcatggtggcacatgcctgttgtctcagctagttgggaggctgaggtgggaggatcacttgagctggggacttctaggctgaagtgaaccgagattataccactgcactccagcatggttgacagaacaagaccctatctcataaaataaaagaagaaagtaagaagacgattgcaagaaaaataaacattttctgtcttctgtcctctcttgctttttggcttgattttcatgggttctctgaatatttactatggacagatatttatgatctcttagcctaatgatatagggcatggttagagaaggcagaagagcctgatagtgggagtggaggcaaaagctcaatagaatgtttagattgtaagacaaagtagtttttgaaaattattttaaggctgacctttagggagaatattaggacaaattataaactggttcattgggagagtggattctatgttgtctcagccaataactgtaattaagactgagtttgtgaaacgttggcctgtacctcttaaggattagagctcccttggcttagccttggctcttgtccagtcatttagaaaggattttggttggcataaatgccatctttgcaatagataaagcaggttgttccatcttcttcccatggtcttgacccaggagcacagctgtggtccatctttctcaacaaacctctgccattatatgttaggctagagtttcttgtttgcactatagatatttgtttgggggctgtcctgcgcattgtgggatgttaagcagtatccctggcctctacccattagacaacaagagcaccaaccccaatcctaataaccaaaaatgtctccagacatggccaagttgcctggggagcaaaaatcacccctggtagagaagtggtgcactaggctaattggaaagggaggccttgtactaggcattgagaattctgaacttacacaaagaattttcaagaccagcttcttacctgagaccttttgtaaggactgcacctcttccctcatgcccagctagagcaggaacaatcacttgcaagcctgatccatttaccatttgaacataattttgggctgtcagaattttgagcatgtggaaacataattatcaggtaacatcaggcagtattaagaggctatgaggttctagaataaagacagaccaagtttccagccctgcctctgccacttatgagccactggacaagttacctgacctctgtgatattcattcatcttcctctttttataaatgggataatgatattaccatttcatatggttctgataaggattaaatttacaaatccatttaaatcatttaaaacaatacttagtcttggtaaacattcaagaaatgttaacagctgttattgtcatcattgttgtccttatcattgtggttatcatcatcatcgttattattattaatctattagctctagaacagaattcagtatatagcattaatgaggattcactttagacctcagctgggaggtgtggtttctgatgtgcttcagtgatctcaattcaagattataccacctgcctctgaggagtgtgatacctgaggagcttctgtggtgttgccaaatgcaacactccaaaaaaaattattctagaaagtacacaagaaaaggaaaaggttgggataaggcaattccaatttggataaaagaagcccgcctctttaaatggttagggcatgtattaaatagatcatttggggattgattaactgcctgggatggcctgattttgtcggattcttgacgcgacacatttcgacacgttggagatggacagctaaccattgggagctgaggctttgatgtctgcaacgcagtcaaaatgttaaaatgatcccaatgccaacagctcaagcacaaggcattttctatttctatatcctcttcactactttcttcccccacaacagcctgacaaatacaagtagcccttgctgcaaatgatttatggatggaaaatgtaaatgaaaaatttatttccagactatgtctttgttctagaaatggttgtgagctgtcagagcgaggggtcttgtaattgtaaatcaggcagggacccagtcgccccacccaggcatactacctaatcagctaaattccaaactctagctcgtcctcagaagaattttggctaaaaaggaaatgagaagaatcacttggcccactgggccaaggcagatttatatggaatccaggatccacctgctagggatgcctccttgcccagggctgggtagcagctcaggggacccattgctcattgtgtctttcatgttattggacaggtgattatgaaatcagagtaggttcttggaaaagacatgcagctagagctggggaatggtagaaatgccatggagccaggccagaagaagcctcccacaattaatgggaagctttgaaaattggaggagtggtgatctcagccttagaaaaatatgccaataaactatcaaccaacccagcagaggtgctggtgatgagaaaaggaaagaaaatgttgaatgcattcagcttcttgggaatgcattattcactgcctgggtgagtccctgcatgactgtttcccaaactggcttgatcccagcgacctttgaaagacatttattttttctcattgccttctctttttcagaatgggaatgtgctttgcagccgagtcagatgtccaaatgttcattgcctttctcctgtgcatattcctcatctgtgctgccctcgctgcccaggtaaagcaatttgtctctttctttcctagctgtggttctccatttccctcttcacccaactcaactcatctccataattccccagaagggaaacttccagacagataacaataggaacctttaggcagtccaaactggcctctaaatactttttatagcccaaatggggtacattctaggctctaataagttattgggtacccagtaacagatttttattgggcttttaatcatttgaaggtgggtgtcaatcggagatggaaattgtggcccagagattttctgctataagcagcctcttcctgccatgggcagcaggcaccaggagagttgcagcatggcggcatgtgtcttatacaattagtgctggaattgcatccgagcatagcttctaaattatgagggggccattcataaatcaaaggagctgacccagtgaggtttatgacagtataaagctgcctgcctgctgaatagtcacctcctccagactgcagttattatgtacacattgttaagtgtaattctaaggggcagccaggcagagaatttttcacacaactgttaggacatctactttcacgatttgcagctacggtatttgtctgaggcaggggctccctcaatgacactttgttcatgtctgactggggcccgattcccaccccaaaagcgtgtggagtgattcagagaatgcctgtgggcccagtggcaatcctagaaaaagctacttgacactcttgggctttgtgaagtagaagccttatcatcctgtaagttgattccatttccctttagggtagaaattcttgaactagggttcctggatgggcttttgagggtcagagaaccctttaaaattgcttgcagtttttggtgtaactatgtatatttgtaaattcctttagagaacatccgcagctttattgtcagtcccaaaggggtgtacaggaagaaccactaccccagctaaggtatagacggtgctttttaagtggtgaggaacttccagaacttataagagagaaaccaaatgtatccaggcaaaaatgttaggaataaggctgggaatggggttcaatgaaaacccagtcaactgaaatgttccaagagtggagaatttttttttaatggagaagaaacacccaaactctttttgtcactacctttataaaatatattttcctgcatcagtaaatacaccctaatgaacacaggtgattcatttccagatggcagaatatcatgccatatcacaggtttttaaattctgagtgttggtgctgatagtatatgctttgagatgtcagagattgacttggcatatgaccaacctaaaagttgttgggttttttttggaataagtccctaagccaggcttactgtttctgtatgtgtttatttgcttcttcttcctaaactggattgcaagaatgtggtatgggtgggggtgggggcgctctggtaaatgggaacaatgtttctgataaagttgccactctggagagcttctttgttttttttttttttgtttttttgttttttgttttttgtttttgttttttggttaacctgccaggtagcctgtcagacagccttataaaagctttttattcctcagaagtctccaaaagtggtctaatgtcataggaacttatctaaacttctgtgtaaagattgttcttccctgggaagaaggttgaggcatgacccagacccagagcatggggcaaaacaacatagaatagaatatggctgcacctaccccagctgcctaacaggaagcaagtattgagaaaaagggaaagtataagctagcagttattttgagagaaaaataaagtgttaaaagaactgagctcaaaaattccagaggtgaaagcgttgaaagaaataaacaccattatggttaagacttaaaaagctcattttatggtatggaggatagaaataaactattccttttcttttccttcttgctcttgcagctcacttctccatgagttcatttttcttcttgttaactataacctttaacagctctttctgtgggtagtagttctaaaattccttagtccttatatacaaaaaagtgtatttattttacaaccattcttgaatgataatttggctgggtatgaaattataggtgcatgttcatctcccctcagcactttgaagatattactaaatggtttgttggctttatgtttgtttatttgtttgtggttaagaattctgctatttgtagttcttttgcgggttcttcgttttttttttcttctagcttttaaaactttcttcttttcattgatgcacacaatgagatgtgtaagtttgattattctcttcagcctgctcagcacatgattttttcagccaaaggagtcaaatttctcttcaatttttagtcagttttttttttgaaaattatctcttcaccttcttattttttctcattctcaaaattgtctttggtgtatattattgcatctcatttaatttatcctttatgtctcctaatgtctcctttatttttccctcctgatattctccctaaaatgatatattacttcaactctgttctccaattcatgaattctttccatgcatactatttaggccatgtgttgggttttgtttgtttctttgtttattttcaataaccttgtttcccctcaggttttcaagttatttaaaaagacatctacatgatgctaatttataacctgttattgttttggggaatcttattctcttttttacttctttaaagtatttaaaagtttatttgaagtccatttcagattgttcaaatatctaaatatttttagatgtgaattgtcacctttgttgggtttcttgacagcttttcttagttctgaattttccttggttttctactttttctttcaaagctcattatccatgggtgttttgggtttgttttgtttgtttgtttttgtttttgttttttcttacatgagcccttctttgtgggatggttgttgcaggctttatagttcactttgctctaaaccaggtcatatattaatgactcggtttgggctgcctcatgcctgaatggtctatttctacctctgttttcttgtgcactactagtctctgataatgatcatggactgatctacaactgcctcatctacaactgcctaacttggacaatcagtgttttttagggaacactgagtggggagagctatgtcagcccctgtttacatgcgagtagtgtgaccctagtccccaacttcacatgggaagccacttgcaagctgtagtttctcctcagccatttggatccaaactatccatattcagtcccagctgctgatggaccatatggctttggctcccatttattgctgtactttccttctatattttattccacgaagagtttttttgtgtttctgaatataattttgcagttttcacgttttatttatttatttttctagttccacatttcatctctctttgttttgaaaataacagggagatttctcatgtgttctctttgccatattgaaccagaatgcaaccagctattctttctttctactgaagataaaacaagagtaaatagctttaaatcatagcagagaggagtggagcttgacaaaaggaagaactttgaacaccgtggctgttaaatcctagaataaatgactaaggataattttagtctctttacttaatatttctagaaataaaaaggtacccacccatctgagatagagttggcacagtcctgctttgagacagggcaatggatgtgatgactcctctgtgttccttccaccccagtgattattaggcatgaggaaactcatgccttcagggccacagaaatgtttggtcaaagaaaagggctctggttttccatcttaacccaatggaaggcactgtgatgaaaatgtcctcatttaagaagaaaatatttaaagccaagatgatgaataagctccgtataaaaagacgacaaataagcaaactgtataccccagatactggctttacatactgtcctatagcagtattgatttagagaagcttttgcctaggtggtaacagactcagtggaagtgtcctacctatcatgcttagagcttagtttccattgaaggagacagaggagccatctcatttcatttgtttatgtatttcccatggctcttgctttctaaactcgttacccctaaaatttccaaggagcccacctgtatttgaaattgtctcctacagctcctgctaaaccgtggaaatcagagtatgcaggcagctcttccagaaataccagagagaaatctatactgattcccacaaagagcaaataaattttttttcatcagcacttgtccaagtcttggcagaggtcaagtcttagtcacataccacagtgctctactgggcccaaagaggctacatggaggctggaacattcttaatggaaaagtcaagactgcataggactcatgaacgtcattaaattcatcctggtctctaagcaagactctgtggagtccctgataattaagagattttagtgatttgaaggaattaaattccctatcttctcttttgggggaatgaagtggtaatgctggaagggaaagtaaaacaacatgacttattttcataatatgtgtatgtatatatttcataatatatatattttattttatatatatgcacagagagagaattttatcacaaaaagaagaattttatagtgatcaggagtctaaatcatgatattatctaagagggctttttaaaatggtcattccactgagaatttgctattcagaattaataaatttgggttttcctggaggtattccagcattcctgggttattaaagagctcttataaaattgccaaaataactgatttgatctggttaacagagacctaatccacagtgtttccttttggctaggtgtgaaaaagtttggcactatgaatggttttaataggaatagtgacagtgtggtttgccaagagagacaccccagtcttagatattcaaggtaggttagggaaaagaccttaccagtgttgcactatagtatgtgttcccataaggagaatgtgggaagccctgtgtcatttctctttcaacaatagttgggttgtgagtgagctagcaaacacaggcatttctgccacaatacaatatgcacatatctgaaaatcctcacattctacaaaattgtacactgaaaaatcacagggcttaaggaaaaagtagcattagagaaaaccactcaaaacttaggcaactttgtaaccagaatattaacaaagcaactatactaatgaaatactaacacagtttaaaaaggcatcttacatttctaataaaatattacagtaaatatagacttctagacttcaccttttaaaatggtaacattagcttgaaggaacagtgtttaaggaaggattgaagctgctaagttatagagacaacagtaaattgcacaaagatcacggagaatcatgtaataagcacttacaagacagagcatgtggcccaactgaggcaagaggaagaatgtagggcaaatggcttcctgatttcagttgagttagtgtacttggcttttagctgctgtcacttggtagtgcaaaatattaatttgctgggtaatcatgtatgaactaatgcaatttctattttataccaacttcattcccttatttagcactcacatatgaaccacttgtgttacacaaatccacactatagcacagactgtgtaagatgaggtgggtacatggcatttgactgtagacaagtttagagtaagagttgaaaatcacttgtttactctgaatctgcttttttttgtctttaatcactgacctatctgcccttgtgttccccttttctcccatcccatgtatttatattaaaaaggagtctagagtctaggtctatgactatgtctgtctatatctgtgacttccacagttacagtaatcaagtagacaggccttttgtgtttcctccagtttttttctagggaaggttcaaaagagagatttatttatttattattgtggtaaaagatgcataacataaaatgtatcattttagtgtataattcagtggcattaagaacatttacaatattgtacaagtggtaagaacatttaccactaatctagtttctgaaatttttcaccaccccaaaaggaaacctattacacagtcactctccattccccttttcccctagcccctggtaaccatgaatctacttctctatggatttgcctattctggacatttcacataagtggaatcatacaatttgtggccttttgcatctagtttcattcacttagcatagtgttttcaaggttcacccatgttgtagcatgtatcagtatgacatttctttttagggctgaataatcttccattattatgcatagaccactttcgttatccattcatctgttggtagtcatttgggttgtttccaccttttggccattgtgaataacgctgctacggacatttatatacaagtttttgtgtggcatatgttttcaattattttgtatatacctaggagtggaaattctgggtcttatggtaattttatttttaatttattgaggaatctctcttaaattttaaggttgccccatcttcttttagttcatttctttgagtacctactgccagccatcctcatggttgctgctgatttgctgcttttgccaccatccatatctgatctccattgctctcttctctcttctattctcttctgaattctatattcgtttgtctcttggattttatcaaaacagatcaattcctttttaacagtaacagccaattagcatattgttttccctagtaaggtgactacaatagctgtagtgtgcaagatgatcaaccaggagccactcctttgcctgcaaaagattggtatatatattacacataataattacatatatatatatatgggtccagagttatccaaaagcctgaggattctgaaatgttggtgtctgaatagcagatattttgctttattattattattactattttaggttacagaggggctgccaaaggagatgttcacttttgatcactagaccctccatgtccatactgactgttctcttagacccctttaaccatcttccatgccttatttccactatttttctcatactgttggtccttggacacttgacacagtacaaggggttaaaaccttcttcaagaaagtagcatttgctgggtgcactggctcacgcctgtaatcccagcactttgggaggccgaggcaggcagatcacgaagtcaagagattgagaccatcctggtcaacatggtgaaactctgtctctatttaaaatacaaaaaaattagctgggtgtggtggtgcatgcctgtagtcccagctactcagaaggctgaggcaggaggatcgcttgaacccaggaggtggaggttgcagtgagacaagatcgtgcctacccttcccagcctctagtaaccactattctactttctgtttctatgagatcaacttttttagcttccacatatgagtgagaacacacggtgtttatcttactgttcctgacttattttgcttaacttagtattttcaagtctcattcatgttgctgtgaatgacaggatttctttattttttatggctgaataatactccattgtgtatatataccacattttctttatccattcttccgttgatggaaacttacgttgattccatatcttgctgttgtgtgtggtcctgcgataaacatagggatgtagctatccctttaatacactgatttccctttttttggatatatacccagtagtaggattgctggatcatatagtagttttatttgtagcttttttaagaagcctccatactgttttccatagtagctgtactgatttacattcccaccaacagcatatgagttcccttttctccacatcctcactagaatctattacattttgtctttttgaacataaccattctaactgggctgagatgatacctcattgtggctttgatttgtatttttctgatgattagtgatgttgagcatttttatatacttgttgtctatttatatgacagagccttgatacattagtacccattatgaatctaccagagaggtatatgggatgtaacattgtctaaatttattcagccataatacccattttttggaggcactttgcagaattagggttctttgttatgtgcttcaagaagtgttgtattttgccattcaatttctaggagcaatgtatgttatagcaataagctattggtatatacagtatcttagtttggagaagtttgttagggtagtaggcaattttagcacaagaccctaaactagtactactcaaattttaacatgcttaaggatcaccttgggagatttgataaaatgcagactcccagaccctacaccaaaaatcctgaatcatttaggctgcagtgggtgtcatgcatttcacacaagcatcccagttaattctgatgcagtcggattgaggactgcactacagtaatagggcccaggggagattttgagaaaggaggtcaagagaactgcccacagaaagccgttctgggtaagatcttgcagcagtgggatctccagagggctgtgggcaacatgacaacattgtttcgctgataatggagcacatagacactctggaaacacattttccttgtgtgacatttccccaggactaaccctgcagtaacatgtgcacaatgtgccatctggcctgcccctctgctttcccagagctcccacccaaaggctgcctcttctgccatcttccacattcagagtccttggctgtcatgtccagaaagcaagaccctccgtggggagcttccccctctaccccgcccattgttcatgacttgttgttggcgagaaatgaatggcatttctcggaattagcccaggaatttctgctgataaacaaatgaaactctcaaagggaaaagcaatcaacatagtttgaaataaaatcagtgttttcagcttagtctgtttttaacttagtttgaaataagagtcacatctagggtattttaaggaaaggattagcaaaatgtcctgtagtgggcttttcatctgagttgccagactgacccttgaaccagggcctgttttcttcttgagtaagcagaagaggcaattattaccttgatttcctgtgacctgtgattctgagacctgtccagccatcggatcagctttgcccaagcccacccccacttccctgccaagttgcctgacacctgaaattgtcattacagcttaatcttttaaatttaggccttgtcctgataaattcaccaatctttgaaggtagtaaattaactcttattaatcatttttactttcgtctgaacacaggatttagaaagcagattttgattgtagaaagaggagacaggtgttgcggggggaagatcccgaggccactaagctcagctgggcacctgaagagttacaaagggagaggggcctgttgaaggaagggcctaaggagtcaagctttacctaccccaaagtcctgcagaacaccagtagtatttaggataagttctttatttgtagcagaggacacagtggtttctagaatgagttgccagctctcaagtttttcactttagtgttgttaatttaaaaccaatatgttctcaaagtaaccagatatccttgctatctgttgcctagagccaaagagttttacttcagggttttggacttaaaatgactgtaacccaaaaggtttgccagattatttgcagccactaagataagcaattgtctttattagaatgatttttgtctgatttttgtgtttagaattttataccatcagctattccctaaaagtgattttaggaactggcagacttagggtgtcagttattgaaatctgttccaaaatccgcctcctcacaggactccatttttggccatcaaagtagtctattttataaatgtcttgatgtgttgtcttttgtctttgccacatatactctaagacacagagactgggaagtggttcagcaaatatatgtatggctacttacaaagtgttttctagagttatgctcccagaattggagataggctaagaaatatatgtactgtatctctcagtaaagggctaaatcaaagctgtctgcaggagggggaggaagagggctgcttggattttagtttaattgagaagacagagaaatacgtcaaacttgggagttgaggttattttttggaacatgaagataatgtaagtgtccccacaagctctttttcttttcttcaataaattcatcctgttttgatttcttcacattcacaagattgtgccctcagggatctaaggccaaatcagagtccacactcactatcataccttttatataatatattcttttattattttaatagagaaatggatattgagaaggagaggacaaggaaatgtggcatgctttcttccttgttttctttctttgtttcccttctttccttccctcattccttcctttttattttcattctcttttttgtttaatttgtgattattttcttgtgctaaaaatccataacataaaatttaccattttaaccatttttatgtgtacagttcagtaacattaagtgcattcacactgttgcacaaccatctccaccatccatctccagaacattttcatctccccaaactgaatctctatacccattaaacactaactcctcactttctacttcctgtctctatgaatttgactactctcagtacctcatatgaatggcattatgccgtatttatccttttgtgatgggctttttttgcttagcataatgtctttaaggttcatccaggatgtagtgtgtctctttttcaaatggggaagagagagaagaaatttgagaagaggctggtggtagaaatgaggaagtgaagtcaggagacaaccaaagagtcttagaggaatctagcaaatgttgcttttcagaacacattttttctggaagactccagagaccacactgtctttgaaaatgacaggcctgacaagcagtaactagtattactgcctgtgtgaaatgctaggttttgaaagacgtgttccttattaatgttccccagggaacttcagagagtgtcatctattaggagctgattactggcaagttttgtcatctgcttttggagaaatccataggaatagaacagtacccctgtttctctttatctggagaagtacttttccaaaagggcctcttctgcgattgctttctgagggaaattgtgtctggagccattcaacatagctttattagaaagattattaaaggattagagtatgaaacctatgaggtgatgttgaaggaaaactgtaattactgaaactggtgaaagaaagacaggggccttcaccaagtttcagaaacataaatgggtcttagaggaggctgatcagctttctccttccacttccaaagggggagaaagagtagaagtgagcttcagtataaaaaacttaggcacaaaaaagtagttccaggcatagataagggaagctgaagtcattttacagtcaatatattatattaatagctcaggctcaatgctgagtaaacacaagacacacataaatgcacaaacgcatacaatatgattccattaatatcaagttcaaaatagggaaaagtaaactatattgattatggatgtgcataaatgtgataaaactacaatggaaagtgaagaaatgattatcacaatagtcagcatggtggtgagttgacctccattggggggtggtgcttctggggtgttggcaatgcactctttcttgatccacgtggtagtcacatgggtgtttgctttgaaagcatcagtacaactctacatttatgttgtacgtatgtaagttatatttcccagtataatataaagtgggattacattttcatttgttcttgatggttctgattggaggcaaaagtaccagaagaccttgcaagattacaaccaagcataggattctgtatgtgcatatggcaatttgggggactgttatatttgtctacttgtttgcattgttttggtcttcttgatgtttggttttgtgtgtgtgtgtgtgtgtgtgtgtgttttgttttgatttttttttttttggtttttggtttttgggtctttttgtcacaaagaatagcagtaccaaaacctagagaaaggtgtgctccttgtcctctaagtgggctcttggaattagtaagtaggcatttgaggcattgatttctaagctgtagagtgcacagtgtattggcatctggatgaagccatctggctccaggattttatcactgaccagagggccagagggcatgtttggcttccaggaagtcaggctggtcaggaacccctttgggaaggaagaagggctttggacctgtggagtatgcctgccttccctcaaagtgaggttttattgtgttatcatggggggaggaaggcagggggggccaataaagagatggggcctcgctctgctgtccttccagttcactgtgggacattcacagagctgattaacctctttgtacctattttctcagcttgtaaaatgagatgataattcctgccttctcttaaagtttgcattgacagtgaacaagaaagttgatatgggaaattgctttgaaaagtataaggaggtatatataatcaaggcagtgatcagcaatgaaaagaaggtatttaaatcctgggtccccagatttcatctgggcatatctcaatatgggcaaagcctgaaaccatagcattttggtacgtgttcctctagatcccaatgatagcagcctcataaccaggcattgaccatgtgtctccagcctcagggaaaagatgaggggagtctaaaggaaacaagtgacaggtttaatgactgtcaggcaaaaggcattaaattaatggcatcacctctgccttgcctttctatttccttctgattagattttcagaggtgcctgtgtgagtatgccgcacaataatgctgatgttctcaaagctgagtgagctcttaacagaaacataaggtagtgctgagaatgcactcagagacaaggtaaaaatctctagactgccttgagaaattgaaggggatttttctgggggagggctagaactgatacctcctccctcctaaatcataaaaagagagagcaagattcaccattatgtgttgattaggctgccttactcctgtttggttcctaccttctgctaatccgtggtcttgctagaggctgtcatctggcgcctcttgcaggagcacagtgtgtccgtactgcagggggcctctcagaccactgggatcagggaaatgagccattgctgtagtgttacttccaaaccagggaggatcagcacacacacacaccctttctgcccccaccaacttctccagggctttagaaatgtctgggaactgttttgttcgtcacagtaatgggaggatgtcattggcatttagtgggcagcaacaagagatgcaaaatgttccacaataagtaggaacacaacgcatggaagaagtgtcccacacaaaattccagtggtggctctattgagaaatactggacagcagccttagtcagagaagcctagtgaagggcgtctcttcctaaccagaagttggtggtatgagtccacacattcattaattcactcactcactcatattaatttcacaaacatttacagagtataagctttgagacatagcccatgtatggtgctgaggtttcagagttcctgcctcgacgagttcacaatctagtggaggagacacgcataacaagattattaaaatgtaatgtgatgagtactctggtagaagtgtggacaagggctgtgcaggcagagaggggagaagataggcactctccaagagccaggaatcaggcacagtcccagaggggagtggacatttgagctgggttctgacagatgaatggcactttgccagatgtagaagagggaggtggggagggcacgtgcagaggcatgtgtgggatccgtgactgcagttgagtatggtctgtgtaggagggaggaggctggaaatgtcagattgatggaggcccagtctcaaaggaccttgtacatcctgtgggtagacattattttgcagagccagcccactgcaaaagtagggaggaggtgcagtttgtctttagtgttcttggatgtctttttgcatcccctttcctctcttgcagtccctcatatcctcatctctctcccagccacttacaaaggcagctgatgagactccttccagcagaaaggtcaatgcttagcttaactgtaagaattcactaaggatagatttctggatgtcaaagggagagtctttgggcagagaacctggaagaactgagcactatggagatagggcagaggagctttgttcagtttacacacacttgatgtaagtgtaagtgtatgtaagcgtgtgggtgagcatgtatgttggagtgggtgacattgtgtggtatgtatgtgtgtgtgtgtgtgtgtgtgtgtgtgtgtgtgaatgagagagagggagaaatgggacaatgatagttcctatctcaaaggactgttgtgaggattaactgaattaaggtatctaaaggagttagcatagtgccctgcccatagtataccctcaataaatgcaaggtattgttggtattattttagaatgcagggccagaattcagtctggagaagggggaacatgcttactaccaagatggagatgaagattttacactaaggcttagtggctacgtctggctagtttcaaatatgtgcctaggacacattctatcactgggataatataatttttcagcatgttggcttatcagaatgtacatgttcccaagtggagccatagcattacactgtatatatttgggtactttctccatctctactcatggaacacatggcaggtagaaagctgttgttttacaaatgacgtggacctgtcttgaggcccagatcagctgatctgtcctcatgtatagcaacataaaatagaagaaccacagcactagggccagagccagggagatgcattagaaaggaattaacttgggaggatctgaattagggaacaaaagtactagccagagaaggaaggaagaagcaaaaagggggaaaaaaatcactaaaaggacaggatacataagatcatccagctgcccccaaactgaacttacaatgttttctgtgttctctttggaagaggagttggcttgtccagaattcaatggaaacttgttgattgacactgaattgggcacaagttcaatgtgagtgcgcctgcagctatttatttgattttttaaaaatgcaccctttgcagtaagactgtttagtttctactggcgccctggggcagtgagtttagattgttaaaatagcagccattaacactctctgtgttatgacactgtccttcctaccccactttagaggaatcaggcatgaggttgtttgacaaaagtttaattctcctctccccaccaaaagaaactgagattcctcctctgagtcagaggcacgtttgcccagccctaaccctgaaaacctccaagtctgcctacccgcctcaccaccatccccacaaacacacacacgtgactctcatgtacatctggaacacacacactttcacatacactctcacaggctcacacccacacccatcccacaagctagaggaaccctagggagcccttgtgcttgtcttgctgttcttttgttttgctttcctgtatttgctttgttttgatttgaaatcagtctttgggattacattggataattttttcatgttattaatagtgctgtgcagggagcatgtaaggacttcctcctcagtcctggccatgcttgcttccccaaatacaatgctgactctcattgatcaatcaaactgatctttgtcagactttgcatacaatacctcatgggcaaatagctcagggagctctaaaagatgcctgaattctgggattatctagattattcatgagtctgcttaaaaggaaattttttaaggcaggactggatagctatggctttcccaaaggccctggggaaaaatcaaaggagcagagacaatgtggaaagtgtggaactgctcagctcccagagcaaggcaataatctgaccaaacactaagcccccacccaaagtcagcattggtcaggctgaacagccatcatgagcacaagcctaggaggcatggaagggaagttctgtgttctctggacatctgtgatacatgttgtctataccagcactgtccaatagaactttttgcaatgatggaaacattctatatctgcactttccaatgtggcagccattagtataggtggctgttgaacatttgaaatgtgactggtgtgagactgagaagctgcattttaaattggatttaatgttaatcggtttaaatatgaatagacatatgtgactagtggttactgtggtgtatggcacagctttatcccattcgctggatacttctgtgcggcagtgaatttaattttgtacctcctctctgttcagtgtcttgcaactacatcataaactttttgagggcaggaatcatatattgtacaactacagaaagttataccttgaaaagatattttttttcagctgcctctccccatatttgacaaatagggagactgcgaaagactctgtaactttcttgaagtgacagcactcattagtaacattacctgagcctggaacccaggtctccttgcctcccggactgtgcttctaccacatctcccttgcagacaagttttcgaaagaggaagagttttcttcctctccactttcttcactgtttatatctgagattcagcccctgatacttggaaataatttggatctcaagtctacatttatctcctcatctgccaaggcacaaaataggctctggacaaatgtctgtggggtgaaaattctctgaggtctttctgttgtctgttatcttctatatttttaaagaaaatctttttctgcctcagtgtgtttgagacaaccattacttatgctgtttcagcccagggagatggggcctctgtagatgtggccctggcctgtgcaggtgctcaggtatacattagagaagcctgtgcaacagcctggcaggctgataaaaaagctgtagcagtttgggacctgggcccctctgtcttctaaattctctagacttgatggtagacaaggatgccatcagacatagcgccctcccttcaccacattttcatagtaacctagaactaaagatgcttcagggaggagtctagggccatatcttactggttactttagaaagtaagagaaaatacccagtagaaactaacctcagaatcacctgctaaaagaaagaataattcaacttgtaggtccaagtaaagtatcctttcatctctcttctcctttctctgttttccaccccaggcctttgccctcaacccagagccaacctatggtaacacagcaatagctgaattgaagcaaaacctgttaacagtcaccaaaggctgagtttcggccaagcagatagctcctccaggcagcccttcaaaagccaggcagaggcaagggggtaaatagcctgtggcctatctgcagtagaatggccagatggtttgctggtgccaccaaatgaaggagtgatctggtactaagatagaaggcttccagggaccctcccagccctaaaaatcttaagcccaagtgtagtcatcagatgccaaggacactggagaaagtctttggagcatgtagaacaccaagccaattggagtgcctgctaggacagcacaggattcctagaattccggccacaccatatacacccccacccccagagggcagccagtggccacagcagaggccttacccagcaggctgagaccctcatcagaccctccaagagcctacttccttacttagggcctgcctgcttgcactgtgctgagttcagggaggtggacaaactgtacctcccactttagcctaagaatctgacttgccatggactctccaggcagtgaatcattttgagcaagcacttaagcaactttccactgagtcattctgaggactgtcaggtttgctaatcctgatatatactgtgtataccctttgttcagatcctatacccatcctgatattggaggagaggggttataaacaacagaactttaaggatgtgctcattagaagtcatttgtattagggttccctttgccctactgactctaacagggcctgaagcactaagagaaatcctgctggtaccaacttttgatttgtgtatgcttttggttacatagctatcaagagtatgtactctttacctggagtggcagtgcacattggatttcttttccagaccctccatggatctgttttcctttggcttcttctagactaggggccagcatttctttttttctgtaaagggccaaatagtatatatgctagcattagcaggccttgaagtctctgctgtagcaactcttgcattgtaatgtgaaagcagtcataggcagtatgtaaataaatgggcatgaatatgttccaataaaactttatttacaaaaacaagttgcaggtcatatctggcctataacccctgttctagacacaataggctaagtcaaattagtagctgagacttagtttcagctgctagagtgcttaagcatatcacattggggaaaaaatcactcttatcctccattcttttggggaagagaggtagaaattgcaggaatattttcatctttcccattttgaatatcaaagcccattcctcatcaaatattacatactccatagtaatcagaattggctaaagtatgatgcagtagcaacctacaaagttcaggacttaaaacaacaaagatttatttcttactcatactacctctttgtcttaggttggtgcctgtcattatcaccaacagactctggctgacagtgccgcaccatcgggaatttagttccagcactatgggaagggaatataacacactgtggtctggctgtttaagacttttggccaggagtgatacagattacttctgctcatctggcattggccagagcaagtcacactaccatgacttgacttctacaggacagggaaatgcaatactaccatgtgcctggaaggaggagaatttgaatattgatggaaagccctaatgacaatcacacactctaagaactccttttcagtttcttcttcatgtcattccttgcctacctttaggttatctggcctagttgtatcttttgtccaaccctacctggccttcctcagacatgctggtcattgacattgatacatgggggagggacaacttagggactaaagcattgggacagtaattattccctaaaatgctgtgtagaccagcatgaacatgaagtcaggcctcagagccaggtcttacatgccgttggatccaagggttgattgccattgggcagcaagcctgagaaaaattggacctcccataactctggttttgatttcactttagtttacttttaatgagaatttgaatcagagaggaagttctaagcatattgactttaggcagtgccttcccttagtgctatggagagcagttatcaagagggaagaggaatatggaatgtgaaaggtagaaagtataggtgatattaatgcagtattatgggctaaagtgaaacatatggcccatgattttagaagaaggaatatatctgcaaagacaaaataattagttgggataagcccattgctctaacaatccccaaatcttagtgactaaagacaatgaatgtgggagtggaggggcctatggagagggagggcttttgctccatgcagtcattcagggacccaggcccctttcactctagtggtctttctttcctctagagtctcacagttcatcactggagcctctggtatgtggtccttagtttagggaaaagaaagcaaggagagttttgcaggacgttttataggtcagtcttctaaggcatgtttatcatttcttcccacattcaattgactggaactcattcacatggctccacctaactgcaggcgagactatggaatgtagtgtagctgggtgccaggagtggaggatggagatgggtttaatgagcacacaacattgtgtattccgctgcatacttgtcttgagcaagggtgattttttgtaggaagggttcagtctgactgagtcttaactgaagtcttcatcaacatactctcaatattgaaatgttttccccttacagagcactgtcggccttggttgaacagaagactagtcctgactgcagaggccttagataaatgcaattttgccagtccttacattttacttcataattcacatggcctctggacagatatgtaagagcacttgcattctcattggtacaggtttgggatatgtatcctggggcaggaacgtgaaatagatgacattcaatggtatcgtgagcaatgatcctaggaaattcattctgaatcctaaactgggcgtaaaccattcttaaaaagtaaaaggaaaccattaaaattggaactacataactaatctttgttccatttttggcctggctaccagggcattcagagtcctttaacacactcacatagaatacatagaataattatgttaatcctattcattgtttttttttttttttgaaggagtctcactctgtcacccaggctggagtgtagtggcgcagtgtcggctcactacaagctccacctcccgggttcacgccattctcctgcctcagcctcccacgtagctgggactacaggcgcccgccaccacgccgagctaattttttgtatttttaggagagatggggtttcaccgtgttagccaggatggtctcgatctcttgaccttgtgatccacccgcctcagcctcccaaagtgctgggattacaggtgtggtatttcttatagctacttctcggttcaggtgttttctattttcaattacttcatgatatatgttgtttgttgagaacaggagaaaaaaataaggcatggcttcttcttgttttatttaggctcggtttgaagactggcatttgtgaaaaagatttttctgtgtctatcgtgacttcctgagcagttggttttatatggtgtagttttggagatgaacttcagctgaaagaaaggctcaactctaagtttgatgtgagccaaaggagtgcatcacctcttcaaggacagctagatctttgctgtctaatctaaagctgttcaccagaatggagaaagcacttttatgttccttttctccctagctatatttcaaacatttagggattagatgatttgtatctattattttttctagtccagagcttcgcaaacactttggggccagataattctttgtcatatcgtctatcctgtgcattgtgggatgtttagcagcttctctgacctctacccactagatgccagagtacccttctcaactcgtgacaaccaaaaatgtctccagacattgccaaatgtcccctggggaaaagttggccccagttgagaactactgtagttgtaaatttttttttaattgggggtagataccctcactttcccagaatcctgttctgtatttgacatttcttgcagagatgggagttggaaacaaaggttatggatgtcagggagctcagttctaagattgcctgcatttatacctccctggggtgtggactcaggccatatggaacaaatatgacatatgtttgtccagtacgggcagtaaaaaggcttctcaatactcattaacctttgagaagctgacttgtttctacagcattattgaaggttctgaataagatgaactcttagaatctgaatcactgggaatcttcctgaagtgcagatgatgtttcagtaggtctggagtgtgggtgtgagattctgcatttctaactagctctcaggtggtattaatgctgctggttcccataccacactttgagtagagggttggtggtctctggagaagaggagctggctaactagacactatttttaggttctgcagaaggaattgttctttccaagattattccattggcccagtaagtagtgaagtaatctgcagttcttaaacattccctccttctcctctcaagaaggtacaacccacagtgatagtctccctgctctctctttcattctctgcagccatttaaggctaatatgaggtaagctagtcaagtacttccttttgattagctaccttatattttttggaccttctgtgtgtccgtgtgtaagagagagagtagtttcctttccagaggaaatagtggggataacttcggaaaagccattacagtgtcagaaataggtggctattttatcctagctggagtttcagataatggaaaatccatctctagaacaatgtagtatagctccacttctgggatcacttctggttggccacttcctagcctttgtttcctcatctataattgtagataatagcaataatcaccttagagggtggacatagggagaaaagaactaatgaatatcaacctgaagccctgagcacagaaccagctcagtgtaagcatgagccagtaaatattagttcctaatcttattggtgtggttattgtcattattggaactgggatcctcagactctttttgcctctaaattgtttgcatatattgtactcctatcagtgacatctttcatcatgtgcagtgattctcaatcagggatgaggtggtatgtggagtttgaaaccactcccaccagacaccatggtctccttgttcctcttttgagggttattggtctaagcaatgactgaatctcatattgtttttccagccttggtaagtccaaagatgataatataccttatttatttgtttgatctctgacccctatcatcacttttcactctaatcactttaatatgagcatctggctgccaaaagaagcccagtttcaaactggaaatttttattaatatttgacatatttttacttttcacacctttctttcctaaggaattgtcaccatcccatggcaatcaatggtggagttctttagaatccagatttcctaacaccttccctttcctttctgtgtattgtgtagtcttaactaaataactctccccacatcaggaattttggtctgggttcttaaagaatttcctaggagaagcaaaatgatactttgtcttttcctctagtagttccatgacatggcagatgagctgcctccttggtcgtcaggaagaggtagactggattttcctaacagcgttcccactgctccagcagcctggagccttgtgtgccaccactttccttgcaccctctgccagtggcctccagggaccactttctgaagccagctgctaacagttttccaaacaaaataatatgtgcattgggggataacttttctcaattaatcttcaagtaccaaatgcctcttttcttcctttatgcctaatgtgatagcaatgggctctttcagtcacctcctgacatatcctgtccccgagctcattatctcttttccagtcatctcagaatagtttttcaaaaatgtaaatctcatcaaatcatttcactacttaaataacttccctggcttctcatcatatacaggaaaaataccaccccctggacttgacttctttgtgtctccaggtgcctgatgtcattgggctgttgttgcaagtggttctggttattagcactatacagtatttcacaggggagcattttctcttgatttatagggcttgctaatgaaagaaaagatactggagatgctatcagccatctaggagtaacgtgttaggtcttagctgaaggttgagtgtgactgaagttgggagtgcggttctggattcagcagataatagtgtccatgagatggcgaatatccagatcctcaaaatatctaggttttgatgtggtgcagggcagtgctttccaaggagtgtttctggggcattcatagttgttacctaggtgaaaaaaagagtctggtggataagtaaagtcagagaaaatgctgagttatcattaaacaggtttctttactatgggacttgtgagatccttttaacatattgaaagggacactgaatgttgaatgtggatcttttcccaactttatttaagcacagaattttgttttcacagagcatcttgtggactagtagtgctctgcagagcagacttgggaaatgctggtgtaggcaatacaaaggaatgcttgactgaactccccactgtctcatccagatgcctcacattgtttctgtaaatgctgcttgagggtaatgactaatttgtccatttcaaagggtcattgaccttcaaaaaaaaatctagttctcaaaggattagaactaaccaagtaatagtagaactcattcttaatttattcagggagaagaggaaggcagtgagtgacaacattaccacataacctgttattaacaatgaggcatcgtgaagaatcattgatttaacattacacctcctggtaattagaggtttttaaaacccatagtacagtagcaaaggaataatacaaatctatcagattcaccatggaagggattctttttgttgggctacataatccaagttcacatgaagatttgaggttgaggaattagcctctgaaaacagagggatttgtgttttatcttccgcaattattagactggattttagtgggcttctctagccctcacgttttgctgctctaggtaaaatgaagagacctaaatttgaatctttgctttggcactaaatagcagtgtccccttggcatctctgggcctcatttccacctgtcaaaagagaaggccatttccagtttcctcttggagatagaaccctaggaggcttatgtaatgagattggaatggtccatgagctgaataatggagctgatgataaagctgttcagtaaagtggaagaagaaattttgacaggaaagaacatagaggttgcctctgaagactggattatgagaaacttccacaagtaagtactctcagcacacagaaagctgaaaacaagtgtgcataaccttagagccacagaatctggacagagttgtttgcagagatctcatactgctgaagtgaaatcctcagcccccctgctttgtatggcaatagagagggtacttcttttgggtcatgaaatcctgagaatctgattgaacccacagacccttttcccagaagaaatcgattctgtaactcacttctgaatcacttttgaaaatcatacttatttctctccagctatctgcccttaaatgaagaatcaccttgcctctagatatgcatatttatatgttaatgaaattaataccagactcttaaaattagcatgtatcactatttgaatatttgttccttcttgccatgctctgttccttttttttttttttttttttttttttgagacagagttttgctcttgttgcccaggctgtgcgatctacagcacaggctgtgcactgcagcagtgcaatctcggctcaatgcaacctccgcctcctgggctcaaccaatgatcctgccttagcctcctgactagctgggattacaggcacctgccactacaccaggctaatttttatatttttagtagagacagggtttcaccatgttggccaggctggtctcgaactcctgacctcaggtgatccacccacctcagcctcccaaagtgctgggattacagtcatgagccactgcgcccagccagcatgctgtgttctaatgctagagccagcaggagatagagaagtagaaggcatagaccctgtctcctttgcacttattgatcacttaaaaagcggcacactttatattaggtgctagatggtaggatgcaaacaggcagaccatgagagttgctgcagaaaatcagagtgtgtttgatgggccctgggggctggatatgagtaagcaaagagtagtctgtgggggcagttggggctagcatgagtcagggcagaattggccaatcagaggtagagcattctttagccaagtggcacatcctcaggggatacatctttgacatgaacttcatgaccctggctgggccatgctgtggtgtgggtccgtacatggaactccagtctttggggtgtgcttactcacaagcagttgactgacactgcaagactagagttgctacctataaggcagcacatcacaagctgaagggacttttctaacttctatgggatgtagtaactctggacactggaccatcaaagcagacaaaattatacatctctttttgccttcaggtagaatgcatttggtaagcagggagataatcataatcagttgactttgttgtatgttgcttctttactccctgaatctttttgaaaaacataatcatttttgttctttataatatatccctgtgaaagagaagcaggtgaaatgattacctctgacacacacatacacatatccacacagaaagttctttagaaactgaagcctagagatgcaaagtgatagcagttccatcacacagcaaacaaatagtacaacttagctaagaatacatgggccctccccctgccccccaaaaaacccccaaatctatgccatttgcaagcactctttgcttcacagagacatggccctttcttgcacactctctcctcaagccatccttcctagccatctgtctgacaagacggcatattcaggcagggtcagctactgactgacagcagctgaaacactgacggaagtgggatgaaaaacagcctgcagatggggtccggatgaggagggggagagctgggattagactaggatgtgagctttcagcgccctcttccactctcttctcgccagctggagcagcagatgactgtttcctctcactcggcaccttcttggttgggacagagtgttgtgtctgtctgtttagctgcagagtgatctgttgaatctgctacaagaatttcctggcctgggacctcactgggggttgggccaagggtagaagtagggaggccactagtcttgttgaaggtgtggtcccacagagtctcctggaagctttcaagcaggaaaatcttccccccatcaccccctcctttagctgagctgtctggctgacccactccatctcccaaagtggatacaccacggctggggacactaggcaaaattatgacttgagattgactccctctacccatttgtgattctccctttctttttaatttacctttctcttcttcaactgcctatcacctacaaaacaccttcatttttttcaggcccgctccgctctgatacccagtctttgtgtttgtattgtataacgtttggaggttattttttttttttggtaacgctttattgaggtatacatacctcatactgaggtttacatactgtaaaattcacccttttatgttgtaaagttggttttagtatatttacaagatgttgcatccatcaccactatctaactccagaatattttcgtcatctctaaaagaatcccatacctactagtagtcactcccattctccccttcccccagctcctggcatccagtgttcttctttctctctctatggatttgcctattttggacatttaatgtaaatggaattatacagtatgtggtgttttgtcactggccttttttttcacttagcagaatttttcaagtttcatccattatagcaataatattacattttatggatataccatattttgttcatccattcatctactgatggacatttgcattgtttccatcttttaactattatgaataatgctgctataaactttcatatacacatatctgtttcagttccttctttcaatttttttgtgtatatacctgggagtggaattggtggcttatattggtaactctatgctcaactttttgagagactgctagattatcttccaaagcagctgtactattattatttttttttacattctcaccagcactgtataagggttccaatttctccacctacttgctaacccttgttattattgtcttttttattatagccatcctagtggatgtgaaatggtatctcattgtaggattccccccaatagcgcctttctctttactggggaatagttccagtcttgtgtattcatcactgtgaagatattaaacctctgggaaagatagggcccttctctaactaatgattgaatctgggggcatatcaggcattctggcagggtggagaggaagagagtttagggacatggtgaacttgccacctttggaagctctaccatcgcagaagcaatctgctctattgattgctttcccttcccacaaagagaccatcaagtgcagaagtaatcaagtgaagttttcttgaaaaggcaagacaagagctgggcaacgaagggtgggaggccaaaggatgtatgaagggggaaatggagaggcttcctaaactaaaaaatattaaatcctttctgaaaagcaccttcagtagtgacctaaaacaaagatgaaagtcaaaccaatcaacaattacttttgtttagcaattctggaaaacatgttgcaggagaggacactggaaatgatggttaaaatacggtgggagccatggcagttcaagcctgtaatcctagcacctcaggaggctgaggcaagaagatcagttgatcccaggactttgaggctgcagtgagccatgatcacaccactgcactccagcctgggcaacagagtgagaccccaactctaaaaataataataataaaataaaatacaatgggagtgttggccaaggagttcactttttctctctattccatgccctttaggactactcataatcacaaatacatttgtgacccttctgagcgtaaatccacctgtctggggtgctcaataagtccaaagtagagtctatgtgcttggtaaatggctctggctagaaagcaactgcttggctaaatcacacctgacggtcttcccactgagatgggaaaatggggcagatagtgtttgcccaggagctggggcataaaaggattcttagtggatgtgatggctcagaagtgaatctctagttaccacttgggatctgacagtttttgagaagttctacagggctgtgaaagactgcacaggggtaaaaacaaaccttgtcattacattacaggtgttgagaatttctaaaatttacagtatataatactgattgaaaagtaaatgtcactgctactttggagttcagcataagccttatacagaggcagggtctgccagtgtggtaagaggatggccactgtaagggttaagtagccccacatctctttccctaccagcctgctttctgccctccagaaaccctatcatttatagctagtagtaaaagaacaacaattgcatttattgggcattaatatgttcctggtactatgctgaacagattatgtcttaccttgtttgatcatcccaacaacctatggggtaggtaccattatcatcccaattttatagatggagaaactgagactcagagatgctaagaatttgctcagctaataagcaataattagcaatggagctttaatttgaatccaaatgggacactctgaagtaaggcttctcctctccctaggacaggtcttggaagctgcatttttagcaagttccctcattcaggtcttaagttctagaaagtttcacactctttacccggtgctctacagcctcattatgaataaaacatcaaaggcctatgttacaatataattatctagaaaaggaccctgttttaaaacattatctaccattttcatttcagtatgaattacttaacgggattagtattaaggcctgccagcatgacctcaatgtgatgggccacaggagagttaagttcttatgggggaggagagtttggggaaaatctagaaatcgttggactctacccgaggaaagcagatctagttaagtcatcacatcaagaggcccaggggaaaaagaagtgatggcagttgaagtgctgaaaaaaaaaaagaaatctaaaggtaggcatcattgattcaactgatgggcccatttgaagcagtacctctgatctcagggagcatcccaaggaaaatgtcgtctgaatccacatagcctcagaatatgagcattgttactttttggaggtggggggaggctgcagacacccactcttctttgtttttgtttttgttttgagatagagatttgctcttgttgcccaggctggagtgcagtggcgcaagctcagctcactgcaacttccacctcccaggttcaagcgattctcctgcctcagcctccagagtagctgggataacaggctcccgccaccacgcctggctaattttttgtagaaacggggtttcaccatgttgactaggctggacttggactcctgacctcaggtgatccactgccgtcgcctcccaaagtgctgggattagaggtgtgagccactgtgcccagcccactgtttttgatacattcatcctgcaagatgtgttgcatcctggatgtatgctcttactttgcctgactgagatgcagctagctcccagctgctcctccctccattacagcagtgctctggtagaaggccatgggtgatttcccactagcaaccttatttgtctatgttccttccatttgggccaaggactaaaagccagctcagatttacacaattactttaacattgtttaagaaagcaatgtaacaacctccactttgcccagatggacgggctcaatgatgtcggtggagagaacccattattggaataagactgggaacacaaagtcatagctaggatctctcccactagtaggaatacagccgggcttctgatgaccagctttgtaggattgattttctatggttggaatggacccaaaatgttcacctagtctagtctacggccttcaagtagaagttttttcaaacgtagtcttcaaatttaatgaggaatacatttatatcattcaagaatatgaatgcatatgtatatgtacatgtatatatgattatatatctaggtatacatataaaagaatgcaatagaatatcttattcaccccgtcccacactcacccaattcttatcttctccctacaacatgtagttcccccccataacttttagtggttatatatctttccagatttttatgaaaatgtaagcaaatatgaatatatatatatattttaaaaatattttttcatttacataaaaggtagtctattgtgcacatcattttaccccttgttttcatcatttaataatatatctttctgtattagtgcacagagaacttattcttttatagaactacataatattttgttataataatgagccatcatttatttaaccagatttctatcaatggacatagaagttgtttccatattcagccattacaaacaatgctgcaatgaataatttttatatgtttcacacatgtgcaagtatatctgtagaatgaattcttaaaaataggattgttgggtcaaatatatatgtatttttaaatgaacagatattgctaaattgcccttcatcatgttttaatcaagtcttcacagacttaccaagagagtgttttattcaaacttttggatttttctaaatctgctaagaaaaatggtatttcattgcagttttaatttatatttctctaatgaatgaggttgattttttcatgtctaagggccacttgtagttccatttctgtcaactgtctatttatatcctttttccatttttaccattgggttatgaatctgtttcttgtcaatttatagaagctctttatatattagggacaaataggattttaatccccaaacagcaaatatgtgaagagattctattccagtgttttacagtgtcttatggcagcaaactctttcttcaaatgaaatttaaaaaagctaataaaaacacatttcactaacaaagtaagaggtattctgttgaagtagaaatggggaagggattttttttttcacatccctcaagtacctctgaagaatcctaaagcagcacagaacctagtttgaaaataatttccctacatgcctagttggcctgtggttccagtttctaataactctttcagcaaggaatcttttttagtatctaacctgaatccttattgatgcagttgatactcctccccacttaacattggcaatttgtgattatttgacctctcttccattatgaacctttatgtgttatttaaatacattatcatttaacacctttttgtgccttcccctccaatgaaagcaggattttacttgaagtcaggggaatgtcctatttatctttgtagctttaaggtaacataatgccaggtattgtcaatgtatagtcaaggatctattagtgccaggtatagtcaaagacctccacaagtgcttgttgaatgaataagaaaacaagagagaaatagtgttttgactcatgtctccatagcacctaccatacacatcagtgcaaagcaaatgcctttcagttagttatcatctatggaaattgggaaaattccttcatattcttcaactttactgctttcctctctgtgacctctttctagagcaagatcatctaccatttattgtgaatgttatgtaccagatacctttgggctttttaaaattaattatcgctgaacctcacagccacgtaaagtagaaggcatactcaagccttcctaagatcacagaaccaagacatgccaaagctggtgtcttagtctgtttgaactggtataacaaaacaccacaaactgagtagcttataaacaacagaaatttatttctcacagttctggaaggtggaaatccaagatcaaggtaccatcagatttgttctctggtgagggcttggcttctggttcagtgatgataccttctccctgtgagcctatatagtagaaggggcgaacaagctcccacaggcctcttctattaaaagcactaatctcattcatgaggatgttgcccttataacttaatcacctcccaaaggccccatctcctaaaagccatcaccttgggggttacgatttcaacatatgaatttcagaggcacacaaatattcagatcatagcagctgggaccccagagaccaatgtttgcagaccccagagaccaggctcagttatcttctcttgcatcactgtgagatacgcacatagaaacagcatcctattctaggggtttctttcaaggcctttttgtcattctctcttcccatatatttctgagacttggggtaaagccctttagatgatgtagttttactttgttggatgtgtatgtctctctgtgtgtcatgggcaattaaagggactataacctcttctttctagtctttaccttcatttccatgtcccttctccagccacctcccaatagcctgcaaatgttctaggactctatcagtagaatgacagagaaccaaagaaatgctagcatcaggctcagccatcagaagaaaagtaggaaccaaagtaatggcagcaatggcaaaagaaaagatggcttggcgtcaaggagattagcaactgatctctgaaagctctggggaggtttgtatttataacactgggagcagatttgtctcctgacatacaagctgcttttctgactatccaagaactgtcctactatggaaatgatcattttatagggtggggagagtggggaagagagcagtcagcatgaggacttggttccagagtgtgggaagaagggtaacaccaggagaggagggaaggcgtacaaaaagaagtgaagtggaaccacaggcttcttggtaaaatttgccagttgctctgaaggacaaaaaaaaaaaggcctgtggcagttattcagactgaggtgttagttagtgacaaggtgtaagtgtaccctctcatataattcttgggattacaaaatctgattgcaaaaggtagccatttaacctagaggaatggacttccaatagtggcattttaagcatcagtgtgagaaaaggtggtaagagacatttgggataagggggtattttctgagcatcccggaaatcatagttctgcttacatatgagatcatccctcacttggggagaagaaacctcctctttcccaacacatctgtggtcacatgacttagtgcttgtctgctcaccctacaatggttttttctccagtcctcctcttagtgctaggtgggaatttgactggaaacagaagagatgggggaggttagaagccacgcagcctggtcattcctattgtagcattccctgaggggccctgtagccagctttgctttgaactgattttctgctagttttcagtcaggaacactgaatgtgttccaaggatatttgtttactagcccagccaccttggaaaatctgggagaggagaaggtaaaatatgaggtggtttttcttccttctgcagttaggaagcatgctgtgttggccctctaaagatgcaaggggagatttgagtccatatcgcattcctagaaatattgaagcttaaagaggtaaagtgccttgtacaagattgtggggagtcagtaccattgagttgggattgtgactcagtgatcctgctctgaagctttaacacccattctgtgaagagcacaaatttgaaagcaggaaagctatatttctgagttggctctcttgttaaacagctgtgtgacatgggacaaatcttttggagtactagtagcctcattttcagtaattcgccccccacccccgagatacacaccattaagggtgttgcaagaatgaaataagaatgagatgttaagaattttattgcataaaactagccttaagcatgaccataattggtttctttttctttgattctactgtgtcttcctctctttctctttctccctatctcctgttgagtagaataatagactccagtgccaggttactcagaagactattgcaaggaagattctcaagatcattcttccactggaaaatctcaccctgcagttgccttgccattgattccttggtagaaggcccggttcaaaaatcaagccacattcttttgaggcaaaataattccaaacttcttttttgttgttgttgtttgtttggtattccaaacatctgccagctcccataagagccgtgacaaatattattttgtaggtcactgtagatttccttcaccacaaaatgctgagatttggaataattagagcccagggggcaaatgggcctgcttctgtcctttctctgatgggtttcactcatgtctgccagctgcagctgtctgattgtatacgcttgtgggcaggggcagggcctcttagcccagacagagttaattagtatgagttaaactctttctaggagctaaggctgtctttataaggcaaaagtaaggaactttctttatatcctctaaagggtcattaataagtagttaacaccctgagagtgaattactcagaaattgatgttagatcgacttatatagcaaagtatagaattgagttagttacccaaatcgctgaagccaaaagaagtgcattgtctgttttctgggtattttaggccacaacattagggacagcatagccttcatgttctagtggtttgggttttggtttttaattaaatggtcccttccttattataggtttgaagtgattggcactttttttgatagtggttatgagggaaggttctagaatcagtcagacatcaagttatatcttagtgctgccacttgcaagttgtgtcaccttgggcaagtcaatctcttaagccttagtttcttcatctgcaaaatgggcataatcatgtctacatcagaacattattagtaagagccaatgagattatgtatgtaaaagcactcattcctgcctggcacatagctagggcttgataaatggtatctattcgtgtattattattattattatggatgttattattgttagccttatcattttcactacatactgagaataatttcattctttttgcttgtttgtttgtttgtctgtttgtttgttttttgagatggagtctcgctctgtcgcccaggctggagtgcagtggcgtgatcacggctcactgcaagctctgtctcccgagttcacgccattctcctgcctcagcctcccgattagctgggactgcaggcactcgccaccatgcctggctaattttttgtattttttagtagagacggggtttcactgtgttagccaggatggtctcaatctcctgacctcgtgatccgcccgcctcggcctcccaaagtgctgggattacaggcatgagccaccgcgcctggcccattctgtttttttttaaacagttgtattgaggtataacttacccaccacaaaatagactcatattcattacagttttgactgatggaaaagaaaggatggttcaactctctaagcctctccctaatgaaacacacagctcccctgatttctctccttccactgtcttatggcaggcactttccaagctctggttgtatcttttgttggtttcaattccttttttcaccactcactagctttgtgacttcaaataattcacataacctcagcaatcctatttccctcaaatgaaaatgaaggtaagaatttaccctacttgattcacagggttgttatgaagctccattgtaataatatatgtgaaatctctttgtaaatggtctgctgggttactataattcacaaatatgagtttcaataatattcaaatgtcatattgtgtgcttcagacattagatgccttgagagatccagattgtggctggagttatttagagaatgcttcgtggaggaaaggcggcataagctgaaccttcaagatcagataggacctcaatgggtggaaaagagtcagggagtgggcagtctcggtggagggattaaaaaaaagcaaaaccacagaggctggaacaaacagataagcacaaaagtgatttaaaatgtaggcggtggccgggcgccatggctcacgcctgtaatcccagcactttgggaagatggggcaggcggatcaattgaggtcaggagtttgagagcagcctggtcaacatggtgaaaccccatctctacttaaaaaaaaaaaatagccaggcgtggtggcaggcgcctgtagtcccagctacttgggaggctgaggcacgagaattgcttgaacccaggaggcagaggttgcagtgagcagagctcgcaccatgcactccagcctgggcaacagagtgagactcagtctctaaataaataaatgtgggagggaataaagttaccagggcagtataatagatgggtccccttctgaagcaactgggggaaaagattaaatgagatagcatggactccttcctttcaggaaagataatatcttattcatctaggaatattagctccatctaggcagggaccttgtccatgttctctgatccctctctaacacatattacaattcctggcacatagtaggtgctcagtaaatggtcaacaaataaaagaatggatggatggatggatggacggatggatggatggatggatggatagatcataatgtcagctgctgtacttgtctggctgttttaacattattcaaaatcattggtcactggagcggggactgtcttaaaactccctctatgtagtacagccccgtctgctgttgggatttatgaaattcttgtcaatgatgccaatactcagtgtggtttttctccaccctgttctagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggtaagaccctacatcttaacattcctgctaggccctactcaaatacaagagcttcctctgtacttgtactttcatttgtgcctgcactgtaaggtgtttgaataaaacatgacttgcattaaatcataagcctccttgacaatccaaactccctgatcttcacccaccctgaacaactctgttgaagggctcaggcccaatcatatcccagtcttaaagctgtaggactgcttaaatgggcaaaggtgagctgtttgtgttgatcggcgctccttttcataataattataccaccaaagcctccatctgaaggactcacaattatttgaagctttgggaatgctatgggtggaaaagtcactttgactatctagggccactcactccaattaacaagaaaatgagttgtctgttagttcccatatctgaagtattttactaaccagttaattcctagtgccctgcaatgagaaaactctctataaatgcttggtcatgatgactaccaggacattacttgtcagaagaactgcatttactttacaaacaacgtatactaattacatcttatctaatatgcagtccggagaatataatcaatagaactagaaaatggagtaaaatgagtgtttaaactgaagcaggaaggaatgaagttagatgtagtaacaacttttctgcctgcaagtggcattaagcactggattgtcaagggaagctatagaatctcttccctttaggacttttagtaagaatatagtatctcagtagtttaggagaattttcgtgtggccttgctttcttaatggccttccaggaatcattctagccccaaaagaatgtgcttctaagaactaagaacaaggtttaaggaataacatttgaaagatagaaatttaggaaatcaggattattgcaaagacagatgtaaccagcaagtaaattttatcctctcccttgccttgtgctagactgagctgtggccatcagatcatcttgtatagttttgtattaccccagagagcttgttcctttggtttggaagggagagtctagtgaatattacaaatggaagctatgaaataaatcttcattcctttaaacccccaatccagctgggggaccaagggtaccatgaacagagaagaaagaaacaagactataattcatggttcagaggctcatggcatccctgacagactactttgtaccaccttagaccatgatgctcgactaggattgctaacttttctgtggcttagtctctggcatggaggaattgtaggagaaaaaaaataatgcgtaataaaatgtaggaagtaccgagaactgacgatgggagagctggggggaaggacatgccgtgttttgagtccctgctctatttcaggtattaagtgaagcctttacacttatcctagatgcttctaatcttaattctgtttctccttggcaggagggaaacgtgtattgtggtctcaagacttgccccaaattaacctgtgccttcccagtctctgttccagattcctgctgccgggtatgcagaggtaggtgtgttatatcccaagacccctgggtgctgctatcctgtgtagtagaatttagaaaggaggaaaatacctgtctaatgtcctagggaaaggtaatttttatggtagccttagtttttaaaggtggtttaattaacaaagggaaaaataaataaagcattgattttaaaggccacagcctttaaaaaaaaaaaaaaaactacaggatggagtgctgtgcttcaggggaggatgggaaagagtcatcaaatgtgaaagtgaatatatttatttctccatccttaatcccttctagcttggcccttaaattattgtatcataaaacacagactattttcattcatagccttagaaggaagaatggaccttgcaaggaattgatgtggccattttgaagactgtgcagggcaaatttaggtatactttttaaaccccataataagatggtgacaaactcaataaaagcaaaacagaaagcattttctcaaattatattcaaaattgaattgtcttctcacattagtctttttttctttaggttttattttttttataatggcaccagttttttcgctaggttcctgggatcaagtgtaatcccctttaatttctcctttgttacctcttctcagattaccaaatctttcagcagttatctgtatctctcccttttcccactttcccactggcaatatccttattttgtcctttttccttctatccagtcaacatattttttgaccatctactgtatgctcagcattgtgctagaattggggtatttatattgataaatacagtagatatatagggtggtgctagaccatatggcatctttatgtgagttacaaaaaggattcccttacataagatactttattgccatttttcagaaaatcccagggaaagcacctttgtagctgtggcatccttttgcagcacacaacctacacaacaatatatatagcatacatagcagccaagatatgttctttgctcttatggaactcaccagaaaagacaaataataagcaaacgtggaaatacagataatgcaagtactatgcagaaaataaacataggactgagattaaaaataagtagtttatttaggttgagttgtcaggaaggcctctctgagaaggtgacatttaagctgagacctgaaagataaaaagaagtcacccatgcaaagatcccaaagaagaacattctaagtagagagaaaagaaagttcaaaggccccaggcagggaagagcttaaagcattcaaagagcctaaggaccagtgtagctgaaatgtagtgattgtggttgaaactgacatgggatgaggctgaagaggtaactaggaattagaccatgcaggattctgaaggccatgggaaggattttggatttccatttttaatacattgggaagctattggaaggttgtgagaaagagtatgaagtgatccaattaacatattaaaagatctcactggctattatttccagactagactggagggaggcaataatgcaagtggagagactagcaagatggttagggtagtactctttccagtgtgagaaaaagggtgcttggactgagaacacagtagtggttcagagtggagcctttggagccaaactgccttggttctaatcccagccttgctactttgtagttgaatgaccttattcaacctttctaccaatctttaaagtgaggataatgttagctcctaccttcaagatgtttgtgagatttcaatgagataatataagagaaggacctggcacagtgtcttgtatatactgaggacccaataattaaaagtggacaaatttgaaatacatttggagccgtggttctcaactatgggtgcatattggaattaccttggtagatttataccagatcagaaggaggaggatgtgattccaatatgcagctaaggttgtgaaccactgagttagaggaaaaaaattataggatttgctggtgggggatgtgtaggtgacttctatacattactgccattttaatcttccaaaaagcaatccatcaccgtgttacacccctgttcaaaaatttttatgccaacatgtatttggacttactatatgtcagtcccagttctaactaagcattttacagatatgaactcacttaatctcatgacaaccctatgtgaggagtactattgttctccctgttttatggatgaggaaactgaggcagagagcggttaagaatcttatccaaggtcaggtagctagtgagttgaggagctaagatttgaatcctggcagcctggctccatatttcaggctctaaccacagtgttctgccactgaaagggatgactccctgtcgccactcaaatacatgtcaacccccgactctgatagtgaaggcctttcatggtctaacctcaagttacctttataggtcaatattcttccattcatgcacctcagggcccactgcattgttcctgtgctctcttacctttttacctttgctcagtcctcttcctgtcagtgtttctcacactttagtgtgcttcagaattgctcagagaacttgttgaagttcagattcctggatcacacctgcagagattctgatttagtggccttggagtgggacccaggaatctgcatttaagcagaccccatcgttcattctgatgcagaatggtggtctgtggactgtcactttgagaaaccattcctgagaccatgtagataacctggaaccaaggatttgttttaaaaaatctgagtttagtgcacttaaattgagcacattaaaattctgaaacctgagtgaaccagtggaaaagcaaccaatttcagttcctgattggttaaagcatctaagtccgaccatatggcaaccaatttgagatgaatgagtggtggccatttcatgataaggaactgggatgaaaaggagacaaaagggctgtctaagtaacaactgcacatgtacaggttggatggagaaaatgtttcctctttctggaaaattctttttctccatccctgcctgtggaagtcctgctagtccttcaagacctagcacaaatgcagcttcctcagattctattgcaggccgtcctcaggtcgcattttgataagtagtagttggaaggcctttcttttctgccttcccacttccatccctaatttctccacccataaatcctgcttatccttcaaaatccagcctaattgccacttcttccatgaaatgtttttaaatcctgcaaactagaagtaaacctgtctctactctaggactcctcagcacttaacctgtgcttcttctggagcatttatcaccttgtcaacttctgttttttattatttgtgcccatgtattatcatccctattaatgcataagctcttcaagacagatactctttttcatttatctttatttctcccactgtgccaggcagagtaggtgctctttaaatgaatgcacactagattggaatgattactagaaatttagtcaggatttgaattaggtgctaccaaaaaagaatatggttgttgtgcatttttccccctgaattactgattgactgtggtagatggtgttgactatacattgattcctcgtcaataggaaattacttggtctcattcctgatctccaagttgttttcttcccctataccactttaggaaactacagttaacattgctttttggaaggactgagcttgtttggactaccagtgtatgctcatcccttttaatatgctatttgcatcagccctcataagtcaatatggatttagttacagcctaatttgatttatgctttggtaaggccctggatctttccatacatgtttctcacaatgtgtgtgtgtatatgtctgtactacagtgtagctgttacatttcagtcaagaaagatggatattttgttcctcacctcctttcttgtcttggccccaacttaatttcagtgtggctcaaaagaaagtccatactgagcagaggtgtacatgtggttgctaatataaccagttggtcactataatccagctgttaggctgatattattccctttggggaaaaggatatgtgaaatctaaactggaaaacaattgataatagaaaggaaaggcaacagtgaaaagacatgtcactgcaacctaggggcaatacggtataatgcaaaggacagaggctctgaagccagaaggtcatagatttgacattgcagggctaccacctacgagtgctgttatcttggacaaactatttaaccactcaaaaccttggttttctcaggtgtaaaaatggagattatgcttactacgtatgaaatgggttgtgtagattaactgagatggcgtagagtgctaggagatggcctaatacagagttattggtttataagtaacaattactatattttatatagtaattactatatttattacccccgagttaagtatcattgcaccttctcctctatctttgatagttttgcctttttaaaatgtaatctccatagacagaactttagttctagttcttcttgtggtaacagatcctggaactagctattttatgtactgttctatcgttacaatttaaatttcttttcttttttatgtcctcagaagcaacagataaaagctagttattactggccatgtattgtccctttatatacttgataattcattaagttctttctttgcaacctctcatccagcctaaatgcacaattttctttcatcttcctttataaagactaaatcctacacttttgtaaaaattgttgttctttcattgcctccagtttctttgcatctttcagctgtatataatgtggttgaaactcctttgaagttctaacttttgaagcacctagttattttttcccatggaaatgacgtttttacaatactgtatcttatataagcgtattactcatacagcagggaacccagaaacctctcccctatgctggccaccctgactgcaggccaaatactgaagaagaaataatcttttgactgctgaacttgcaaaccttcatataaagggcattgaaatagcctctctgcactgtccccaaacactaatgtgtgtctttcttcctgggtcagacagcaatcctagacgcggattgaatctcagacctagccttcattggctagacgtgtctttgaggctgggacagtcaaggagagcgttggcagaatgtgtgtcattgctagcacttcagcaaacctcattaggactggaagcatagtgcaaacagccactggaaccttaagggaaattttatcagaagaaaaaatctcttcagatcctgtgttagtttgctaaggatgatagcctccaactccatctatcttcctgcaaaagacatgctctcattcatttttatggctgcatagtattccatggtgtatatataccacattttctttatccagtctgtcattgatgggcatttaggttgattctgtgtcttcagaattgtgaatactgctgcaatgaacatttgcgtgcatgtgtctttttttttccccaaatactgcatgttctcacttataagtgggagctaaatgatgagaacttacgaacacaaagaaggaagtaacagacactggggtcttcttgaggatggagggtgagaggagggagagaagcaggaaagaatctgtacaacaaaccctcatgacaggagtttacctatgtaacagactttcataggtatcctcaaacctaaaataaaagtttttttttttttaaatctcttcagagattatactactgccacattctgggaaggcaggcttcaaacccaaacccacacccagcttccctccaccattgatcatttccacttcctgtcccctgctcatcttgccaaaacaacagggaaggctatgtacttggactctagacaagggaaaggtatttggggtaggtattaactgtattgaaagccaagtatgcatttagtaaatggtgtctaaatgtagcacgtacaatgtgccagacaatgttctaagcacttatgtgtggaatagctcatttgatcctggcaaaaatagtagcaactatttatatccccattctacagatgcggaagctaaggcagaaaagttgagtgatttgtccaaggacaaatggtagtaagtggcagagctagaattttaacctggtcagtctggcttcagagtttcaagctcttaacttctatactacctgttgggacccattcataggagtatgacaaggatatctcctagtacaggggagtaaaggggaagacgggacatgcatggcacattgttgtgtgcagatactcctaagagagtatcttaccacactgcccatgttttcccatcaaggccttaacttacccttctctcactctaggcttaaagtgtcttgagtgtaaatgtctactttctttcattcagcaaacattgttaagcaatcactaagagcctggcactgcaccagtgctagagatacaatggtgaacaaaaatggacatggaacctgccttcatggagttttagtagggaagatagacaccacgtcatgatataagtaattataaaattgcaactgtgccacatgccacaaaggaaagttgttataaaagccaataattgagaggggttgacctagtcagggaggtgaaggaagacttctgagactgtctctccagcctcaactcgcaccacatccctccttgttctctgcactccagggtgaggaaagattggctcaaaaattagggagataactggtggcagtcatacactcctgggatccccaacttctgatcccaccatgaatccagtccctccccaggctgtaggggtctataatgttctttctacattatacatgctacataataccctaatctaggaattttcttttactcttctttcttttggctgtttcctgtttttcagagacagggtctcactctgtcatccaggctgtagtgcactggcacaattatagctcactgcagcctcaaactacaagctacccttctgtctcagcctcctgagtagctgggactacaggcgtgcaccaccgtgcccaaccaatttttttttttttttagagacatggtctcgctatgttgcccaggttggtctcaaactcctggtcacaaatgattctcctgcctcggcctcccaaagtgctgggattacagacatgagcccagcctaggaattttctttttgagaaactacttgatcatgctaccatttcttaccatattatccaatctgaatttttcagcttgtttttaaagaccctctgtgaaacagtctgatccttccttaacctactttccagcctcatttctctgacaccaacacacacatctcctttaggctggctggctgatctctttgttctgttacatgctatgtttcttcctaccttccctcctgttatgtgcttcacttaaactgttatttttcacaagcttggaatagcccccgctcctcttctacctattcgcatcctactcatctttcaagggtccagttgaagttgcacctcttctaatagttttgcccaatcactctagttctcattgatcttctttgaccaccttcaggacttaatctggttcaaaaataagcattcagaaatatattcttgcactgttattgctttgtgtcttcctgtttcccctggcataacataatattaatcatatatcatgctgactggtttatttaatacaaaaagagccacagtcacaaaaagctcttgacagcattccaagtacagatgcagtagggaggcaggagaaatggtggaacttacaatttgctcaacccaagcccgttcatccaacatatctcaaatgagcccagggagaaaatggaagtcactttttatgaaattttgatatttctgctaactccttcaaggtaaatgaaactggaagcaattgtttaaaagtatattagtcagtgttcaagataagtgccattttacctaagacacttgatttctctttccgaaagagcagcaaaattgcacctcagatcccatctcagctagaatccgggatcttcagggaagtggtatgtgagatacttcattgattttaaacatcataaaaattgaccagtttttcaaagttttcaaaatcaaagaaaactgaagaaaataacagcaaatccaaatatagattctcacaaattagtctcaagttgtttatgttttggcccacattttctgcagaaacaccaccatctcctggtcatgatgataggaaagaaacattgttaatgagaaacactactttaaaaaatgaaaattcatcttgtataactgaaaccttatgcctgttgattagcagctccccacttccccctccaaggtgaacaagttctaaagatctgcagtacaacattgtgtgtgtatagttaaccatatagtattgtatacttaagtttgttaaaagggtaaatctcgttaagtgtccttaccacaataaaataaaaaaaattaaaattaactcagtaatttttgagtttatacattctcacctaaacttcaaaatacagtccgccctctatattcactggttgcacatccatggattcaaccaactgcagatagaaaataatttttaaaaacacgttaaaagtaacagtacaacaatctaaaaattacaaattttagaaaccaatatagtaaaatgactatttacatagcatttacattgtattaagttttataagtaatctagagattatttaaagtatatgggagtatgtgtgtaagttatatgcaaacactatgccattttttatcagggacttgagcatctgtggattttggcatctgtggggggtcgtggaaccaattccgcatagatactgagggacgactgtgtattgatatactctgatattttcatagctatagaagagtctcgctgtcattaataataccttttcaaaagtgaatcatttatgttcatgtgtatgggaccattttagagatttgccatcctcacctacctctcctcatctaaatcccaactggatctccttccatggaaatgttccagattgtttttgctttctctccatctcttgtgctcaaaattcatccccacgtacttgctgactgtcccaggaccccgtccctctaaggtcatcatgttccttcttggcatgtttcttacgtctagaatatttcttcttgaatagaaagtcattcagacagtggatgggacagcgttgactttcacattgagtttaacaaattaatagcactgattcctaatcggccatctgggttgtcctgtcagggtcagtaataccccattctgtttctgggattggaggacttttttgtgtgtatatgaatctgtttctataataaaaataaggaattcccagtgaagcatttcagagcaattatttcttcatgggtggttaaagccactctttcttcaaccttattctttctaactccttcaaggaattccatagctgcccagaaacaccattggatgtgcccattactcacattataatagtctttatgagcttagactccaacaatttatagaaatcaacctggtttgttgactgacagtgcaaacagaggtaaaagatacatgagaaggaagagcagtgtatacaactgactgcttttcattttcaggttgaccagacagtcagcatgggtaggtcattgagtttctcctctctgtcctgctttttattttcagttcatggatgtggtagcacagaactctactttatttggatacttggatttttttttttaagacagagtctctgttgcccaggctggagtgcagtggcatgacctcagctcactgcaacctctgcctcctgggttcaagtgatcctcccgcctcagcctcccaagtagctcagactacaggcgctcaccacatctggctaacttttgtatttttagtagagacggggtttcccgatgttgtctaggctggtctcaaactccttacctcagatgatctacccgcctcagcctcccaaagtgctgagattacaggcatgagtcaccgcgctcagtgggcacttggatttttaagacttcactttataactttgtaaattgtactcctaccaatgaagcagatatctttcctgtcaagcctcatttttagccaagagagaaaagagattttaattaagatgcaaactcttttttaaaaaattggaaatagaggactagcataattatgagaaattctaagccagtttagaaggtgtgagccgaagaaatctctctagccatttttaaaaatatctccaggaccctgtcttccaatgatttagagatgaaatgattccttttcaatgtgcaggcatgcagttatctttgctaggctttgtttgcttgtttgtttgtttgtttgtttgatccaagcccttttctttgttaaatacacagcacacttgtgggagtcccttaagccgggtattcccccatgtgtaagctacccttgaggagaaggaggaaaaagaagtggaggcaaagaatgggaagaaaggggattaggaatagcagctaacatttagctgacacagtgtgccaagcacaattctaaatgctttgcatatactaattcatttaatcttcacaaccctataaggtaggcattattgtctccattttagcaataaggaaactgaggcacagagaagttaattcatttgcccaaagtcacataagtaggaaggagcagagccagaatttgaatccaaactgtttggctccaatctgttctcttagccattatattatactgcctctcaacttggggaagcaaagcaaatttgggaactcttatttctgaggctaccgggaggaacagactgtgtgatgaccatctttccaggggccagatatggtaacaatccagcagatgcattgggactgctctgagaagcaaagattctgtttctcaccataaacttggatctgtttagccacatctccattgaaagagcagagtgtggatggtgggtaccatccagctcgtagtttctgtattcactctcttctgatttcctcctggaaacgcatgcattctcacaatgcactttttaaaaagtaagtatttatgatttttctggacaaataattttgtactcttcttcagatttggcttgctactgttggcaggaattccccccgttgtgtgtgttttggtatttctcaaggagctattttgttaaaaatactaagatcttatattgacagcccaaacaataaagtacttcatttgacaaagaagtattttttaagaaaataactgtctgatcctttttatggctgtatagtattccatggtgtatatgtgtcacattttctttatcccatctatcattgatgggcatttgggttggttccaagtcttgctattgtgaatggtgctgcaataaacataccggtgcatgtgtctttatagtagcatgatttataatcctttgggtatatactcagtaatgggattgctaggtcaaatggtatttctggttctagatccttgagaaatcaccgcactgtcttccacaatggttgaactaatttacactcccaccaagagtgtaaaagtgttccaatttctcatcctttccagcatctgttgtttcctgactttttaaggatcaccattctaactggcatgagatggtatctcattgtggttttgatttgcacttctctaatgaccagtgatgatgagctctttttcatatgtttgtgggccatataaatgtcttcttttgagaagtgtctgttcatatcctttgctcactttttgatggggttggtttttttttcttgtaaatttgtttaagttctttgtaggttctggatattagctctttgtcagatagatagattgcacaaattttctcccattctgtaggttgcctgtgcactctgatgatagtttcttttgctgtgaagaagctcgttagtttaattagatcccatttgtctagtttggcttttgttgccattgcttttggtgttttagtcatggagtctttgcccatgcctatgccctgaatggtgttgcctaggttttcttctagggtttttatggttttaggtcttacgtttaagcctttaatccatcttgagttaattcttgcatgaggtgtaaggaaggggtccagtttcatttttctgcatatggctagccaggttttcccaacaccatttattaaatagggaatcttttcctccattgcttgtttttctcaggtttgtcaaagatcagatggttacagataagtggcattatttctgaggcctctgttctgttccattggtctatatatctgttttggtaccagtaccatgctgttttggttactgtagccttgtagtatagtttgaagtcagatagtgtgatgcctccagctttgttccttttgcttaggattgtcctggctatatgggctcttttttggttccatttgaaatttaaagtagttttttctaattttgtgctttataaaacttgcagatttcttgtattgttgtatatcatcattggaagctcaaatgcctatcagtggagaatccttatactagtttccttttaaagcttctctcaaatttcagcacacttgctccctcccagcagaatttatagaattagatgtttggcagaggctccctaaagtcatctgcttctactcacttcttcatctctagcttcggtatggagcactggcattaaagtgctcccccatggaacccagctcatggtaaggagagacttcacaatgggtttattcctccctgctctcttccactttgccctgattctgctcatttcaacttctgcctcaaaaaatacagagaacatttcccctgtctcagggatttgtctcatgtccctttgccttatgattagagtgactatgtaatttactatctcaaccgaggcacattttgaaagcaagagctgcaatcttaataattatgcctgccagaaaaacaggcaataaaactgagttgtctgagataaatctgctctatggctaccctatttatgatgtatggttcaaaagtggccacatgctggcatagttttgctctctgaggcttatcttcatgggtatctcggaatctcattgtacacttagtccttttgagaggacagtttacctctctgacctgctcaagccaccagagattaatggaagccacaggagttataaacagtctgaatttcagcctagcttttggccatttttcaaatacttgttctccctttctcccactactagaaagccaacccattacagcttcatagggtaccactcagagagagtatgactgaggtttgaataaacaatacatgtggcttttagggttaaatgaatattgtttgacatacagtacactacacttgtttttatttcagttcaaaaaattggttaaaattatatcttgttgcttctcaaaattaattagaatccatctgaatccattagaatctctgttttttgttttgttttgttttttacaaaaagacttggctgaatgaaaaagcctccatctcattcagataatctttccagtgatcagacaaaaagagcaaagaaacaggttttttagggtattggtgcctactttttttcaaagtatgatatctaaggttgcaaatggacatacctattttcagctatccagacagactgtacccaggtctagagaaccacttatagccttataaaatgtcaacatctaagaagataattccagtttaattatgggttaaattaaatagaataattcaaatgttaaaacgtttagcagctacttaatagacttaatagaacattgaagtttagagaatgcaattttgatgactttgaaagctcagaggcaccagaaatgctaacagttcctagtatttatatatttaatgtatataatttataatgtacatagtatatcttatatataaatatagtgtatatatacatatatgtgtgtatttatatacaggttaaatatcccttgtccaaaatgcttgggactggaagtatttcagatttccgatgtttttggattttggaatatttgcattgtacttaccagttgagcatctctaatccaaaaaccccaaatccaaaaatgctccagtgagaatttcctttgagcatcatcagcactcaaaaacttctggagcattttagactaggaatactaaaacctgtatgatatatataacatacagttttagtatgatatagatgatatatatatatatatcatacagttttagtatgatatagatgatatatatatgtaatacaggtttagtattcccccattacttgtttttgtcaggtttgtcaaagatcagatggtatatatatgtgtctgtgtgtatatatatatgtgtgtgtgtatatatatatatgtgtatatatatgtgtgtatatatatatgtgtgtgtgtatatatatatatatatatatatagtctccattactttttaatgaagtgctgaaatttaggtatgcattcttgtctgcaaatgctcatcaaatacacatcacgacacactcatctgatttgtgttacagggtattagtattcttctcctatgcctgatagtgacttgcctccttgattttccatcttacctctctgctcatttgtaagaggcgctatgtgcttctataatgctttgagattctgactggactataagtatttaatgacactctttaattaaaatccttttaaaaactctagggtataaattaaataaactgaacttttcagaaggccagctaagtaaacattttatgtcaataccaatcattaaatctacattttaaaaggacatttgatgaagagaactagtctatcatttttcttttgcaacttgttttctcccttttgactacttaaattaggcttgaaaccacattatatagcttttacattttgttttgccatttgctggtaaatctttactggtttctattcgtctctctagtcccatattttatttggcccagacccactactgcccactgaaacaagggggacaagtaaatctaagctcatccctgctcaatcactgtccccagctctccagatttgcaacccaagagttgtcagatactgatttcccctttgccttccttccccatcatcaaatcttccttcagggtcttatcagtttcttttcatctgtaggagtctcattcaatccttcttgtgtgttattgcacagatgctcatggcctattacatattactatagcagcttcctgtatggcctcctgcattcgagttactccccaactagtctataccccattgccagaataggcttccacaaatatcagttttatcataggaacccctacagaaaaattggcaacataatcaaatgtgaattcttcagccttttacaaaattttatatttttttgaatttttactgtttactttttacaatttaattattttcttaaaattgtgtgggtacataataggcatatatatttatgaggtacatgatatgttttgatacaggcatgcaatatgaaatgaacacatcatggagaatagggtatcgatcccctcaagcatttatcttttaagttacaaatgatccaattacactctttaagttattttaaaatgtacaagtaagttattattgactatagtcaccctattgtgctatcaaatagtagcacattatttactacccctatttacctcaacaacacaccccactgtcattctccctccctccttcgctctccctctcctccctttctctctacaagttcaattaccagcgtaatttctcttgttttcatatctgaagtttctactcaagccacaccttgcttgctgtctccagtatgtgacttgctgtttacaaagctctggtcctttgccaatgtcactccctttggttgaggtactctctgcccttatcactgtcggtttatgctgtgcagtatctacttctaaaaatgtgacttaatggttctttcaggaagctttctacgattacatctgactgctcactcatcccattcagtgtctcctaagcatgtgtatttcatttgtatttgctttttttgtgtgtttttaggctgtttcctatattgatttcccatcacctccaacctgggtgtaaatatcctgagggcaagagcccagcctgattttctcctctttctgctgtagtatcaggctcttcacccaagaagtgttcaaagcatgttaactgactcttgggcataattttctagttataaacatagttgaaatcatctttgttttacagtagtcagtcagggtttccacagagttcagcttgcagtctacaatctttactcagacatggaataaaacaggcagaaaagagtatatatactattgaccaagcacttaattctgtatgttttactgcagttcaattcaatacatatattgagcacctgatgtgtacgcagcaatatgctaagtgctccagcctggttattcacaaactcctgcatccatcagaatcccctggaaggcttgtcaaaacccaggatcaccagcccccatcctgagtttctgacttagtaggtatgggttgggatctgaaatttggcatttctaacaagtttccaggtaatgctgatactgctagtccaggaagcacattttgagaagcagtggtctaggagatacagaggtggtctaagacataatctctcattccaaggaatttacagactctctagggagacaaggaaggcccagaaaacatttaacagtaataaatattgtacagtgttttagtatttattgattcgacaaatattgaataagtactatgtgcccagcactgccccagatgctggagttacatcagtaaacacaatagacaaaaatccctgctgtcatggggggattctaatatgggaaagcagacaataaacaaaataaataaaatataagaaatataagatagtaataactgctaaggagaaaaagcaaagagcaggcataaatatcagatgggggttggaactatagatagggtggtcagagaaggcctcccagttccatcatttgacaagtatttattgagcgactactatgtatcaggcactgttatagatgatggtgatatagtaacacaggtaatgaacccttttcttatggaatggacatacctatttgggagccaggtaacctagagttttggtgttaattctcacaaactcattattagactctgaatggctacttcccctctcagccatggtttcttcatctgttaaatggagcagttggacaaagttatgcttgacgtcctctatacttctaaaacttcaggatgcttagtcttttaggcaatcagaaatatgtaagagtgtttgaagaagactttgcagaggagagaaaacttaaatggttttcacaggcatgggggagctatggggtgtgggagatggaaggtaatttcagaagaagaataacatgagctacagcacggaagcaacaatgggagtccagtattcagtgaagagcaagtagctcaaagggttcccattgaagagtagctgagatcattgggtaggcagtagggggtgattgtagagagtcttggttgggaacccactgagggttttgatcagggaatgacacgattatacaatcaaagtggtgttttactgttttatgaagattaacctagcaaatagttaaatcctcaaaattcattatttttcatcagataatatttgaattatgaagatttacagtcatactctgttataagtcactgcctgattctaatattgctatcaaactaatttttaggtcgttttcaagcccttaaaagcctatgatactacctaatttcccctaacactactactacatgcttgaactggtaacatgttactctttttgtgtgtgtgtgtgacagggtctggctctgttgcccaggctggaatgcagtagcatcatctcggctcactgcaacctccacctgccaagctcaagcagttcttctacctcagcctcccaagtagctgggactacaggtgcacaccaccatgcccagctagttttcgtattttctgtagagacagggtctccctgtgttgcccaggctggtctcaaactcctgagctcaagtgatctgcctacttcggcctcccagagtgctgggattaaaggcatgacccactgcacccggcgtgttactcttatgaaggcttgagagagtaatcagaatagaaaattcttagtacttacacttttttgtgtttctggttatcttataaaatatatgttgaatattaggtttatcttcagccatatatataatttaaatagtactcatttcaagtgatgcaaacatctctaagacaaggctcttcccattcgcttgcttggtcagaggtaacacaagggcaatattcttggaaatgatcctcttgttttttaatcagttgaggtatatccacagctcttgtgtgtttgttgctctagaggctgaaagtagaatattcttcctataagcagttactttagaagataatgataaggagttctctgtccaaagagtgggtcatgtagacctagagaaaggtgtgtcataagaaattatgacagatcaaatcctcaaaactcattattttaatggtagtttaaacagaagtgaattatgacctgcaaaacacttaactgtcacgaagtaaaatgagcaaaagtgacagtgatggttaaattaggtggaaagtgattattttccttttattttccaaattctgcataatgttgctaggacatctatttagaaagtggcaactttcttcagagttgttttgaaaaatgaggcacacccagagaaatctttcacagccgctttttgaaggacagccacaaaagcaaaaacacttcaagaactttgggatcatagtaccaaaaatgttgctgggtcacaagggtgataactttcccttttatgaatgtatgattttctccttatttctttttaataaacaggagatggagaactgtcatgggaacattctgatggtgatatcttccggcaacctgccaacagagaagcagtaagtgtgaatagctcaaataattcaacactccacagcatcaggccaagctttcctctcctcgtggctactattctagcaaatccaaaaaaaaggcccgatttctaacaccatttttcttcccttttctcaaagtttttaatgtcatcaccaactggaaaccatttaagtacactgtaaaattggtaactggaggcaggaaatgtgcacaaagaaaccatagccccagccctttgtctaggtcagaagttggtactctttcaggatgacttgccaagtctttatgtgttctctaaggaagctaggtcactcctatcctcaacagtgaggaccttctgtagggttgtaggatacaaccatctttttggtgggatttggtaggtacttcagacatgtccacataaactctttcccaagccttaggctctcagtcatacagttggaaaagaggaaaggtagcagtctggattctcctctcttcagcctggtgatgtctcccttctgttctctgcactaatctcagaataagcctcacaagtaggcatctgtctatgtaagtaatagcatcttttgttcttttgtattttgaaggaatttataaaatagcattcctctctaaaaatatatgtctaagaagctttacactacaaatttcttaaaatctgaaaaggagatgttccgattcaaagaatctatcatacaaaatgcacagtggtgaccattgcacataaataggtgttcatcacatccttgtacaaaaaaagtatgcaaggacattcactgcgttgttgttttcataaaaacaaaacaaatggagacaacctaaatgtctactagggacttggtgtgtacatccaattaatgggacactgtgcagttgttaaaagaatacggtacatctaaatgtagtaaagtgaattgagctccaagatatgttaagtaacaaaacaaggtgcagaatgaaattgtacactatcacttctttatgtaaaaattgtatgtgcatgtatataaatgcatataaaccaatctggaaggtcacataccaacatgtcaggtgtgctaatcttaaaggagtagaagtgggcaggaggaaaggtagattttgactttttactttatattttctgtataatttgatgttttcctataagcatcaattagttttgtaataaaatatatttgattttctaaaaccctagaaaaatctcagcaaggattgaatatgaggcaggagtccagggaattacagggcaagcctgaggatattgagcatgtgaggaagatgttgataggggatgcagtagaatgactcatacaaacatcacagtgctgctgaggctgggcttcctggtcatcacatgggccacttctaacttgcatgctcccagcttgccaacacccaacccaaagcttcagcagtgagatggaaccatttctatttgtcttactctctatcagtattattttctgaacactgctgtttctgaatagttgcagaagaattggggaaaggggtttggagaacagtactctggacatctcaaaaaatcagcatcctgcaagagagggtaggcttccctgtttgctggttaatataaaccctgaggaaagattttctccacccaactctatctgctttatagtaagtgagattccttccagagcctgacaggagatgatgtcagtctcagttttctgtgttgtctgttcctctttttctcagcccctattttttattgtggtaggtagttgagagtggctgaattagtggctgtcaaccagatgtcattctaaaccaaatttagagtttagtcaccttaagctatgtgacttattccctgagaggcccccacactaagcactatggccaccttagcagtcttgctggtaatgccatgaattagcctttcttcttgacttcattttacactgccctcaattccagcccttatctttcagcttcattgacaggcctagtgataggcctggacttaatccagtacttcctgtagcaaaaaaggtcgggtacagaatgtgggcccttgaaatagttattgattttcaaaggagttcaagacctatctttagaaacaaacatttgtgcctggtagaccaaaatggccatatggtttcactttattataaataaatatttccctttgttctaaaagggatagatattgtgggatatgatttgaataataaatagcatctgtagtaatggaaaaatatatacctggcacatagtagtcacccaataaataaacattgaatgaatgggtgtgggaggtggcgtaaaatgtgtgtgatggtggagtggggagggggttcctcattaattttaatgcacaggaatttgtctcaaatcagagataaactcttcaaatttgttgtttgctcttgaccagcctaaaatgagaaaataggagaatcccttctgaatatcctttgcaggcccaacttcctcagggcaagaagaaaaggcagccctaacaacagatttcttatccaggagactgtccttttcgtaaactgttcctatttaccgggaaccagcaaaacctctgttcaacagaaatacagctgactggtttcttttgccaggtggtctgaaaaccatcggcttagcaagttttatgaagtgcacaggaagaggaaccagtggttcaaatatgactcctttgtaaaaacctgaaacagtttttgtttgatttctaagttgtaatttctcatgaattggtcctcgtgccattggtggggagtgtgtctgcgtgtgtgtgtgtgtgtgtgtgtgtgtgtgtgtgtgtgtgtgtgtgtgtgtgtgtgtgtgtgtgtggagtggtgtggtatgtggggaggaagaagtaggtgcagactagaaagccaaaacatgaaagcatgcataattttgttttggacaacagccaagccctgatttttgccccctgtagattacgttgaaatttaccattaaaaaaagtgaaagcgtttgggatagaaacgacatgaaacagataaaaatccatgtctcatttgtactgtcagaacaatggtttgggaaggaaattggcctaagtgtcttccagccagagatagtcctaggttggtagtgattaagatacaatgttttaatggctgtatggattagaatatattctgaagccgctttttaaattaaactttttttattttgagataactatagattcacttgcagttgtagcagaaaatacagagagatcccatattccctttgcccagtttccccaaatggtaacatcttgaaaatctatagtacagtatcacaaacatgagggccctttctggaccctgatgttttcttgtctacaccaataaaactcttatattttagactttagaacatgaaattcttgggggtcctctacaatagtggggatttttcaacactggaaaagaactgttttagagccacctctaaagcctgaaatatttttcagtctttcaagtaagtaaatcaaaaaataccaaaatactgagcaaaataaaagatcatagctatatggtcatttctaactggttttgacccgctctctcaagcaggctagttgcagctaatttttaagataagctccaatttcacttacaacttcagggcgttaataacctttttctcctttgctctgagttacaaggtcagaatggcccctcataagtctctttcatttgtttaggggaggaactctaaaagaaccattacccttaaatcaaaatcacacaccaccaccacccactccagcccccaaacagaaaatcctttatgtcagtgattcccaaccttggcttcaaaccagagtctcttggggagtatataaaatcctaatgcccaggccttcccccaaaccacttacataaggatacctcagagcgggacccaggtatgagtattttttacagctcaccgggtgattttagtgtatagccaaagtggagtatgtggtatatgtggttgtgaacattgtagctgaatgaacttttgtatctgaaagaacttctctttgcaccagcttttagtcaaatggttatagaccactgagtttgattggacattctttcttccactttctccttcttctccttctcttcctccttctattcatcttccccctactcctacactcctaccatctccaaaaactcaatcttcattatcaccatgagtaaactgcctctcctccttggcctcagtttctctgtctgtaaaacaaaagacttcaacaagattaggttctgggggactgactggtctacaatagggcctgtgatcaaaattcttgaggattttgttttttcatcatgatcattttcctaccattattatatgtcccaggtctgagacgttggtgctaaagaatggcttttcattttgtgttcaccatcatgagtcagagaacttctcgtacttgcagcttatcctgggtcaacaaccttccctctctaattctatcccagtccaactgcttctttttaggatcagtgggacaccaaccagccaaactgtcctctatgtgttcctttggcaaaactttgccaaacttcaaaaaggacagagcaacctataatggcctttgtggaatgtgagtgattatggcagaaaaggacatatgagccattgtgggaatgagaaatatttgaactgagaatcctatccatgtgcatgaaaacaaactgatgcaaatttttatttgtgtgaattttgatagcaatgcaccaacataggctcttcttagatagaataacattgtctttcaaaaggctaaaaaaggtcctcttacttcagctcctgtttactctccctttcccctaccagtggccccttcctgccaagagggcaataatacttcccaaagtgaaatttgcaacatgcctgtctgtggcccataactttaaacagtgttttatgggatatggtcaggggaccccataactatcttcccaaggttcctcactatttctgtcactgaatataaagaccttccttttcaattgcctgtgaaagagttttttaatgggttccccctccttcacccctaacaattgcctataaaatacaattaatcttacttggctttaagccttaaggttccattcttcattcatttcatcttcttgtacccccagcctactttagctcctgggagaggggtgggtagcacaatagtctggtcatcacgtgtgttgaacccttgctgaaagattacttgtatgacaagactctaagcttttcttaggtaccagagttttgttcactcaacaagtatttgatgaacaccttctagatgcctgacactaaaatctaggcactggagatatagcagtgaacaaaaagtccttgatttcgtagagcttacatgccaatactgtcatgtactatcaattcttctacctataaaatacctagggtatttgtactgcattgtatgatcttatgccattacctgtctttagagtctaagtacatcttatcaagactatactcgaatctcatcttttcctcctatccagttcaccctatgcatgatcaggattcaatgctttgaaacagttctgattacattatttctctaactttaaaaaaaaaaatccctcaaagccttctatgccctcacctctattgcttaccaaataaagtcttcaccccttagcctgtcatttaaagtcttccatgatctggcttcaacccacttttggaatgttattctgcaactgttcccttttatggactcgatgttctcttcttcaccttctcaacttgtaaacctctgcctggactattccacttaacttctgcctgtaaaaaagtctacccatccttcgtggcccaggtcacaagccctccccaactagaagctctctctttctccttctgatttgcacaggactgcttacttcttctgcagcctctattcacattctgccttgcgtgcagactactgtcttaactcttaaactgaaatgtgagagtcttggcagcaggaaggacgctttagcctttttggctcttttctccctgagaagtttgcctgtaaatctagtcctatcttttagaagaagagagataaaccttggcaagttgtcattaaaaaaaaattttaatgaaaaaaatgtcagctgcttgtacatgaccacatccctatttctattggtgtaggtaagcatgcagctgaaatcagagctcaccactataaatcaaaattattgaatgacttctagtatataacttaatctctgtgatctcattggtggcttttggactaaatttgttcttgttattttacagagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaaggtaaggggcatccttcttttgtatacttccacaacaaggcttcagcagccctggtctttgcagggctggagctgggaaaggaccctttctcccaggaatagcccatattcacttgtggctcacttagcatcaagtctgtgggtatagtcaggtgactccaggagactctttggacttccttaaatgcagccaaaagagcatagtccggtcccttttgtaaacagcctcttgtattttctcaattatccctggggattgtaggtcatttgggaaaatttcttgggtctttaacagaatgagtgattgtctgtgttttagtaggggacccaacattcaaaggtactcagtgccaaacatcactgaagctcttatctataccttagaaatagcaattctcacacctcaatgcaccccagattaccctggggctctcgttaaagatacatattcctagccccacactcagattctggttaaatgtgtagcatatgagactatccttagaaacgagtaatccaggtgcagtggctcatgcctcacagcactttgggaggtcgaggcaggaggatcactcgaggccaggggttcaaaccaggctgggcaacataataagactctacaaaaaaaaatttaatgaaaaaatattagccaagtatggtagtgagtgcctgtagtcctagctacttgggaggctaagacaggaggatcacttgagcccaggagttcagggttacagtgagctatgattgtgccattacactccatcctgggggacaaagtaagaccctatctctaaattaaaaattttaaaaaggaaaaagagtaatccagtgagaaatcccaaaaccacctggctgagcaccaggaagactgatcaggttaagactgacatgctgtccacttagttgatcaactggctacagcaggcacccatagacttccatagcttccaatgtcttcttacacagcattttctggcctccacccgccccctgcccccacccccacacacaccagtagcaggagtcagggaggagaaactcaatcaaacaattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaaaaattaaattgcttttgaaatttgcaggcttaaaaaaacattcgaaataaaaccattaatggaaaatggtgatgtagtagaagaattggaaatacttactatcgatctgtgtttgatttgtattttattatttttaagttccaaggatttctgataaaagcttatgaaatcaggaagaaaggtaaagatagcttgattttcaattctaaattgcctccaatagattccatttgctgtgaaagtatttcaaagccttttaaaagtgtagggaaatggattttgaaaatcctaaatcccataatttccacaaggtctctttaatttcagggcagaggctcatcccttgattttctccatgtcctacaaaaaccccagctggtttacatttattcatttgcccccactgatttggatgcaacagttctgttctgacctttctaatatagctcactgaggaatcacttgtccccacccccaactcccaagctggatgattcaaaatcatctcgataatttttggggtaaggagagggctatgtttccctgtccagaattaacttcaccccattccactgcagagtctcatccagtctagactattcctttagtccaaatgttcaggggagatggagcctagctatataacactgggaatcctgcctgccctgctcatcatggatcgttcttttccttacatctcttgctaataatgtggtcctctgatatatctacttggctccttgttagcatcaaataagagaaatgataggaatccaccattttgaacttgaatccagcctaaattttcttgaagcatactgtgtgtccacttgatcacattgtctagaagggaacgttactgtttggggagaaaaaaaaaaaaagaggtaagggcaggagagtgaacagcacatctggcctgtcttgtgtgatcctgtccacagccctgacctcacagttgaggtgtcagctctccattttgtctcattgtaacattgtgagccactccagtttaggttattggaaatctttacgtgggttgaccagttagagtgtccagtattctagcagctcttgcaaaggacaggaaaaggcagctaacattattcttatttcttaatgtgactcagtggacttgatgagaaagaactagcccagtgattcatccttctgaggccattgtcttgcagccaaatcagccaattcctagaaatgcatcaagtgggactatttctccccaacagcccagcctgaagtgatacaacccaccctagagatgttgttgattgggatgccaacaggtttccctgggtgtgatgaggtgatgggaataataagaaacacacccagtcctagtcatgacttgaaatctccacaatgtctcagcactctcaaaaagggagataactcatcctcggacttccccatctgcagccttgtgcagttatcttggagcctagctccatgccttatagtaggagccagatatatttggtgttgatttgcatagaaagatactcctgtggccccttccctttataggcccctcagcctgcatcctagatgcttgctccttttttgggtgggtctggggagggaacagggtctcactctgtcacccaggctggggtgtaatggcgccatcacggcttactgcagcctcgacttcccgggcccaagtgatcctcccacctcagcctcccaagtagctaggactacaggcatgcactaccacacctggcgactttcgtattattatttttgtagagactggggtctccctttgtttgccagctggtcttgaactcttgggctcaaaggatcttcctgcctcggcctcccaaagtgttgggattacaggcaggagccaccacacccagccagatgcttgctcttttaaggtccttcagaagacatggggccaatgacttaacttcccacttaacaaatgtcagactgccaaaggatatctgtgaagcaagcagtgatcagctgtagccaaatatctatagccagtatgaggtgggagactgaggaaattgcctgaaattagaggcataaaaggctatcccttcacaagttacccaggagggcttggtcctttccctctcaatcttgacttatcactttccttcctacaccaaacagtgccgaacaccattaagctccatacttatatatgttggtggatcagacagactcatagcatttgacattctgaatggatttgcttcaggatccggaagaaactgtccctttgggaagagcagtaatttttgcatctagcctccatggaaagcaaatctcccaaggaaattttcatgcctggaagcacatccacttgaggcatacaaattttctatagaactgaaaatattaacattacattctactagagatagaactctgctttcatgcattcatttattctcatatatatatatgagaatatatatatatgtggctgggcgcagtggctcgcgcctgtaatccaagcactttgggaggccgaggcaggcggatcacgaggtcaggagatcgagaccatcctggctaacacagtgaaaccccgtctctactaaaaatccaaaaaaaagttagccgggcgtggtggcgggcacctgtagtcccagctactctggaggctgaggcaggagaatggcgtgaacttgggaggcggagcttgcagtgagccgagatagcgccactgcactccagtctgggcgacagagcgagactccatctcaaaaaaaaaatatatatatatatagatatatatagatatacagatatatagatatatatagatatatagatatatatagatatatagatatatatagatatatagatatatatagatatatagatatatatagatatatagatatatatagatatatagatatatatagatatatagatatatagatatatatagatatatagatatatatagatatatagatatatatagatatatagatatatagatatatatagatatatagatgtatagatatatatagatatatagatatatatagatatatagatatatagatatatatagatatatagatatatatagatatatatatagatatatagatatatagatatatagatatatagatatatagatatatagatgatatatagatatatatagatatatagatatatagatatatagatatatagatatatatagatatatagatatatagatatatagatatatatagatatatagatatatagagatatagagatatatagatagatatatagagatatagatatatagatatatagagatatagatatatagatatatagatatatatagatatatagatatatatagatatatagatatatagatatatatagatatatagatatatataggctgggtgcggtggctcatgcctgtaatctcagcactttaggaggctgaggcaagtggatctcttgagtcttagagtttcagaccagcctgggcaacatagggagaccccatctctacaaaaattaaaaaaaaaaaaaaaagcacggcatggtggtgcatgttagtcccagctactcgggtggctgatgtagaaggattgcctgagcccgggaagtcaaggctacagtgagccacaatcacaccactgcaacctgggtgacagagcaagatccggtcttaaaatatatatatatatatatatatatatatatatatatatatacatatatatatttatggactgcctactatgtctgaggccatttataagcatccagaagctgctgctgaagaatctggagaagctcctgagagtagaatatggcccaagctgttttttggtcacagatactactcggtaaacatagccccatggctatgacaagaacaaaggatgcttgatatgttaagtagttcagggcttgggttctgaatatagggttccattttagctccttagcttttaattgctaattctgcattctctttcagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaaggtgcgttggttggaggccctgcttttggttgactgagattctcacctagtctttctaaactttctttaggcatcagaaacataacctttcatataattgtaatgataatatttctaataataatgaatttcattctctcttctcttgaaagactgaaaaggcagttgcttggaagaaatttactacccagaaatatgcttgtgtctaccacacctctcatgtatccctgagtgttgaacttacctatgcttttctaaatagtagagaatttaggctatcatgatgataaggaagaatagtagcagctttcatttatatcactattaaacccatcaaagtacaatcacatccattgcccttttaagacaggacgagaggcaggtgagttatagtggaaggagaccaggttctgatccaagcctaagatgttgagtgatcttggaaatgtgccatatccattctgagcctcatcagccttatctgtacaattgaaagtttagaaaaattatctctaagctcccttctaacactataatcctataattatattattatttattttttaaagataagaaaattgaagtacaaaaatcaaaggacttgcccagattcattcaactaatcaatcataaaaccaaggcctataacccaagtcacttccagcccatcgttttttctatgccagtagaaaatattgactgataaaaaagacaagttaattatttaaatggtagtttttaaaacatgagctaaataaaaatatagtccctaatattggggttgacagaatataggatgggtaatcaagcattctatctctgtcttgccacaggtttcctgtgtgatctataacaagtcacttcacccctctgagcttcagtttccttctttgcagaatgagagggttagagtagattttttggggggcccttacagctccaacattcgaagagtcgatgatttagtcaatcccaggcacatgaatttatcatttcttatgcttctgcaaagcatttttataaacacagatgaaaattcaaacattttaaaaagtaggtagagagctaaattatatacttcttcaacttagtccctcatgactagtaggcaaacatgccctgaatcaatgtgtatttattgagcattttcctgcaggccagtggtactcaaacttgtctgaacattagaaccccttggcgagcttctacatatacctgtgtcccatccccagagactataatttaattgatttgaggtgtggcctgggctgtggcatttttaaaagatccccaggtgaacattgtgtgcagaaaagtttgagaactactgctgtaggcccagggtcatttatggtcttgctactcaaagtgtggtttatggactggcaacagctaggagctggttaaaaatgttgactctcaggcccccactcaagacctactgcatcataatctgcattttaacaagaacctcaggtgattctaatgcacattacagcttgagaagcactgatttatgacacaaaatcttcctcaatgtaacaacccccatcttccagagtacacagggggcagcgtgtggacaggaaggacaggagctatttgataaggtgtagagaactggggcattgaaatttatgagaaaatgtatttattacgaatacagagagaacacattctttttatttttttttttattttttgtttttttgagacagagtctagctctgtcgcccaggctggagtgcagtggcatgatctcggctcactgcaaccttgcaacctccacctcccggttcaagttattctcccgcctcagcctcccgagtagctgggactataggcacgcaccaccacacccagctattcaaactcctgagctcaagtgacccactcgcctcagcctcccaaagtgctgggattacaagcgtgagccactgtatccggccaatggagagagcacattctaaggatgatatggacatccgggccacccagcaacaatgacctattatgacttccaagtctgtggtctcactggatcctcaaaccttttagtatcacatagtggtagtttcatgaacacaattttctcttctgtcaggggtctaacacttaatagtttaaaaagtaatgcaacaagataatttcagacaaaaactaatatttacacaaattacccatgataacataaaccctctcattgtataatattccaatttgaatctcaggccttcagaccaagtcttatttcattgtgtgcttaaaattttattgatgcagatgattcaattaaaaaattaaataatcaaaaagctgtgagaacaagacaaacaacagtcattgcttttaaaacaattgtcctctcaggttggtaatgtttattaaaacatttggtggccgggtgcagtgactcacacctgtaataccagcattttgggtggccaaggcaggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctcaaaaaaaaaaaaaaaaaaaaaattggctaaaaaattccacttctaggaatcctaagaaagtaaccacagacatgcacaaagatatacaaataagaatttttgctgcaatgctgtttacaatactgaaaaattggaaataatctgaaagttcacgaatatgggaatgattaaacaaattatggtgtatctgtaccgtggaatattaatatagccattaaaactcattatagaccaagattgaatggcagagaaagatgtttgcaatgtatttgttaagtaaaaatagcaagctaaagaacaatatgtatattatgatccaactttttgtgttaaaaaagaaagcgttgaccaggtgcggtggcccatgcttgtaatcccagcactttgggagtccgaggcggacagattgcttgagcccaggagttcaagaccagcctggacaacatggcaaaaccatgtctctaccaaaaatacaaaaattagccaggtgtggtggcatgtgcccatagtcccaactactcctacttgggaggctgaggtgggaggatgggttgagcccgggaggtggaggttgcagtgagccaagatcgcgccattgcactctggcctgggcaacagccagaccctgtctcaaaaaaagaaagaaagaaagtgtttatatatgctaagacaaaaaaaagaaacaaaaagactggaggagcatacggcaaaatgttaacagtgaccattttcttgtgactgaattatgggtaactcttattttcttatttatttatttgtattttccaaattttctatagtaaatatgtgttacttttgtatttagaaaacataataaaatttatcatgtaaaaaactgccctccagtatcccagttggcagtatattgaagtctgaatgattaaaccgatttttctggaagagctgcttttcccactttcccactctgctcaagtttgtggagatagacgattgattgagcaacatggaagaagagaatttctgtctcattctgtgtatctgcctctcagtgagccagacatgggtgtctgcatgttgaatcactccttagtcacattgcctgagagtcaatagccacatagccaagggcacctgctccaggtactctgcaactgcagagcatcaggaggcatgcacttgctcatgcattcaatctggaaatttgttttaagtacctactgtgtgcaagacacggttacatgcactgaggacagagatgtgaacaagacaaaggctacttgccagcatgctctttacattctagcagaaaagaaagacagtgaacccaaatcaataaggtaattttagattgtgatgagtgctgtgaagaaaaaccaaacaggatcaagagagagtgaatggggcaggaagcacttttaaaggagtagtcagggaaggcttctctaaagatatttgaatagagtcctgaatgacgtgaaggggtgagaaatgggatgatcatgacattactggcctcttaaaaaatgacacatgacacagaagaaaaggaacaaggcagtgaggagagaagtagatggaaggaagaaagaatggtaaattcagttatgttgaaaagggaaaagagataaataaaattcactgataatccagccaaaagtttcattgtaacaagtgattgcagcctcctacaataacaaactaggaccaatattaaagatgtgagtttcatctctctcttccctttgctctggtagaggctgaccttgctttgcatatcaatggccacctacagggttgggtaagatgtccacttcctgaagattccccaactcacttctcacactgtcgtgccaaactcctattaacctcagtagggaaggcaccagatttaagaggccgaagaaaagatccagagccagcaaacaagacatggggttttattaggggctgacatacaggggagagagtccagtggaggtgggctggacaggagaaccaccttacatatagaaacagtccagtggcagcaggttgggcaggaaaactgcaaccacttgcaaacatcatgcagtttatatagcattttcactgaacactctccccttaacgacctggcaaccttcatctaacccaaaactcaaggcctctatcccctgtgcagccccagggatgagcctggggttcagatggtcctcacagacaaggaaataatctcccagttggccacgcctggattcccaagctcagaacacacattcagatacgtctgccatacagggtcattctaagggtacacttaagttattgctatcatgagcatttactgtacatacaaccacaataccatcccaataccttgaatttccataattacatactccttttaggttatggcattaaaagtccctattaagacttaaaagttgtcccagctggaataatacttctccttcattaccacttctgcaaggaattctggaaggctcaggatgggaacattctcttgggctgtggaaatggccagaaatgacatcaagcacattgtcttccccaaaagaaaatgagagtaggtgaactatagtgatcagaaagcaccttgaagtgcagagtgtgaaaaacggcggatgttgctaagtaggtagttctaaagacaaactttgcttttcttagcattttcaagtaccagccagagttaagtcaataatgagttttgttgtttgtagatcccttcggtcaagtaaattaagctcttgtagggaaggaggtagtggtgcaagatgactcttcaggctactggaagaacttttagcatattacaggtactgccagtgccatcatggatttcatgtcagctatagctgtagccaatattaagctggtgagcaaagtttgagaaatgaatttggctgtcattctaaaggtgataattgaatacacagaagtctctgtacactcagtgacctcttccctctctccaacccatttaaaaagtgctagcacgtggcccttaattacctatcaccaaaaagactggcccaccaagtaaataaatagctaaaaagaaggacaaaaggaggaaaacaaaaagcttgattccacaataatccacaaattgagtaattcagtctggaatcaagagaagactatggttttgtccttacaatgccaaatggtggtgggggtgggaaagctaatcaggttaccaagagacatacaatagcaatttgattacaacttctagtccaaatgtgtctgattggctaacagtgagtctccctaattagagtcacagatccaaagcactcaacactcagtggtttcatcctcaacaattcagatattcttacagatggcttctgttgttctgatttgagtgtatgctttaagtacgcagttcaagagagtactgattacaaggccagcaagcaaacttaactcactgataaccaacaagaagaaactttttaaaacaggggactgaggaaagaggagggagggtggagtgaaatgtagagcttgtgcctttatgcctgcgagctgaaattcaacagtttagtttacacattaaatgatccatcgctgagggacttgaccaattttttgtgtctcccaaccattcatttggcatagcatacatatggctaatctgacatctagattttggcactggtgctgatccggtattattgttccccttacaaacaaatcaaagagcattcagaaatgtcaagccaatttggatggatcctttgggcaagtatatgcacataaatgagtgtcatgaatgttttctaagtataccaaaatgatgtcaggggatgttaaccaaggccctttttcagcccattccctgggcctctcctggcaacactgagctggacagagcatgatcctgaccctgtatggaaattcctatgttctcttaagtgcctaggagatttgtacctggctacatttttcctcatgaaagtccacttctcagtgacagtagtaggggtctagtgttccgaagaactatggattctgtcaacacatggacttcaatcaaagttacgtgctcctttgtgatttgtggcttaatctgtggcttgttgcagtggcagcctaagctgggctaatgaagtatgggtggaatttctgtctctcgaagaatgttcttgttaattgtccacttttgataagtgtgagatgttatgaacaatgagatacataaatgcagaagttcacttctagctttagaaaaccatgacaaaattctacttgcttcctgattccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggtgagcaagacaacattaatttctcatctttgtaagggggcacagaaaaggatgagaggactcactttaattttgcttcaacctgttccctcatttggattaaaagttctttttgattgcttagaaactgacatatctaacactattgtcattatggcctttcaaatttaacgatggcctgtgctaaagatcaagtactgacccttgggtttccaaagctgcctatttcacaccaccaaaagctggagaagcggttctcaaccctggctgcccatcagaatcatcagggagagttttggtttcctttaaataccaaatatctgggccctacccccagagattctgattagttggtctggagtggggcatgggcatcagtgtttgttcataatgcttctcaggtgattgtaatatgtagccaggattacaaactgtcaaactgtagtctgtcattctttccagaataaagctcaacaaccatgaaaacccattcattcagggcaaagctaagtccctaatatcacgatgtgtcttctggggtaaaacaaatttaaaacatcatccctgccctcaagaaggttatagtcttactggagaaaccccagtcacaatgttcaattccttttctgattactcacagtgactaccacagcaagccacattctgttcattgtgatcctacagctcttctaactttttgtaggctcaagactagtgcttatttagtgtggtcaaggttcctcacaatccaagtggataagtgagatttcagctggaaaatatacacatctttttgctattggctctcacataaggctcaagagtactcgaacttctgtatgcatcaccattacacagggagctggttttaaatgcagatacctggccccatcccagagataggaattcagtagaccttgggtagagtccaaacatttgagtgtttaacaaatagccagatgattctaatgcaggtggcacttggaccatgctttgaaaaagactgctcagtatttatgaggctttttttctctccctttagacaacagcctttatctaaagaatgcatttctccctaaaaaaaagatgcttgaacatgtatatattcactcatgcttatttttggtctatgccttggagtgttgatttgccatctttaactccctagctcatccataacaggacacctaggactaggcactggtttgttgcgtttccccagcagtgggcccactattcgtcatcccacatctttcgcctctcagaggtgtgcagatgaatttcaacttgctaatgtagcgtctaaatatcctcttgttcacagttctgggttatcaaggtctatgcttggtggacacagaaaaagaggcttaatctacttcgcccatttaagtgggctggtaatatgttgctccttcagtataaggcagttgtcagttgtctacctgttattgtgataaaagctattcaggcaaggttgagactgtggagagcactctattttaactctccccatttatgaataaggaaggctaaaggatctgtgaatatttcccaaaggaaaatatgcttttcagtgagttcaagaacaagggtggcttctccatttacaaaaccaacctgcctgcaatcccactgcaggctctcagtgcttagccaggagggcagcccagcggtttggcatggacacagtctatccaggttgggggcaagtgcagaatttctaatactgcctatggctgcagaagctccagtaagcacttatgctagattccatgtggctttccctaggagagagtcccatggtcagcagcactatctcccttatctccatccactggagaagccgaggggaagccagtaagccaaggaaacaaatggagtcaattataacccttgagccatccaagttcctggttaagcacattacacagcccaactcgatactcttaagccctagtaatgaaatgatatgctgagcctgagcagaaaaaaaggagttgatggttccagattgagtgcctgaccatttgctccactttttgcttggccctaggcattctccagcacttccatattgagaagatctccaagaggatgtttgaggagcttcctcacttcaagctggtgaccagaacaaccctgagtaagtagtacttctcttgactgctccctgaaaaacacattcagttttcaatttagcatagccacagctaaagtccctccgcaatctcagtgaacattagcactgctcagtatcaacactaaaggatgttccatctctcttctgggtgacttagcagtgaatggggtgtctgaatgtaatctgaagagcttggacatggtgaatacaaacccagatgtagtctgagcataggatacctcaggtcaaggcttcctgaatgtctttaatgaaactgctaagcacagagtctcaagagggttggagaaagctcataagattccaggtctggtatatttatggagacttcacatctggaagggtgtatcctctggtggtgggtatgagaggcaaagagaaattaaaggcatatcaattcctgtgttatatgaaagcacttttactcctggggaactgcccctgggtggtcatgtttccttaaaagcattcaggcactcaaaaacacttgcagctctcccactttccacactagatggagcctagggactaagatacttctaggcattggggcgggtgttgagcacttctaatgggataaaaggcacacagtttctatccacagggaattataatggatgagacagaacatgaaaatgacttcagtatgaattagtatagttctgaggagttaaatatcaaagtgctcaggggaatctgcaaagaacaatgagatgagagccaggtgggcttagtcggggaaggcttcggggaggaggtgtgttttgaaagagaagggtatgactgggcaatgggtcaggaaatcagtccaggaaaagagtgcagcctaagagaagactcagacaggagcaaacaggaaatgtgggtaggggagaggaatgatcacaaaggccacagaaggtgcactaaaagattagaagatttggaggtagaaagtagtcatagggcctgaaaaaaagccagtaaaatgttcaaatgtaaggcaagtagcatctgtagttgctgcaaatagcatagagatatcaacatggtgctttggaaagatgtctttcggctatcagatgcatatattacattaagcacacactttgacgaagccagattatgaagtgcccaatttatcatgctaggacattggacttgatctccaggccagagaatgccagtggaggtttttaagcaagtgaatggtgcattcagatctgctttatttatttttttatttttttagaaagaggtcctcgctgtgtggagtgaaaggtggacccttattaagagaagtgggatagtctgaattaggaactaattatactatattaaatcaatgagacgggaggagacgtcactgtgagaaacatttctgaggttaaatcaacaagatcagcatcaaagagagaaacgagtttggaatgggtccgatattaataactcgactgggtgaatagtaataccattcaccaacagggaaactgtgaagaataagcaggtattggtgaaaaagagtttcacttggaacatgtttaaattaatatgcttaagagccatctgagcagagttagggtccaataggcagctagaaaaagagccaaggcagtcagttgcttgtctttggcaggactcatagaaaataacaggacagtatgagaattcaaatggaaaagttgggagtccttacatgtgagtaagaaaggaggcagagtgtaagatcctaggatcaattatgggacttctgaagttacatgttttagttcatactgtgaacaaggctttgttctaggttccaggggacttaaaagatgatttagatatactctgtgcccatggcaggatttggggtatataatggagtagaaggtatgtgcctcaaactgtgtgtagctgaaagaagttggtatgatcctacagggtcacctaggagcaaagaagaacaaacccaactcttttatataatgtgcctagcagagcccagcacattatagggcttcagtaatagctggttccttgcccaaatcctcttcttgtttttttgtttttccttctatcttcccattgagtcatagagaatggggaaaagggagaaatccaagggagaaaggagcagagaaatcaggcccatagggaaggtgggtcattattctcttgtggctaaggaaaagaaaaagaggttcaagacaggtttgggcttaagaggagttggcttaacttggactaggagttctccaggttgcagtaccatgagcacaggaataaaaagaagacaaaacacagtatccagggtgggcagagacaacaggggatggaagggctacagccaagtttactctgcgtggaaagggattccatggggtatatgagaatggatgaggaaccatgggaagggatttagggtgctaagggggtataaggacagcatgtggacgtaggagaaagcaacgtcgagaagtttttaacaaaagatagcaggaatagaggaaagagtgatatataatcaaatagtaatcaagtaacccaaaccaatatttggggaccctaagggtaagcaaagccccagtaatacagtaggtgccgttttccaaagtgcctttttgacctggtgccaagtaagctgcctaaatagctaacaagcagatattgaagcattttgtaaatgctaaatatactgtaaaaattccaagaataacacttaggttttgctcttgaggaggggcagttctatattattcttgggattcttacaaatgctatgtgttgaaatgaaaacttcatttcccattttccatatctgctactagaaaagtgttttggggccattttttgaaaccaagtgatatttgtattccaaattccctggtaggtccatgagtaagtgggtaagcatggggtatattggttctattcctaatttgctctgctttcctcttacacactcccggccactttgcgtttgtttgccttttaggccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagccc

SEQ ID NO: 3637 - DNA, 276633 bp, human
atcacagtcaaaatacacccagatgctctcacacacccagacgcgcgcgcatccccgggccatggggcgcacgtgagcccgcaccccgcgcacccagccctgcctctcgccagagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacaggtctgtgcagggggggcgctttgttgcgggctgctggagctcttgtggctccaacagccactgggagggcacggggcgggagggatggtagattatttcccagttttcagtcttgctgtatgaatagatgcagggcgaaaggctgggaaggcagctggttccctttgccagttcgccttcctttttggttcatggcgagagagcactgaagctgcccggactcctgcccccgcccacccctaaagctctctttctttgcgtccccactccctgcatccacttccccaggctgagctttctcttgttcagggagctcagggatgggggcggggagagatggatggagatgatccagccgggcacctgggtgcctggggctttgttacatacaacaaaaccagtcctcctcagcttccagctccaggctaggctgcggtccgccggcaatgtggggtgtgggtcgggccgactagggaagtgagagaatgtgagaggacactccctgtatgtgactacacacaggaatgcagtggtgtgtgtcgtggagatggtgtgggttttgtgtggaattcagtgagtgcgagttggagtggtgtgtgtgtgtgtgtgtgtgcgtgtgtgtgtgtctgcgccatggggctgggctactcttggcattacatgtccttgggtctcattccatgccaagccagactgcagcaacacgcaggtggatcaggtccaacctgttctgcccacattggaaggataatgattgttttcaaagtgatggaaatccccccagctgggactgttgcttaggactttctggatgcggaatttcgagccaggttgaccaagccctaccagatagcgttattgttctcccaaagatgcccaactttcttagcagggtttcctctctcagccaatgaggatccaaagctcttacagtgatccctgcagtgccttcccacacccattttaattagcgcatcctaatgtcttcaggtcttacttactacagtgaagttagtggtgtgctaggatgtagttctatgtttgaactaaaaagaacaaactaaatgcacctatgtgttagtcatgaatttgatatagaggttttttttttctttcttgaatgataaggtatgaactggtatggccactttttaatcaaagaaagaagaggtcaataaaaatgaacaaaactgctaaaccttctctttgacatttttatttgtggttttaataaagcattgtttttcagggtccaaaaatatacagttaaaggtagtgattaatcaaacagcagacattttttgcatacctgctatgtgttattaatgttaagtattgaaagtatataaatgaataaaacatcatctcagctcacagggagtgcacaatctggtaggcaagatagagcgtgtaaacagacaattagagtaaagtatgacaaggggcaggcagggtattgtgggagcccaagggaggtatgcttgattggggatgggggttatgatcaagaaaggcttcatgggcgaggtgacatttgagttgagtcttgaagaattaattcaccaggttactaagtggaaaatggtatcctaagttgaaagaatggcatgtatgaaggtagagaggtcatagttaagtgagactgcagggagtccttggaagtgtgactgccaaattctcaacaaactcagaatgggtctttctggtttggagtgatgactggtggccaaaaaaaaaagccagtattgcagattgataaagaccacaacacatctctatattaagaaacatctggctcatttattaatattagtgtgttttgctttaagcaaatctgatatatgtaaatgtgagattccaaggcaaatgaactaaatggacaatatttacattgcagaatttgctgctttacaaaaggattcataatcagattatgttaattaacactgcctctctgacctttacagtgaatttcttttaaccaaaaatccactaacggaatttttccaatagtccatgaatggataaagacaggcatacctgcattacatttactttttgcacaaaaatttaccaacttcaacgcaggaatttcctctcattctgtggatgtttaataaatactaaaagaaaatatgaaaatgctagtaatgaatattaaatccattggctgtgatcttttatcattcaaactgtatataaaatagaaactaacctgaacgggatcttgaggaatttttacattttaggtacttttagtagtttcactggtaattaacaatggtacaagatttctgtgctgtatgttagttttaaaatggatatataataactgctctaatgctcgtgcaattaagccagaacaggggcacattctgagtctcctgttttgttgtgttggtgctgattgcattcataggctgataaatggccctgggagtgagactaagagactgattatttctactggaaatgcctggtggtcacaaaattatgctaggtaagagtgtgggttctgagaacatggatcagcacccatctggagcacctctccccttaaatgaagaccaaaaatagccctgggttctatttgaaaggaatgacagaagtagatgagcttgaatgacttctttcctcgtctggacaataccttgctgtggaggagttgatggcctagggtactttgggcacataaaggtcctttgttcactggctgtcaataccagaaggtatcaggcagtatctctaagatacattctccaaagcttgggctggaatggaatcgatctgtcagctgtgttgatgttcagatctgtctagttactagacagtgttttttgatgtaggttctaaagaagactagttccatagaatgttagtagggcacacctctccccatccacacacacacacaaacacacagggttttgtggtcaagttaagttttggaaattcttacttaaacataaacaggtttctttcctgcagggcttctaaaagtctttactaggctaatgaatattgtgactctccaggagtataaaatatgcagcatttctcagatggaattacccatagagcatggtgttccaacaagcatttgggtctactggtgttgagagacacgttctttgggtaaaagcattctctgctgagttctgagttcagaggctgtcggcatcttgctgggtaagcttggatgactcgctttacccctccaggctttccttccttcccccctctttaaaatgaggttgataataatcatcactctcactgactgtgatggtgtgatgacaactaagataatatctctgtaagtattttgagctgcttagaagaaaggctgtatgtaaactcaaggttattattaaagtgaagtgaagaattaaggcaattatcctgataatgcaggcccaaattctgtctttctgctgaattattgggcagactgcctcatttctctgctctgctttgactgcagagacctatcctcattcaaccttggctgactcagttctctgggtttatttcctttcatattctgaaaatttcagcatggcctttaatatcctggtccagaggtatcatcagtacagccttcagaaaaagtccatcaatctgaacatacactgctgactagagaaccctggagttaggaattaagtttagttggaaagttgcttttatccttcagactaattgtctttcagaagcatttgtaaagggccatgttggaagctagctggtgcaggatttctctccagtagccccaacacccaacctgggctggagtcctgtttacaggagacgcttcttgaacaacagtttcaggggtccattttgtcaatgggaagctgaggccatctttaaggaaatttaaagataaaggaaatagcattcatgtgactattgacccttcttggatcccttgactgctattaattcccagaacctttttttctttacaaactgccttgaaaggagaatggagttcttgagacttaatggctgataatcattgcaaactgggtttggggtagagactgttgcacaaggcattcagtctctaccccaaaatgaacgtcaagacattcgggttgctggttctagagtactctatactcagattagctcttctctgcatgaaagcagcaagcttcagttgtaataggaaggatttctgttagccacaagagataactgtgtgactttaagactgtgtgatgctgtaaagccagagtgaagttattcgctgttctggagtacatagtggagatgcttgttcagtgggggacattcatagaatggtagagctacaaatgcctatggaagtttctctgttgtaaaccttatgtttggatgatgaaaatgaggatggaagaagtgaagtgagttgtccaaggtcacacagctaccacatgacagaacagaagtcattctaagagttgaaactcagatctgctgcctcccagtgttcttctctttgacttaactgccttcttgtgtagttcaggggagtgaggattggctcatttggtgggacttggaggtcatgtccagttctgagcagtgtgggctctcacattgcagttttagcagagggataggtttctagtggagacctaaaagaccatgcttctctctctccctcctcattcctcttgagtgtatagttgtctgattcaccaagccaagcacccagttggtaacctgaggactagatattctacctgagattcatggtggatgatttgatcatcctagtccttttactttggtgattgattaataaccattttctgtgtgccaaggatccccttgaaagtcatgaaagctactgatgcactccccagagaaggcctctcatccatggacatgtgcatgtaatttcaaagcattgtaggtcgagagctcttgctctgcttgctgttggtattggtacacagcctagggtgactggtagaagctccctaaatatgaaagattcccagaggtggaattgtcaatcttaactcggagggaaatggaaatgctgggatgagctttgtgccaaatagacaggggacagggagtagagtggaatttcttatggataaaagaatggaattggatcctgaattcgagataaaaatagaaaaggaattgaagtgagctaaccatgtccccttccttcaaccttatgaaagaaagtgaagtggggaagctaggcaggtgggaaatttgggaggactggggagggggtcagtccagaaaggatggcaatcatgccatatttaaatgaaataaaaattcttcccaaagaatgagacaactctttcacttctctccagatttcttaccctagtcaaacacctaaataccaaaagctcagggctttgggtattagaagttgtcttagattctggaacactgtctccttgaaaaggacacatttaaaggctgggagtgggggctggacattgtgggggagtggcacagcatggctctcttcttgtttacaaaagcatttttattatcaaagaacacatgctcattcttgcttataaaaatagagatatgatgtagaatgttccttccttgtctctccaacactgatcccccaccatgttcacaggttggtatgtatcacattgtgcatgtttttatgaatattcacataaatacattcatgtacataaaataatcaaagatgtgaccatgtgctgttctacagaatgctttttactgaactatatgtctgaagatcttttattgccagtagacatctagttatttcattcttgtttttaaattttactttaagttctgggatacatgtgcagaatgtgcaggtttgttacataggtatacatgtgccatggcggtttgctgcacctatcaacccatcatctaggttttaagccccgcatgcattagggatttgtcctaatgctctccctctccttgtcccccaacccgtgataggctccagtgtgtgatgttccgctccctgtgtattttattcttataaataactgcatagtattctattatataattgtaatataatctctttaatccaacctttgttgatgaatttttgcattatttctgattatttttacattattaaatattggtgcaatgtaccttcttgtacatacaactctgcataccactgtgagcaattttgtcatataaatttaaagtagtaaagttgctggtttggagtttgatttgcacatctttgattttaatagagcctgccaaactgcctctcagaaaggctatcacaatttaccttcccatcaacagtggccatttctccacactcttcctcatcaatttcagatattattgatctttttaatcttagacaatgtgaaggctgaaaaaaaatctcctttctctttgcatttcattgagtactagtgaggttgaacatcttttcatgtgtttttttggccatctgtatttcttctgtgttgccatttcatatcccttgcctgtttttcttttgagttgttctttctgcttctgataactgggttctccttcttttgagttgttctttctgcttctgataatgaggatctctaaatattttggatagtaaccatttaactcttctctatgttgcaaatatattaagcagtttatcgtttgtcttttaactttgatttggatgtctttcactgtacagaaatgtttatgatttttgtaaaaatcacaattttcaatctattcctttataagccaacaatgccacaattagatatccttgcactatgtcatatacagttggctcattatttccttaagataaattcctaggattagatttgttcagttaatatttttctcgatattgccaaattgctttctaaaatatttctagcaagttacactccaactacagtgtatacaagtacattttccccctcctcctgacgtcttctgataattcaggttttggctcttaaatcaaatgctaggctgaaattcatatttgactgggaggaaaggcaagactgagaaaggctgggagcagaaatccctaactgcacgtggaacacctgtaatacatgtttcaccttcaattatttaagtaaacatgctctttaattcatttccaactagaactgtgtcgaaagcgttttccaacgttaaatcactctaaattcactgtgaaatgaatgaccatttagggtcatctctgctggcagcatctgcaacagcaggcaatgatgaactaactttagagctctatctcatcttaagacacttggaaaaaatctactgctgcatcttcactgatctctgaggtcagctagattggttccataactttctgaaggctgagtggtgagtaggaatcagtttctatttaacttggcttcctgcaaagaggacaagtttgaggtcctcccatgagaagttattctaacagaaataaacagtgatgtcacactctgcaaagggtatagtgccaaacaagtacaggtgtagctttttcccttactctgcctgggcttgcttcatcttcttgtgcctgttttctgccagtatccagatatggtcaagggtattttggtgtgtgctttaggccaaaggtagggtctgtggattagaagatggaagtctgagtggtagtttatgtagcttacgaatatcttttgtctgaagagcacagtagcaacctaaaatcctttggaggtggcagggcaatggggaaacatgaaaaagtggtgatgatagttgttgcttacccattttacagatggagaacacatctggaaaggagaaatgctccaagagttggacactgctggaaaaggatcctggcatacctcctaatacttgctaactaaagatttggcaacttctctcctctagggatatatgtatgtgcctttaaagtgaagcttcctgatttgatatgtttaataatgccctttgtacttacccatcattcactttatctagtgtggtactgacacagcccaccccagggacgattttgagctgtcagaagatgggtggattattgtccccaaaggaataatttggattacttgaactattgacaattatgagttgtggttttccacttacctcaaaatcttggtatttggcaaatgactttagattgtatctaatatttgtctttttttctcctttttaaagatttggactagagtaagcatagttcacagaggaaatgatggccagataatataattattaaattttgctgccttgaaaaaagtggttttagtttttatgctaatgaatgtcctgttttaaaactagtgtttctctttttaattgccaaataatttaaaattgaaacatcatagccacagatatggattctatgcataaatcatatgatacatttatactttttgatggttacaagtggaaaggtcatctttctttttaaaactatgcttggtgctttaagtagaattggaaattgtcatgtttttcttttctaatgaactattctgcaaaggtaacattgtttttttaactctgattagaactggaaggggatgtctgactccatacttaatccaaaaataaaaacctcattaacaaagaggcaaagagagtcagtaaatggagcttacattaaattgggaggcagaagtccagggttcgagttctggttttgttattaattagttgtgtgaccctgaactagagcttaaatgcctctgagcctcagattcctgacatataaaatgagggcatcgttaggaattgatgatccatattgtaattccttcaacttaaacaaggcattctcctctccaaagtcaatgtttgctttgtgacagaatcacttggggacattttaaaaatatattttgaaggccccacctcaaccagttgaatctgaactccaagggtagacccaggaaacctatttgttaactagcttcttaggtgatttgggagaagactggaacaccctccagaggtaactttcaggaggcaagatctcctggtgttttctggcttgagggaatgaaagcattttcaaaagtggggaagtccaggtcacctaggagctctggcttagaaatctatgatatgaaactgcacttgaggaggctggcttttggcctagctccctgggactggtttctgcagaggtgaatggagagcacagtgttcttcttaagaagagcgagtttggacgaacaaactgaccagtcatttaataatgagtatatttcaagccctttggcacactaccttgagaagaagcattactgagagagggcacagtgatttccataactcctagactgttttggcccaagctttcctttgaatcctatttcaaatttctattccctctttgactttttcaacttttgttcttcttcccttcattaaattcacagtgttgcagtgggtttttcccacttccccttgatctcactgatcttatttccttcagccataggcactctctcaataccatcctatcttctaaatgccaaaaagaaaggagtcagcactagtgtacaccaatttgccccactatttccttctgcgccaactttcagcccttcacttcattatgggagtagttggagctagggaaatgcttctctaaggcaaactttcagagacagcaagtgtttctttttatatatagctcccatttattaactgtttgttgtgtgtcaggtattgcactgctctttgcatgtgttgtctcatttaattttctctgcaactctgttaggttaatactgttagcattccattttacagaggagggaactaaggctcagagcagctaagtgatttgcacaagttcactcagatggtgagcagcaaagtgaatctctgtctggtcttggggtctgaatggttaaacagagtgttctactattaagggcttcctgtggtaataagactgtgttacaccaaaggggaatgtatgaagcaacagatcttcttgggtgtgaccagtctgagccttgaagcaacaataaagaccaggaaagaaaggggaggttcattttaatggcagcaaaatgttgccagaattattgtgtgtcattgtaggggtggggctcagagattagtcttgattcttgtgaattgttaactgagtaaatctctaaatattatcattgagagataaattcctgatatccccatgactattgtttgtgtcacaaatcatgggaatgtggaacatactttttgttttcctcctcctactcccagcaggagactagtgccaagggtatagaggacctctgggaggcagggagtgacttcctggatgttttcagctaaagggagcctgggtgggggaagacaaccagggagaggacccagaataacatgaataacagtgtcattggctgggattattgggtttccagctcactcaagttcttcctgtctgattctcattatcaaacttgcagcatgcagcaaaggatatttggcatccagcaatacagactcattgatctacgactgatacgattcaaactcatgaacataaccaaagcatgcactgcaatttccagactatacgtatgggaccaaatccatccttaaaccctaacctaatgccctttttgaagtagccgaacttttcactttgactgtagtatagggcattgagcaatttaacatcactgcacaaaaacagaccatttgttttctttcccgcagctctttcctagaaagatcttctactggctataatttctctaaaaattcccttccaattggagccctcaggggaggacttgcacccatttcctgcaatatctgtcctctttattgccgtttccggtaatgagagtcaataggcatcaagaaaccaaagatgagccaggcatgggggtgtgcacctgtagtgcacctcagctactagggaggctgaggtgggaggatcacttaagcccacgagtttgaggctgcagtgagctgtgattgtgccactaccctccagcctgggcaaaagagtgagaccctgtctcttgataaaacaggaaagaaagggagaaaccaagaaactacggtcttgtaaggcctcaattgcttactccatgtctaatgccagataagtcactttgcctctttaggcctcagttcttccatctgcaatgattctaattctcccttctctgtggaaaacttggagcaatcagatcactgaaaacagactactttgaaagaaaagtggtccaagatatatgactgtgaatgtcttcatgttttccctggcaaaagagctgttttggagcaaaaaagagggtagggtaaaggttaaaagatcacttgcttaagtttaagtccctgctctgccttctgctagctgtgtggtcttggaaagtttcttaaccacctaactgccttggctctgtaaaatggaaaaaataatattagtacttacctcacagagttgtggtgaggaatcaaagagataatctatgtctgtccaatagatagtgtttatttatggcaactatttttattttgaatgcatgaagctccatgaagaggtttggatcctggctcaggcactttggacagtcatttagcctctctaaacctctgtttcttcacttgtgtaatggggataataatagtagctacgtttttgggtttcttgaggaatatataagataattcctgcaaagttctcagtacaccacctggtacacagacgtgctcaataagctattgctattatcattcggttgccatcctcagaggacttgtggatcccttggtccctgcttttctatatctggaccacctatgggcctggctcccaccccagaaaatatttctggtgcctgtgatgtactattatcctcatttacccttgtttgggttaagtagaggagatagcctttttgcataggggaggccccaagactgaggggacttcttgctaaagcactgcacaagggctgcttgtggagaacagctgattccttgacctcgaaaatgtttcacacagtgaccaaaatgggaacaaagcagaccctgctttacgactcccactggagcctggtcccatgaagcacaaagttctgtcattgccctccccacgcctcccctgtcggctccaccagccatatattcccttctgacattcctccaagacaactggtcagagagcacttagtctcctccccacataatatgttgagtaaggcaaccagatgctgccatagtgacaattcctacctgatcaatagagctgggaattaagccctggtgacaggaccttctttgtggagggcctcctcccagggcatcgcctagctcagcctggtgatgaagcaacctgccctacccaccactgtctgtgtactaatctctgggcctttctctatacattaatccacatctctggggccccaaagtgaccatttcagagaaattttgacctcattggattccccaatgtttctgccttggttcagaccttcatgatttcttgcctgaactatatcatattattgttcctgctacttttacttctatgaataacaataaattatagctaacagttattgtgtacttattatgtcctagttgctgtgctagcatttgcatgtattatctcatttaatagtcacaaaaaccctatgaggcaggcactattatccccattttacagaggagcaattataataccagctaacatatattgagtgcttaccatgtgctaggcactgtgctagctgccttatatatttttttctcatttaatcctcatgataactgtatgaggtaggcattattactactaatagagatatctgtaggcctctggtagtaaaggactggataagaaccctgatacttatgaaatattcagaagggttgcatgacccaagaggactttggatgtacttttacaagtccttcctcactaggtgcttgggtacagtagacattgctcattttgaatcttgcagggaccctggccatggctggtgataggagaaggagtggtgagtctttcttaccctgggttgttttagggatatctgggatcaggctatggtagaggcacaaaaattttcatgccttgctcatggtgttttcctacttggtcttctctaaaaatccttctcagaccatgtcacttctttctttcattcctttagtcattcatcctttcatcccaaggacacatgttgattacctactatatactaggtaatgtgctagacattcggaatattattataagcgaaacagacataaaacctaccctcatgaagcttatggtctaatggaggagacaaacattaaacaaataaactcagacacatataattgtaaattatagtagtgctgtgaaggaaaagtatagggtaggagagacaatagcaggggagacttcattgagatggttgaggagcatgaagaaaggcccttctaggggaaatgacacctaagctgaggcctgaaacgtgaataaatattaacaaagagtgtttcatgcagagagagcaaattgtacagacaccctgaggtgggtactttccatattcaagtgactaaaagagacagtgaaccgggagaaagtgatgctcaatgaggtcggagaccatgcagaaccttgaaggccatggtaatgagttccctttttatgccaagagcagatggaagccaatgaagtagaatcagtgaagtaagggtagaatcagggtaatgtaattcatagttttacaatatcattctggccgctatataaaatggaacttaagagtggcgagaagagaaagaggggcaagctaggaggccatgacagtagtccaggaaaagagatggtggtggcctggactagaggtgacagtggccatgaagaggagggcaaatgcagcatgtgtttcaaaagagcttgctactagactggatataaggactaagaggagagaggaatctaggaagacttccatgtttctagcttgaataacgtgatgaaaggtgtccatttatggacatggggaagtatcctgaagcagattgagttgagctctcatcctgtgccatattcagtctaaaatgctcatttagcatataagctctattaccttgttttgatggtagttaacatgaatgcatttgttctctccctaggtaggttttaagccccttgaggacagtagctgtgtcttactcatctctatattccccaaggcacccaagatatgatgtattaaatgctgtatgattgattaacaaagggaagaggttcctttctctttcaaccttactcttcttgccaaggcatgggacattactctggattatgcttttttaaaaaaacaaatgtgacgcactcaatgatatatattatttgatatagactttgaacttcattcaatcattaatcaccttttgaataactcctgccatatgagcaagatacataaggcacacatacgtttgctctgcagaatacccttcagcagtgcagtacaggctatggagtcacagaagaatggtctcacgggaatgtgtgggctaggtcaggattggcagagcagaagactagaagtagcctaaaagcctgagttgtttaggcagttagttttaactctggaacaacttcactccaatgatttcctcccaaaagggtctattcagagtttcgagacatcttaattccccataatgcctctccatttctgcaatccactgccactaccccaaatgtaagttcctttcctctcctagggattttcatcctcatacatgtttctgctttctctttacactctatcctctttctcgggctttccgtctgtatcctttgagatctatgttgcatatcaacaaactcctctggtccttcaccctcgtgtacatcacagtgctggctacatgttagcatcacctggggagttttttaacgggtactgaagcctggaccccatccctagagaatctgattcatttggcctgaagagggacctgggtttccgtactttttagagctactccaggtgatactagtgtgctgtcaggttttcacaccactggtacctgcttgccttaattgacacatcagttctcttgcagcttatcaagtgtaagccgctcattctcctgggttgcacattctacagagctgaggggtgatagccacactctcctatttccccagaactatttttaggccttttaagttcatcctgaaaaagaagcgaaaaaagccaacagataacaaaattaaatgcaaactaaattcattgttttttttaaaaaataaattgattttaaaataaaagaaaataaaatgacatcaatgctccctgtaagtgtcatggcatctatactgctcactcttttcttttgtcaactcttgtcttcctcatgtacccacacttttcctaaatgtttaatacttggtttatcagtttcctctccaacctaagtcctgcttttctcctggaggactttagtgcccttgttggcaatctatccaacattctggacttatggttccttcatcactttgacaaatatttatggaatgcctatgtaccaggcactgttgtaagtaagtactaggtatggaacagtgaacatatggacaaaatccctgccctccagaagctcattatcaggaaggtgccagtgagggggataatcaaccaatcagtaggcaaataaatgttaataagcattgtggaaaaatttaagcagaggatgagggaatgctgggagagagggatcaattttaaatataagggaataaatttcaacaagaatagccttcactgagctacccttgcaaatatcttgagggagagcattataaacatagagaacagcaagtgcaaatgtcctgggacaggagtgtacctggctgtgaggaggcaagtctagcttaagctgagttagaaggtgaggtcaaggaggtaacatggagatgggtcttatcaggccttacaggaaattgtaaggacactggctcttactttgaatgagacagtgaaccactggaggggagggttctgggtagggaaaggaatagggtgtgacttttatttgaagtttccttgatatcagttatctccactcactttcatctctactgcactttgataacctgtccccattgccagctcctggattttgtccccaaactgttctacctctgaaatcttaaactctagtattttaattgagagagcttatatatccagctccctcatgctaattatactttctcttttatttcatctaaatctctcatctgttgattctacagtggtcttcgtggatgttagtccctcctggcttccctcttttccctctccctcctaaattccatagtgcatcttttccagcaattctcatgtgtcaatatattttttttcctatttaaccctatattatagtggtttagcaaaacccaaaccatagatcattctagtggatcttgttcctggctgcacatgagaatgacctgggatgcttagaaacatactgatacctgatttcactggtttaggatggggtctggatatagatatcttaatgatccccaagtgattgtaatgagcaaccagattgagaacctgtggactaacccagcatctgcctcttcattttctatatcttgacatctgagcagaaaaccaaatctcaactgctccctgtaaattgcttggaaatcttacaaagtgacgttagtaagctacatgtcacttttctgttatgttaaaccaacctgcaccaccctcctctaggcttcaacctcacttctgtctctgtctctcctagaagatgacttcttttcccatttcataaagaaaatagcagcttctagcaccccaagctcctgcccttctacctcaaacctagatgtacctgtgtccacttttatcctgttgtctcctctggcacttccaaaactttcctcattcttgtagatcttcaacatcttgccactgggtcttttcaaaatatctacaatctcttttgtctttaaaaaccttctcttcacctctagattctcacttgctagctactgccctatgtctcttcttcccttcacagctaagcttcttgaaaaaaggagtctttaaccaatcccattctctcaccttccattcacttttttagtcccctggaatttggtttctggtttcatgaaacacattttgctgtggacaccagtgatttcccaagtgacaaatctaatgaatagttctgtctttttctttacttgttgtttctgagtcattaattttatactgcctgtcttcctgaaaatctgttctttcatggattccatgagagtattttcttgatttacctcctacttctttggcagcttcttgagttcttcttccttgtcctagacctgaaatatgagtttggaaaaatatgaggaatctcttcttactagttcacatttctttctcagcaattttatgcatgcctttggcttcaagtatcacctacatgttcatgactcccagatatattacccccactatggatttctctcctgatccctagatctgtttatcagactgcctatggactgcctctgcctagaaattctgcaggaacctcaaagcagtgtgtcccaaacttaacttggccttttagaaatactctgactccaccaaaccagaaagcggagtcatccaagattcctccttcatctccctcaccttccacaattaccaatcctcccaaggctatctctaaaatctttgttatctatttgcttcttgcatcttgactgccacatctctagattctcatcatctctcctctggaccactacaatatcttcctaactggatttcttggcattataacagcctccttcaagctgtcttgcaaagttgaataatctttccaccatgcaaaccttacttgttatttctctgctcctatgcaattaatcattaatgactcccagggacttatagcagtggttttcaagttatacttcatgcatccctgtgtgtgttctggagtgaagttgggggcagcaggccgagcaggccacataacagggccaagccgccaagcctctaatttaactaggacagctgtgctttatatctgtttatcatcctggcctctgaagatatttcccattagagtgaaaattctacagccaaaagaaatatttgaatgctattgatgttgaccttcataactaataagcttagtatttatcaggaacagaagggtatctctgacatcaagaatgtgaaagcttcataggccttgtgtccaggaactttatcccccctagatgtattcgtttggttgcaaggcccagaatgaggcctctcacagcttgatgtgaccttttgtgtgttgtaaggccctttctctgtctttcagggctgctggtgcctgttatacacatgaaatacagaactctgcctgaagaacaaccatggccttgatgcaggcactatccctggtcagcatcagatatgaaattgcacatagttctataatttgcattttctacttaatatatgtctaatatactcctgagtgattgtagagcctatttaaaagcagcagaatattccactgaattaaaattttttacatgtttacttcatgaaatgaaattctgttgcctttatcagaactgggagaaccttaagacatcctgtccagtcctcatgctgtggtctccatgggaactaattcccagtgagctctttgttctcagggcagcttagttgccctcatttactcttccaaactgtgattaagctcaggctgtaggcttttcatctgcatccaggaaaagggaaagtgcacactcttacctataaaaagggaaatttgccattgataaatctggtggttcccaggcccatgctataaaattgcctcaatttttccagttcagagaatgttcatggtgagtggagcctatggccatggccaggcttgactgacctaagcctctagtgtcatctctccctaaacaaatattcttattaaaactgctgttaagtaaaagcactgaattgaaaattaggttttcatcaggttctagtgctgattgtgccactcaactaactgtatgaccttgggcaagtcactgaacaattctcatttgaacacagaaaggacgatgttgaaccaagtgatctctaggattattttcagttctgataccttgagtctttgatactaggagataattgctatgtaaatgctttcaaaagttcaaagtgctatatcagcgtgaggtgttatgattaattaaacttactgctttaagttcccacagagcataaggagaagtaaaggagccttcctgatacacaactgggcaagtcaacatccgaatcatctgaagttagcatggtagtgttatttactgggaagaaaaataataataagagttattattcattgaaacatgaccacatgccaaacagcatgctagtcactgtcacatacatttttattattcatccccacaatgaatccattgttactattatttttgcccttttacaaatgagaaaactgagttcaaggaggttaagtgacttgattgccatcatacccctagcaatcgatgaagctaaggtttgaaccacaatttttctgattcaaaagctcaagcattttcaagtgtgagaaaatgtgagatccaaggccatgttttctatcccagtacatctaaaactctaattcgtgtatgaatcaccaggagttcttgctaaattcaaattgctgactccataggtctggggtggagcctgagcttctgcatttctaacaagcttccagttgctgcttgatgtagcaggtccatggaccacactttgagtagcaagagactagagacctttatatggaaatcatctggcctatatttgcccctggagcagggctgcacagactgcactgcacaactccagggagcactgttcacattgcagtctctgtgcagtgtgcctcttgagttgtgtactgtgctccccttgtcctagaatgagaacattgtgagtagtgagtagatctacagaatcttcctctacctgtgccacgtctgaagaacaggaagtgttctttccctcacaaatgaaaaatggatcaatgctgttgagaaaagcaacacaaatccagtctgcccacaatgagggtggcccatttggtgttctaaggcaagatggggaggagggggagaaggaagctagctggcaagctggctggctggctgactgactgactggctggcttgctggctggctggctggctggttggcgtggcaggctccattcttatgctaacaaagctctgattccaggcagcagctgctgcttgtgtgggtgcttgggccattcatagcagcttgctttaccagtgccagacccccagaacaggtgcggccgcacttgttattttgctcagtcctgaccgtccagacagggagctgattatcactatgaatctgggattgctgctgatattccagcttctcctgaacaaaggggccagccttgagacagctgtcttttctggccacagtgaggctgactgccctgaaggccatgtgggccttggggaggtgggtttgcattgcaaatgggacggagaaaatcagacccaggtaagcagttcttctgaaacagttcaaagtgtctgagagtcagaaagtttgggggcttaagcccacagtccccaagcaggagctccaaacctattgagatctctccaagctcctcttctctggtcaggtgctgttgcccttagccttcccttggcctaaggtctgctgcagtggccaagggcaagagaagggcagctggctgacattgtccccttcctcctttgctcagcctcaggaccaggctttgggaaccaggaaattagcttctattcacaaaaaggatggagaactatagcactgtggttaagaagaccagctccagggtgaggcagcctgatacagatcttaacttgattactcactagcagcaagcatgagcttaggcaatcatttgatttattcaagcttcagttttgtcacttctcatagaagaataacaatagtacttccctcagggactattatgaggatttattattaataataatgaaagctaacactgacagagcacctactgtggactaggtactcttctaagtactttacacactgtaattcactaaatcctcaaaatgatcctgtgagagggacttgtattatccccattttatagatgtggaagctgaggatcaaaggggttaagtaattcgcccaacgtcacaaatctggtgagcagcagagctgagaattgaacctagcagtttgctccagaggccacgtcgtatgcactatgctttactgcacaaacttaaagtggagtgagcacagtgcctggcacacataaatccttgctaaatgagggtggttatgattcactaaactgatttagcctcactgtttcaatgaatagctaaatatgtgtcacctaaaaaagaaatgtatatttttttcaataagaatatgggtttccacagctggagtcttcataatggaaagagtaatagtctttcttggccccagggctccagttccattcattcatacacaaaggagggtaggacaattcattttcccacttggcttagcagaccatttttgattcccagagcagcttttcatctctgcccaccaaaccacctcctcttaattctaccgcctctacaggcccactgcttccccataacctttagccctgtgaatttgattcacttattatgtgaaagaaagggagggactcaaaaaaggagggagggagggtaggagagaaagaaaggagagagagtgagagatcaagaacagagagagagagagagatcaggggtgggaaggagatacttctaaaaagaaaacaaggaagaaaaaatagtcaagacagtcctattcaaatctaatcttaaataaattttgactgcagttttagaagaatgtttattgaaaagggaatatgtccataatatacaattatgtgagaaaagcaggctgcaaaatagtgttacaccattttgaagtgtgtatgtacaaatataaaaaaaaaagactggaaggaagtattccaaaatgttaacagtaatcatctgtaggtagtcaagttgtagattatttttcttctttaaattttctgtaatttttccagaattctaatgaatataaatgctttttgtaattttaacaagatctaaggaaaaggaaaaagcagggataggatatgtcggtactgcctgcatgagggatggatcctgcccccaagaatgccctgtactagacagaaatgattgttgtcctatgtgtattgcaaaattgcattttctgtgtgcaagggaatgctagattactcaacaagaccacagagagctttgaggcacatgctcagctcccagtcagctctgagagtgtctgatcttcctgcccagacaaaccctgacctgtggtgtgtccacttagaataccatgtgtccctgactacagtttgggaacccagtggtagagttaacattctacagacttgccataggggcaaaaaccagaacagggccaaggggacaaaagcaaacagatcagggactacgagtgcagaaggtcagagctgacaacaggaaacagaaggatagtatcttcagtgagctggagggggttagtgctgaggtgtcacgtgcaagattcttgttttgggtatggctgtgttggagacgggtaaaaagagtgtaagtaggcacagggttagggacaaaggcataactaggggccacaaactcaaatgcctttggggaccagactggtagcttaatgattgcaggggcctgggtgaggactgtgctgagctgaaagagaacgattcccatggaagagagcagtgggaagcctgggaatttgggcccacatttacatgtcttatgaatttttaagagaagatagatatccaggtatttatgtaaaatctcttaacaattaatttttttttcaatgtcaagacactacgggccaagcaaaatatatctgtgagccacacatttaaaaacatttcacttttaaataattatagattcacaggaagttgccaaggtgttacaaaggggtctctgtgtacctttcacccagttttcccaatggttacatctacataaccatcatgtaatatcaaaccaggacaatgacattggcacaatgtgtgtgtctagttccatgtcagttcatctcatgtgtgggtttgtgtgtccaacaacacagtcaagatacagaactgttctaccattgcatagatctccctcgtcacatactagtcacatccattttcctccctccaacattccttacccttggcaaccactaatctattcttcatctctatagttttgtcatttcaagagtatgacacaagtgaaacaatatattatgtgactttttgagactagctatttttactcagcataatgccctggagatccacccaggttgttgcatatactagtagttcattcctttttattgctgcatagcatttcatggtatggatataccagagtttgtctaaccattcaccaattgcaggacatttttgctgcttccagttttgggctttacaaatacaactgccatgaacaatcatgtacaggtctttgtgtggacaaaagctttcatctctagaataagtgtccaggagtctgattgctgggtcataaggtaagtgcatatttagttttataagaaactggtgaactgttttccagagtggctataccattttacattttcaggaacaatgtatcagtgatccaatttctctacatctttgccaacatttggtactgtcacaaattttttacttcaaccaatctgacaagtgttagtgatatcttgtggttttaatttgcattttcttaatggctaatgatattaaacatctcttcatgtgcttatttgccatatatataaactcctcagtgaaatgctggttcatgtcttttgttcattttctaattaaattttgtggtttttgtcattgagtttgagtttttaaaaatatattccagatagcagtcctttgttagatgcatgatttgcaaatatatatattttttcagtcttcagcttttcttttcattctgttaacagggtctttcatggagtaaagtttttaaatttttatgatgtctgatttattcatttttctttcatggattatacttttcgtgtcatgcctaagaactccttaccagccctgggtttctaagatttttcccttatgttttcttctaaaagtttatagttttatgctttacatgtaaatctatgatctatgttgagttaattttgtgtgaggtatgagagcccgggtttaagtgattctcgtgcctcagcctcctgagtagctgggattaaaggcatgtgctaccagacctgcctaatttttttttttttttttttttttttgtatttttagtagagacagggtttcacaatgttggccaggctggtctcaaactcccgacctcaggtgatctgcccacattgaggtatgagatttaggtcaaggttcattattttgcctagggatgttcaattgctacagcattacttgtcaaaaaggcaattcttccactgactttttttttttaatagagtctcactctgtcatccaggctggagtgcaatggcgcgatctcagctcactgcaacttctaccgcccgggtttaagcgattcttgtgcttcagccccctgagtagctgggattacaggcgtgtgctaccagacgtggctaattttttttttttttttttttttggatttttagtagagatagggtttcaccatgttggccaggctggtctcaaacttccgacctcaggtgatctgcccacattggcctcccaaagtgctgggattacaggcatgaaccactgcacccagcccttccactgaattctttttgcacctttgtcaaaaatcaggtgggcatatttgtgtgagtctatttctgagttgtctattgtgttccattgacctgtgtgtctatccttccaccaatacaatgctctcttgattactgtagttttgtggtaaaccttaatattgggtaaaacaattactcttgcttgattcttatttttagaaattgttttagctatgctaggtctttccaaatatattacagaattatattgtctatagccaaaaatcttgctgggatttctataggaatagtatgaaatgtgtatgtcaattttggaagaattgacacttttactatattgagttttctaatccatgggatctatccatttatctaggtctttgatttctttcatcattgtctttacatttcaacatacaagtcctgtatagattttgttacatttacacctaaataactcatttcttgagtgattataagtgctcttgtatttttaattttggttttcacatgttcattactagcatatagaaatacatgtatctaatgactagtgatgatgagctttttttcagatgtttgttggccacataaatatcttcctttgagaagtgtctgttaatatccttcacccacgttttgatggggttgtttgtttttttcttgtaaatttgtttaagttccttgtagattctagatattagacttttgtcatatggatagattacaaaaattttctcccattctgtaggttaggttgcctgttcatctgatgttagtttctttggctgaacagaagctctttagtgtagccataaaaaagaatgagttcatgtcctttgcagggacctggaggaaactggaaaccatcatcctcagcaaactaacagagaaacagaaaaccaaacaccgcatgttctcactcataagtgggagttgaacaataagaacacatggacatcgggaggggaacatcacacaccagggcctgctgtgggtggggggaaagaggagggagagcattaggaaaaatacctaatgcatgtggggcttaaaacctagatgacagtttgaaaggtgcagcaaaccaccatggcacatgtatacttatgtaaaaaacctgtacgttctgcaaatgtatcccagaacttaaagtaaaataaaataagtacaattggtttttgtatgatgatattgtatcctgcaaaccaaaacttcattgctagatcaaggctcatttttataaattcgttgacatattattctgtgtagatgatcatgccatctgtaaatagagacaattttattctttccttttggatgtataagacttttattccctttcttgtcttattgcactgggtagtactacctcgaatagcagtgatgagagtagaaatcagtgcttcattcccaatcttagagaaaaacattcagtctttcaccattgtgatgttaggtttagctttagtttttaaaaatcagcttgagataagattcacatgctgtacaattcacccatttaaagtacaagattaaagactttgagtatattcacagaattttgcattcatcaccagaatcaattttattcagtgctctcaaaataaaccacataccccttagctgtcaccacccaatccaccatcttccccggccataaacaaccactagtctccagttggtctctatagatttttctattcaggacatttcatataaatgcagtaatacaatatgtggccttttgtgactggcttctttcacttagcataatgttttcaaggttcatccatgttgaagcatgtattagtatttcagttatttttattgctgaataatattgcattgtatgcacataccataatttgtttatccattcatcagttgaatatttaggttgtttccatttgttggctgccataatgtctttttattattgagttacaagagttctttagattctagatacaagtcccttatctcatatatgattttcaaatattttctcccatcctgtgggttgtcctttcattttcttgatgctgtcctttaaagtacaaatgtctttaactttaatgatgtccagtagtttattttttcttttcttgactatgctgttagagtcagatacaaaaactactgcctaattcaagatcactaaaattcacacctatgttttcttctaaaaattttctagttttattttgtacatttacatctttttatccattttgggttaatttttatatggcatgatgtaggagtaaaacttcattattttgtatgtggacatacagttgtcccagcaccattagttgaaaagattattcttttcctaataaaacttcttggcacccttgttgaaaatcaaacggccataagtgtgagagttcatttctagactctcaattctattccattgttctacgtatgtatgtaggtatgtatgtgtatatatacacacatatatatacacacacacacatatatatacatatctatcaatctatctatctatctctctctctatatatgtatgtatgtataagacttttattccctttcctgtcttattgcgctgggtagtactacctcgaatagcagtgatgagagtagaaatcagtgcttcactgcgtttgagctctgagaatggactgactgcctcctcaagtgggtccccgacccccgtgtagcctaaatggggacacctcccagtagggagttggctgcccctctggggagaagcttccagaggaaggatcaggcaggaatattgctgttctgcagcctccgctggagatacccaggcaaagagggtccggagtggatcttcagcgaactccaacagatctgcaactgagggatctgactgttagaaggaaaactaacaaacagaaaggaatagcatcaacatcaacaaaaaggtcatctacaccaaaaccccatctgtaggtcaccaacatcaaagaccaaaggtagataaaaccacaaaatggggagaaaccagagcagaaagggggaaaattctaaaaatcagagtgcctcttctcctgcaaaggtttgcagctcctcgccagcaacggaacaaagctggacatagaatgactttcatgagttgacagaagtaggcttcagaaggttggtaatgacaaacttctccgagccagaggaggatgttcgaacccatcacaaggaagctaaaaaccttgaaaaaagattagacgaatggctaactagaataaacagtgtagagaagacctcaaaggacctgatggagctgaaaatcatggcacaagaacttcgtgacgcatgcacaagcttcaatagccgattcgatcaagtggaagaaagggtatcagtgattgaagatcaaattaatgaaataaagcaagaagaaaaggttagagaaaaaagagtaaaaagaaatgaacaatgcctccaagaaatatggcagtatgtgaaaagaccaaatctaaatttgattggtgtacctgaaagtgatggggtgaatggaaccaagctggaaaacactcttcaggatattatccaggagaacttccccaacctagcaaggcaagccaacattcaaattcaggaaatacagagaacatcacaaagatactcctagagaagagcaaacccaacacacctaattgtcagattcaccaaggttgaaatgaaggaaaaagtgttaagggtagccaaagagaaaggtcgagctacacacaaagggaaacccatcagactaacagcagatctctctgcagaaactctacaagccagaaaagagtgggggccaatattcaatattcttaaagaaaagaatttccaacccagaatttcatatccagccaaactaatcttcctaagtgaaggagaaatgaaatcctttacagacaagcaaatgctgagagattttgtcaccaccaggcctgccttacaagagctcctgaaggaagcactaaacatggaaagaaacaaccagtaccagccactgcaaacacaggccaaattgtaaagaccatcaatgctatgaagaaactgcatcaattaacaggcaaaataaccagcgaacatcataatgacaggatcaaattcacacataccaatattaaccttaaatgtaaatgggctaaatcctccaattaaaagacacagactggcaaattggataaagagtcaagacccatcagtgtgcttattcaggagacccatctcatgtgcaaagatgcacataggctcaaaataaagggatggaggaagatctaccaagcaaatggaaagcaaaaaaaagcaggggttgcaatcctagtctctgataaaccagattttaaaccaacaaacatcaaaagagacaaagaaggacattacataatggtaaagggatcaattcaacaagaagagctaactatcctaaatatatatgcacccaatacaggagcacccagattcataaagcaagtccttagagtcctacaaagggacttagactcccacacaataataatgggagactttaacaccccactgtcaatattagacagatcaatgagacagaaggttaacaaggatatccatggcctgaactcagctctgcaacaagcagacctaatagacatctacagaactctccaccccaaatcaaatagatgcaataaaaaatgataaaagggatatcaccaccgattccacagaaatacaaactacaagagaatactataaacaactctatgcaaataaactagaaaatctagaagaaatggataaattcctggacacatacaccttcccaagattaaaccaggaagaagttgaatctctgagtagaccaataacaggctctgaaattgaggcaataattaatatcctaccaacctaaaaaagtccaggaccagatggatttacagccaaattctaccagaggttcaaagaggagctggtaccattccttctgaaactattccaatgaatagaaaaagagagaatcctccctaactcatttgatgaggccaacatcatcctgataccaaagcctggcagagacacaacaaaaaaagagaattgtagaccaatatccctgatgatcattagtgcgaaaatcctcaataaaataccggcaaaccaaatccagcagcacatcaaaaagcttatccaccacgatcaagttggcttcatccctgggaagcaaggctggttcaacatatgcaaatcaataaacataatccatcacataaacataaccaacaacaaaaaccacatgattacctcaatagatgcagaaaaggccttcgacagaattcaacagcacttcatgctaaaaactctcaataaactaggtattgatggaacaaatctcaatataataagagctatttatgacaaacccacagccaatatcatactgaatgggcaaaaactggaagcattgccttgaaaactggcacaaggcaaggatgcttgtctcaccactactattcaacataatgttggaagttctggccaggccaatcaggcaggagaaagaaataaagggtattcaattaggaaattaggaagtcaaattgtctctgtttgcagatgacatgattgtgtatttagaaaactccatcatctcagcccaaaatctccttaagcagataagcaacttcagcaaagtctcaggatacaaaatcaatgtgcaaaaatcacaagcattcctatacaccaataacagacaaacagagagctaactcataagtgaactccctttcacaattgcttcaaagagaataaaatacctaggaatccaactaacaagggatgtgaaggacctcttcaaggagagttacaaaccactgctcaatgaaataaaagaggacacaaacaaatggaagaacattccacgctcatggataggaagaatcaatatcatgaaagtggccatactgcccaaagtaatttatagattcaatgccatccccatcaagctaccaatggctttcttcacagaattggaaaaaactactttaaagttcatatggaaccaaaagagagcgtatgttgccaacacaattctaggcaaaaagaaccaagctggaggcatcacgctacctgacttcaaactatactacaaggccacagtaaccaaaacagcatggtacgggtaccaaaacagagatatagaccaaaggaatagaatagaggcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaatacaagatggattaaagacttaaatgttagacctaaaaccatgaaaaccctagaacaaaacctaggcaatacaattcaggacataggcatgggcaaggacttcatgacaaaaacaccaaaagcaatggcaacaaaagccaaaacagacaaatgagatctaattaaactaaagagcttctgcatggcaaacaaactaccattagagtgaacaggcaacctacagaatgggagaaaatttttgcaatctacccatctgacaaagggctaatatccagaatctgcaaagaactcaaacaaatttacaagagaaaaacaaacaaccccatcaaaaagttggcaaagggtgtgaacagacacttctctaaagaagacatctatacagccaacagacacatgaaaaaatgctcatcatcactggtcatcagagaaatgcaaatcaaaccacaatgagataccatctcatgagagttagaatggcaatcattaaaaagtcaggaaacaacagatgctggagaggatgtggagaaatacgaacacttttacactgttggtgagagtgtaaattagttcaaccattgtggaagacagtgtggcgattcctcaaggatttagaactagaattaccatttgacccagcaatcccattactgggtatatacccaaaggactgtaaatcatgctactataaagacacatgcatatgtatgtttattgtggcactgttcacaatagcaaagacttggaaccaacccaaatgtccatcaatgataggctggattaagaaaatgtgacacatatacaacatggaatactatgcagccataaaaagtatgagttcatgtccttttcagggacatggataaaactggaaaccatcattctcagcaagctatcacaaggacagaaaaccaaacatcacatgttctcactcataggtgggaattgaacaatgagatcacttggatacagggaggggaatatcacacactggggcatgtcaggggttggggggctgggggaaggatagcattaggagaaatatctaatgtaaatgattagttgatggaggcagcaaaccaacatgacacatgtatacctacgtatcaaacctgcacgctgtgcacatgtaccctagaacttagagtataataaaaaaaaatcagtggttcattctcaatcttaagagaaaagcattcactctttcaccattgcgatgttaggtttagcttttgtttgaatcatcttgagataagataaaatatatataagatatatatgtataagatatatatatattttatgacagtactacactctcttgattattgtacctttgtagtaagttttaatattgggaagtattagtcctccaactttgttgttcttttccaagattgttttaactatttggggtaacttgcatttccatacaaaatattgtaaaaattttaggatcatcttgccaatttctattttaaaaatgcagctggaattttgatagggattttgttgaatctatagatcaatttggagagttttgtcatcttaacaatattaagtcttctaatccaaggacatggaatgtctttccatttgcttaggttttctttaatttctttcaacaatgttttgtatttttcattttataagttttccacttattttgttaaatttattcctaaatattttattttttgatgctattgtaaatggaatcaatttcttaatttcatttttggtttgcttactgctactgtatacaaataaaattgatattttgtataatgatcttgtaccctgcaaccctatttaacttgtttattagttctaattatttttagtggattcctcaggatgttctggacactggtcatgtcatctgcaattagagattatttaaattctttctttccaatcagggtggcttttatttcattttcttgcataattgtcctggctacagcctccaatacaatgttgactagaaacgacaaaggtgttcctaatcttagggggaaatcttttagtctttcactattaattatgacgttagctgtgggtttttcatagatgctctttaccacgttgatgaatttccttcctatctgtagcttgttgagtgctttatcataaaagggtgttaaattttgtaaaaagtctttctctgtgtctattgaaatgatcatgtggttttgtcctttatggtattgaagtggtatattacattaattgattttgcagatgttaaaacaaccttgaattcctgggatgaatctcggtaggttataattgtgtaatcctcttttatttgttattggtttcatttggctatttttttgtttttgttttttatttgtttgtttgttttaaggcagtccccccctctactcctagttttctgagaggtaggtttggtttgttttttttattgtcaggaatgaatgttagattttatcaattgcttttctgcatcaattgataagattatattatttttcttatttaacctattgatatggtggattacaatggttgattttgtaatattgaactaactttgcatccatggaataaaccgtagttggtcatgatgtataattcttttcaaataatgctgaattctattgactaatattttgttaagaatatttgaatcatatttatgaaggatattggtttgtgccttctttctttttctttctttcttcctttcttctttcttttttctttctttctttctctctgtctctttctttctttctttctttctttttctttctttcttctttccttctctctctctctctttctttctttccttctttcttttgtactgtctttgtctggttttgttatcagagaataaatactagcctcaaaagtgaattggaaagtgtttttctcccctttccactttctggaagacattgttgagaattggtgttaattcttctttgaatatttggtagaattcctcagtgaaaacttctgatcttggaaaccttgttggggggctttgaaattacaaattcagttttctcaaaagttataggtctattcaaattatctattttatattggctgatttgtgatgcattatgcatttcaaagaatgattaatttcatctacattgtcaaattaatgtgtatagaattgcttgtactactccattttatccttataatgtttatagggtctgcagtgatattttcattcagatgttggtaatttgtgtcttctctctttttctttatcagtcttgaaggatcaattcagtcaattttcttgatcttttcagaaaccagctcttgttttattcattttctctattacttttcttttttttttttttttttttttgacagagtctggcactgtcacccaggctggagtgcagtggcgccatctctgcccactgcaagctctgcctctcgggttcatgccattcttctgcctcagcctgcggagtagctgagactacaggtgccgccacctcgcctggctaattttttgtattttcagtagagacggggtttcaccgtgttagccaggatggtctcgatctcctgacctcgtgatctggccttggcctcccaaagtgctgggattacaggcatgagccactgcacccagcctacttttctcttttcaacttcactgatttctgctcatatatttattattttattccttctacttactttgagtttatgttgtttttcattttccagtttcttgaggtgggagcttgattactgattcaagacttttcctcttttctaatatatgcattgagtgctataaatttccctctcagcactgctttagcagtgtcccacacattttggtatgttgcatcttcattttcattctgatctgtaggttagaagtcctggcagacttgacagggctttctgtttaaagtgtcagctgggttggactcatatctggaggttctgtggatgaatctacttccaagctcattcaggtgtaggcagaattcagtttctttgggttgtagatttgaagtgcccatttccttgctgattgtctgctaacagtcacattctgctcctagaagccacttgaattcctccttagtgacccactccatcctcaaaaccatcaactagcaatctcgcatgtcaaaatattctcatgcctcaaatctccctgacttcctcttccatttatcagtcagagaaaaccatgttattaaagggttcctatgatgagattacacacactcagataatctgttttgccatgtaatgtaacataatcattggagtaatttctcatcatgttgataggttccacccacactcagaggggaggggattatacagaagcaagggtcatttgggtggtcatagttaaaattctccctaccacagtaattatctaattcaaagaaaaatattgggaaaatggtatgaccaaaatattgaggagtgcatgacaacagtttgggacccaacggagtagttcattttaaggtccattccaaattctatgattctgtagtagggaagtcatggaatattctgcttttctgtctattgtaggggccaagggataactttccccttggccttctgaaggttccctgaaaaatcaactcataaaaggcagatggataggagaaacgacatacacatttaacatacgtgtacatgggagccttcagaatgaagacccaaagatacagagaaaattttccattttatgcttaggtcaaaaaagtatggacagccatgtagaaatatgattagacataaagagcataatccaatgcaatagactcagtggggaaatacatcaaagcctctctgtctagattcttctaggcctctctgaacatgaattcctttcttctgggtgtggggcatgaccctctctggaacagagatcttatgacctgcagtcaaacaaggtaggtcagatcgtttctttgtggttagtttatacacagaaagacagagggaaagttagagtaatatttttaggtttcatggctggatttggggagaaggggtcggtttctatcactcgtcttagggaaaagagattctaggttctgtggctagcctccagggaggatgggattgagagacaagagggcaggagaaggtcagagaataacatttgcttctgaggccttcattttggggtactgttttctgagctccaacactccagtgaggtgaggtacagcaaaaaccagaggccagtatattctttaaaaatatcaaggtcatgaaagataagaaaaactgagaaactgtttccaattaaaggagactgaagagatatggaaactaaagttaagaattcattcatatttggatcttttactaaataatttttgaccttttgttctaaaggttgacattgggataattggtgacatttgaaagaggtttttagattagatcataatgttgcatgaatattaatttcctgattttgataattgtggttatgtaagagaatgctcttgatttttagaaacatgaactaaagtatttaaagataaaggggcatgatctccatcttactctcaaatgattgagaaaaaatagtgtgtgtgtgtgtgtgtgtgtgtgtgtacagaaaaagagaaaaggataaagaaaatgttgcaaaggttaacatttggggaatctgagtgaggagtacgtggaaattccttgtacttacatttatcctttctactaacagagcttcagatgaaaatcacaaccctggccaacaccttgatttcaatgcaatgagaccctaagtagaagattcaggcatactgtgcctgtacttctgacccacagaaactgtacaaaaataaatttgtgtgttttttaaaagtgaggccaatggtgtgtaagaagaatttgaagtgggaaaaaagggtagattcaggagacattatggagagaaaattgccacaatatggtgttttccttggctagatatgggtagagagagaagagttggggatgattctgaagttgggagcctagaaattgggataatgctggcagaaagaggcaaatagagggagagctgggtgggagaaaaaaaatgatgttttagaaattctgagcttgagtgaacagaggacatgagtaaaagggaaccatctagtggaaaggaattggttaaggattgaagctgaacagagaggtcagggctgcagccagaggtttgggaggcatcaccattgttttggatgtatttggaatccctgttgtaaagggaagaaagaggctgaaaatagaacgatatatttgagtccactcctgcacaccaagttggttgtgaggacttgcactgaagacagacagatctaggtttaaatcctggctttgctcatgcctagctctgtgacgctgaacaagtgcctaaacctctctgagcctctgcttttcttttattcagctatgaaatggtgacactgatcatacctgccttgtggtgaggactaaatgagataacctatatataaagcacttagctcatcgcctggaacataggttgcgctgaagaaattggggttatgattgttactgttgtttcctttcatgtgattttctgcattaggcagccttctcccgaaaagaaccctgacaattcagatcactgtgtgttttgttttgttttgttttgctggtgggaatgaggcaaggcgaccatagcatggcatcttttgcttatggagggcaggtccacaacctgttactgaaaagggtgaactttttctttttctgtcaatacgggcagatgaagagaaaagcacaaggagctctaggaagggaaagttggagctgtggctaatggagcaagggcagaccccaaagactcatctagatcatcagtgatgattcattcctccgaagcctttcctaggccattctgagaaacactggaggaagtgggatggcatgatctagtgtgagtgatgggcactgtgcacaaggggatgatttgtatttatgaaaggttcttggtgcctaggctgcctgatgcatgtctaaaaaggcagtgggttccaagtcaatgtgcctggagtgaggagatttagcttcacctgctggcactgactttccctacagaagatgtagctctgggcaccacactcctagcttacatttgatccctcctgctgaagcagtaatcaatctgcagtcttctgctattagatgttaatgcaatcaaagagatcacaatgaccttaagatttcctgattaattcactttttcccctagtcagcattaccttctttaatttctcagcacttggctcgttttctcagctcacttggctctgtttcatgctacaagtacctttttcctctactgaggagagggtttgggtagagtgatggcgttctgggctgcctggtagtggaagatggagaatccctgtccttgaataaaggtgtactacccaaaaagaaaggttttggggttttgacaaaaagcaatcttagaaaaggacatttggaaatggtaagagaaagacagagagagagaggatgtgtgtgtttgtgtgcatgtgtgtgtatgtctgcgtgtgtgtgtgtgtgtgtgaaagagagagagagaaatcttgagaaactggtaggaacaaagtaaaattattatttcctctcaagtcaaagaaggtacagaaagaaaactgccgaggtgaagatacgtatcagggattaccaattttccagagccccccacgcataaagtgctttaagatcctcagtgaggagaagcttaagatacagagactgatgatctgccaccataggtgggcagctggagttgatacaagctgcccaaagcagaatttgtgatttttttctgcaaatacattcctcttccagtcaaccccactcagtaaatggcactaccgctcacctggttgcttaagtcaaactcctggtggttatcctgagttcttcttgttcccttacacatcacatcctagtcatcagcaaatcctgttcatttaccttgaaaatatttactgaatttcatcacttttcaccacctcctcagccattagctagtgtgagccaccatcatctctttcccaaaccactgcaacagccccctaaataatctacttgcttccgctcttactgccaggcctgccatgtatggatgttcaggttgtatactacacaagggcaccatagctatgggtgtgccatttatatcacagacacatacatacttacataagattgtgcagatgggtgcagacattctgggcttcttggctctaagtctgacaacagcggaagagagcctgctcctacttaaaactgtaccagtgcacatggccttgcatagactcaggaaagcacaatcacacacacacatacacacacatatacatccataaatgtacatactcagtggcacacacaagtggactctatcctacccaagccctgggtgtcccctgagtttacttctctctctactacccattgttcccacaggctgaagtcccatccctcccacttccagctgcctcagctggagaggggatagaacagtggggggcaaagtgttgttgatggtgcatctattccagtgacaagaaatgcatgagtgagaggaataatgtgggtgctcacaacacaggctgctgcccaccatgactctggcaaactttcttgggcaggacttaaatttgtttaggttgtacaagaaaagactaacataatttttgttgtcatttttaaaatgaggaaggggtgtcttttttgtgattcacacagacactgtatcagatagtggcagccttacgcccccccgcccccgccaaatctcaactccaaccaatctctactctatataacagtcactaagaactttaacaaacaggctgggtacaggggttcaagactgtaattccagcactttgggaggtcagggcgggcaaatcgcttgagcccaggagtttgagaccagcctgggccatgtggtgaaaccccatctctactaaaaatacaaaaattagccaggcgtgttggtgcacacctgtagtcccacctactcaggaggctgaggtgagaggactgcttgagccctggagatcgaggctgcagtgagctgagaaaaataaaaaaataactttaacgaacacttgagtatgttgattctttgcttaaagccttccatttatattttaatgtttttaggataaagataaaactccttagatggcctacaaagcttgaatgatctggcccctgccttcctctgcaacctcatctcatatcaccctccctctcatgactgccccaaaccccacccacactgattttctgtcccttgagttcaccaagcacatatcattgtatttcttgtttatctgcctcccccttcctcctacctccctgcttctagagtgttaactctgttaagcagggactttgtctttttcatcattatgtcttcatcacctagcacagttcctggcatttaataggtggtcaataagtatttgctgagtgaataaataagtgaacaggaaaatgagcaattttgctccctattccactcattggctctaagatgaacctcagctcagcctcatctctagtgtgctttgagatcctctggtgaaatgagatggccagaaaatgcaaggttgttaaacatcagaaagttgcaagaccagtttggtcaggaggaataataatcagtataaccagcacgtattgagatattagcatgtgctgggcattgctctaggcttttttctcatttaatctccacagtaaccttataaggtatttcctagtatagaattatccacatttgatgatgagcaaactgaaacccaggtgattcagtgacttggatgcagacacaggcagttcgattcaaagctttcttttgtgttgtgtgagaatgagaacagtctcatttccactgatttctttttcaaaccaccctaggattatccctctaccccctggcttctcttcaatctcataatcttgaatccagccctgaggagcaggtagaaaagagccatgtactacattggtaagctgcagtgagtgtaggtctagttagtgtccccatagggtagcagctactttgatgattgacaatataaatttaaaagctgagatatcctgtactatcttgatactgaaatcaataaaaccatcaaatcctaagccagcctcaccaaactaaaagggagttgcaaccacaaagcaaatttaacacctcttggaatctttctgacatcacatgaagcactacctctgaggtgagaatggcattagcttgaagctctacagggctgaaaccttagctattacagggctggattgtatctgccaccttcacatgggaagagaaattgacatggggggaagagacaactgactaggcagtctttgcagctctgactgtgcataaagagaatgaaaaaataaaagaagagagggaaaacacagcataatcctcattgttaagatgttatcatgctcatgggcataacagaaattactgttcttcatctcaccttatgattccctttaacaaaagacaaccattgaaaacacaatttgaggccagtttaccccttcatgctcagagcctgaatcacaaattcatgggctgtattaaatgctttccccacttattttatcagattcttagaaccagagaaggaacctaatagaatatctggttcaactcattcacattttctagatagggagactgaggccaaaagaaaggggtcttgatttcattttcaccaagtgtacgcgtgtgtgtgtgtgtgtgtgtgtgtatgtgtgtgtccattcgtgtgttgcatgagtgggaggtttgcttcaggagctgttaaggggagagatggaaagttctgtattctaaaaggaaaggggtgaaaaatgttagaatcaatacagtgtttggtaaataactagtaatttgtcacataaacatatacacactacaaacaccactgtctgtggcagaaacagagggatgttctcaacagagggagggtctcagccaagaaggataaatgagggccattcatcctttcagaccctttctgccattggcaaagattggtccagtccactgcctaggttttctgtgggctctcaacattttgctcagcagagacttcccaaggctgcttcactagtggctggtggcatttaacctctgtgggagggatggagctttttcttttcatcatggaatccattatttttctttgaagcatagtgcaaagcttcttacaaattgcatggcaaaaatagaaatgcagccagttctcagcacagccttgtggaagtcggggcaacctgtccctcaggcagtgtggatggagagtgtgttcatttctgaacttgatggtaaatcctatggggaaggaggcagaaagcaacccatcccttcctcttctcccttaaagggaactagacctaaaatgtgttggagctgtgagccctggagaaagccagcccaattgcagtattagaccccgccagagggagtcagagtgtggcagcttggctgtgaacttgccgtgagacctggagtaagttgcttcccctctttgggtctctgttttttcatttaaccctcatgcttcacagaatgattgaaaggtacaaatgtagagaaaatagacccacatatgctttggaaacagtaaaaacctgatattagtacaaaatatttttattgtcattgttttatgtctgctctttgtctctggtggttgacctggaatttgggtatctgatctggaatttgacttggtatagaatatttcaggataggttcaaggcctctggagctgcagaaagaagaattgttggaagagtcaatgcaggttgaacactgggctcaaacagacccctcacaaatcacagccctgctccttcattaatctccccgggtatgtcttccagcagcttatcgaacctctgagcttcagtttcctcatctctaaagtggggttgttgtgggaatttaagtgagataataaatgaaagctattatgctgaagcactggtgtggagtatgcatttgataataattctttttgatgttatttgcatctgtgtgctgagaataactgtgattccttaatgtcagtgcacagctagtccttgttaaaacatacagattcctgggccttgccctaaagaaattctgattccataggtttggaatggagaacaagaacatgtgtttaacaaggactccacggtattctgatgtgggtccaatttggaaaccattggtgtagagcactgttattcaagctgtcaattgttacccactgctcagaaaatcaatttagtggatagtgaccagcattaaacacacatacaggaatggaatgggaaataacagggtacactgcacacagtaagggtaaatattgagttataaaatgtttataattacatataattttaaatataaagacagttatatttatcatttataatatagttgtatatacatcgtttgtgtgtatgtgtatatatatacatgcaaacatttcatgaggcaatacttaccctcactgtagataccttgacattggacaaaattatttgaaatactcatttcttatttggagaaactggcatccagagaattaatctgtcaagtctcagataagacaagaaatgaccaacaagggaatggagtaggatccatttctcctctctccccatctctcccatgctattcttggatcaacagagttggtggttctctaattagaatcagttctaatatcatataatggccctggcctgaaatgtaagggcaagttagggaggcggctgcaggtatcaggctaatggcattgaccccattagacggaaaatgcatctgggtttatgggatgtttagctgctcttggttagtgaaggctttgtataagtgtgccaagctcttgtccaaacaactgctcctcctttccttctcccagactttgatattgattttaccatttgaaactcttttgttgcctctgtaaaatcaaataattagcttaaaactatccttccggtcacatcaaccagcatcatcttttcagtcctgacttgatatgttgaagatgttagcacccctaacctttcatccacatgctctgtctaaagggagcagctatttctgggttccagttcattatggtcctgtgggaatgtggtcactttgccagtgaggccttctgtgtctaccctctgtgatactctaggccttgcaggaacctactactcttaccatttcaaaactcttcatctcctacctgactttgtattttcctgatggtacttatcatacaacttaacatagtatattttaaataataaacagataatgaaaataatcccatgtgtccagatattttttttctaggaagattgaaaatcaaattttatgtgaagttttccaatttttaatgctgccagatattttgatttttctagagagcttggacatctgaatattcatgtaaaatcttgtaatttttcaatgtcggttaccagttcatagaaaatttaaatactatttgcaccaaagaaaatatgtttgtgatccagatagagtccaaggttcaccctattgtgatctgtgtcatagatctgtagaacactggcgctgtgagaagccttgtaaattggcagcttctaatgaggaagtacagactcagaaagattaggtatcttctgcattatcacacagctggcttgtagcagaactggatctcgaacccagctttcctgcctcctagttgctctgtcatagtcaccatgctggctgcctcccttctgctgagggttgagttaatctgctctgtgtagaggacagctttcagtcttcagtcccctcctcctaaagaatataacagacgcatcaccacccatctgataatccccaggcacttctcaccagagtgtatgaatttacctgccttcccaatctcaactgaggatattgcctcttggcgctctttattgcttttgctccagtgatagaatcaagacaaagtctttataggaatgttattatcattgctcccagacagcggtgtcttccggcagagtcatagagtcggtgtggtctaatgcaaagaatctggggctcaaagtccagacagctgggctcaattctcagatatgtgacctgagacaacttatttagcctctccggcactcaatttccttaactgtaaaaatgagaaaaataagatctgtctctcttgtgtctcagagctgctgtgaggctaaagtgagatgatatgtataagagcaccttggaaacagataaacattttacaacgatgagggtatagtatcattaaatcagcaaaataatgattaagcacctactatgtgacagtgaacataccatttatgcagggcatgccaagaagcataggcctatctgcctccatgagcttatagtctacctgagaagaagggacatagctgagtgggaagagagccagcactgcaaagctagagaccagggctgaaggaaatgtattgaccgtagaatgagagaaagaaattgtggtagaaaggggtgaccatggaaggattcctggagggagttgcatttaaactaagctttggaataaaaattcacaggctagggctggcaggagttaaaaaaaaaaaaaggatattcttttactggtcaggggcaacagcacaaataagggctgaaatcacaacgtatgctggaggtctaatctacatggacagaagggttcaagtagtggctctcagattattgcttatccagctttttcactggcctaaaacacaaaagagaaagtcaagggatgcttgctatgaagtcaaggtggggccaggcacggtggttcatgcctgtaatcccagcaatttgggaggctcagggaggcatattgcttgagcccaggagttcgagaccagccattggcaacatagcaaaacctcatctctaaaaaatacacaaaaattagctgggtgtggtggtgcaggcctgtagtcccaggtactcaggaggctgatctgggaggatcgcttgaaccctggaggcagaggttacagtgagccactgagattgcaccactgcactccagcctggatggcagagccagaccctgtctcaaaaaaaaaaagaaaagaaaaagaaaacaaaccaaggcagaggttaagtgtgggcacaggtttggttaattacatcacaggagggcctaatactataaaatgatcataatgattatttctgcctcatagggcttttctcagctttaaattacatgatgtgtgttaaacatttagcatagcacctgatacatgattagtactcaataaatgttagctatcatcatcatcaccagttttcatcttatactgaagttaggggacaataacatgggctttggaatctgtctaatattagttgtgtagccttggtcgagtcacatcacttcctcgtttctcggtttcctggtctttaaaatgggaatgacagtagtgccaactgaaaagggctattgtgaggattaaatgagttaatccaagtaaagtacttatcaccatgcctggtacatgataagcattcaatagatgttagctgctacagttattatggccagttgaccattaaggtaatatgacagcataactaaaacatgagaaaattgagaaaaataggcaatcatgccaaatcttactactaagacacatcttgttattatttttggatttggttcttaaatttaaaatttcttttgttgagaaaatcaagactgcaggagatggcatggatttgggatgcagcaggcatttcgttaaacacttaataagtaactactgtgtgctagccagtgttccagaagctgagatatgacaagaaaaaaaaacacacaggacaggcattattcctgtatttaaggaatttatagcccaatagaggtagtatggaaaacaaaataataaatataaaatattgtgttatgtgatattaagtactatggaaaatatcttcagatggggtgataaggagttgtaaaatggtcaggagtggtgagggagggttggagagtgaaccctgcagagcctataattttagagggtggtcagggtaggcctcaccaagaaggtaatcttttgaatccagccctaaaggaggtgagggagtaggtcatgtaggtatctcagggaagagcattgggagcagagagaacaggaagagcaaggtctttgaatcaggaggatatctggcatttatgaaactgccaagaagcccatgttgcagcaatggagtgaatgaagggaagagtattgggatgggaggtcagagaggtcacagagacaagtttgttaagggcattgactgccatttccagggagtgagatggaaagccacggaggagcttgttcagtgaaggacatgacccaacttatatgagctatttggcactcctataagcagtgggttttgaccccatagatcctgggcaataataaacaagaggcagcaactccaccattccctcagaactctccttaccactctgtagactgcagagagtggacttattgatcctgagggcgacacagagaggaattgatggcacggagaataggggaaaaagatgtaatctcttagagctgaaagggactcagtgcaattctgccaccgggcatctgttcattccgcctcgactaaaaccgtcactgccttatcagcttgctcagcctcttcttgcaggaccttctcaaggtcggaaagccttttgatgggtttactgaaaatctgcctccttttcaccaccgggtggcagtagtcctggttctatcacctgagcaacccagaataagtgcataccttccgcaggaaaatacttgagatttgaaggcaggtggatatcttatatatcccccaacgtttctcctttacaggccctattgtctcttctaccttcaagagtaactcctattatagaatggttttcttttgtcaatcttgcaaccctcttctggaggttttccactttcttagtgactctcttaaaatgtgatgtctaaaattgaacaggagacggcaggagtgaacagaggaggttacagtgcaatgattatattctaggatctagaaactgtactttgattatgcaatctaaaattgtgctctgtttttagcgactaaataatttaggtacattaaactgttggctcgaattgtgcttgtgggtcaattcaagccccttgatcttttttagtttgtttatttgtttgatgtgagttgctgtgaagccacacttcccctattttggcctcacaaaatggacttttaaaatttgaattgatgattttttttctttatctcatttatatttcaccatttaaattttagcccagtattccaacccgtctgagcttattttgaatctcaattttgttcttcaacatattccgacatccctgccaggtttgagtcatcttaaaacacagtaagtacattttctgtatcacctaagttattaataaaaatgaaaaagtcttgtggcccttctctggagaacttctgctggattgccaatccatttgactgtattataacttgatcaatatgttactatcttgctttagttcattcatgagaaaattctgagacaaattcaaatgcatggctaaatccaagatatgttgtcaatgcaaaagatagcatggatgaaggtgatctaagataggatgtttttgttttgcaaaatggaaattctagtattgttttttccaattataaggtgatattggcttgttgtaaaggtcaacagcatacataagtatacaaaatacaaagggaaatttcctctgtaattctgtgcaccgacactgtactagataactatggttgacagttttatgcatatataaacacagatctatggttttactgggatcatgatatagagactgttacatgacctgctcttttcacttacaatcctttggaaacgtctgtccttctcagaaagtacagttttagctccttcttttaaacaatgatatagtgttcttttctttggatgtttcataatttatctcatcaatctcatattgatgggcatttagatcattggcaatttttgccgttacaagcagtattacatgttgaattgtctttgctgactcgatgagatgttgtgctagatgctggttgttgccttctctgtatttcccatcctcttgtccttctcagatattgttgtcaatgtcctaaatgccaaagggctgcttccgcctaagaactaatgagggggccaaattactactcatcatggtttgagtttgaaaatctatacttgccctactttcgagtgtgtttaaggctttttgagctgccaggggcttttagaggatcaaggcaccccaagatcaagccttgagggacagacagtcttgataggaggctgcaacccctgtttggcacatgtgaagtggttaggggcagaaaggagaaggagaactgccttgccattgggccacaattccttgttatacaccctcagccctgaccaagcaggacacttgctggtccctgaataagctcctcctttttcatgttcacacctttattcctccacagggtcttcctcctttcacacgtgtacctcccagaacaaggtaggagccatctgctctgaattcccagaatgctttaaaaccatgggcttgggagttgaaccaatgtttgaatatcagagcttggcagttgaacctagctctgtgatttttggataagtcttttatcctttctgggcctagttatcctcatctatggagtgatgatatgcctatatattttgaaacacctagcccagtgcctggcttaacaaacgtttgctgttattattatcataattaccatatgtgattatattacctactccactgttgtgaaaattaaatgagaacatatgtaaagcacacaacacagtgctcagcctaaaatgggtattaaataaattatggcaattactgattgtattcatatcttcctttggatacttatcttactctcttgtgttactcctatttgtgtttacgtcttgatctcctcctttaattaataagttccttcaaaagcacagtgtttgtcctcttccctcctcctacccctctcccctagaaagcataaaaaaaccagtgttggggttagtagggctctttaaaatttaggtgccgtcagcgaatgccaccatcactttgtctaagcccctttctgattggattttctagttagaaagcactgtctcattaacagatcaactgggccccctttctagggcaagtcatggcatacatattccaacccctgagccactgatcagaattagcaagctatagaatcttagctttggaaagattttcagaaaccaatggctttgtgtatgagtttacctgggcagaatggattcatgtaccactctcaggcctttgctatctagatggaaaggaacaacattaggccattagcccagtccagaccactgttgagtccctcttagactaccaaaacagtctcctaggctttttcctgctttcgctcatgcctctacacagcagcaagagcaatctttagaaaataaaaaatcagatcacatgatttccctcctcaaaaccctcccatggctcccattgcatgtagtataaattcatatttccttcccatggcctagaagaccctgaataatctggctcctgtgcatctctccacattcatcctgttacactcttccccttgccccctgtgcaccacctgcgctgatctactgttctgaggatacaccaagctcatccctgcttcagtgcttttaatcttgttttgaccctctaccaacaattgaatgccagccttgccccaacttccccatgtttcttttcgtccttcaggtttccatttcaattatactttctcagaagaacatgaaaagccttccctgtgcaccctgtctcaagtaggttcttgtccccacgttattctcaaactcattggttctcaggcttgcttcaaattgagaatcactcagagagcattaaaaaacaaaacaatggccaggcctcttctagatgaagtaaatcagaatttctgagaatggaactcagctatctgtatttctaaatgctcctcaagtggttttaatgtgtagccaaggtggacagcctttgttttatctgtcaacttgtttatttcattcttggtgcttatcacaaactataattattttgcttattttagcaacttatttagtaaatatttattatgcccctacatgtgccaggcactactcaaaacatggaaattaaactagtggacatactaaacacaaatcccaaccattatcaaacttcaattctagtggaggaggcagacaataaacaagatcaataaaatatatagtgaaatttttatagtgttctagactaaatggttgtgtcttccccaccaaattattgtgttgacatcttaacacccaatatgatagtatctgaagatgtggcttttgggatgcagttagggttagatgaggtcatgagggtggggctttgatctaatgggattagtgccttgataagaagagacaccaaagagcctgctctctctctctctctctatctctctctttcccccaccaccccaccacccaacatgcacaaagaagtcatataagcatacaatgagatggtggctgtctacaagccaagaaaagaggcctcagaatgaaacttacctttctggcaccttgatcttggacttccagcctccagaactgtcagggataaatgtctgttgttcaagccacccagtctgtagtattttgttatggcagtccaagcacattaagacatatagtatgttagagaatgatgagtgctagggagaaaagtaaactagataatggagatataaattttttggaggagagaaacactttagacagagtgacctcgatagataaatcttgagtaaagacctgaaagaagtgacagatatagatctgcagctatttggatgacgaacttttaaggcaaagaagagtctgtgcaaaggtcctaagactgtatcatacctagtatgtttgaagaacagcaagggggccggtatggctggaggtttgaagacaaggggaagagtggtaggtgataaattcaggaatttaatggggttgggggggcaggtgtttggaactttgaaggttattgtaagagctttggcttttactgagtaagaaggggtatcatagagcagagggtaatatcatctgacttagattttagtaggcttactatatatggtatgttgagaatacactgaagagggaaaagagtggaagcagaagaaccagttggagactactgtaataatccatgtgagacatgatgggggctcgaagaaggatgatagaaatggcaatgatatgagaaccaataagaaatggacacaaactgtatgtgttttgagagatagagtatttaggatttgctgacagacctataaataggacatgagataaagtacccagtcaaggatgatgccatggtttttagcctaggcatctataataatggagttgctatttacctgagatgggaagaactgtgggagaagtaggttttaggggaaatatcaaggaattagttttcaacttgttaagtttgatgtgcagctgtggtctgaaaatttgtgttctccccaaaatttctatgttgaaatgctaacccccaaagtgatagtattaggaggtgagagctttgggaggtgattaggtcatcacggaggagcctctacgaatggaagggattagtacccttataaaagagacctgagagtgaccattcactccttccactacgtgaggacacagcaagaagatgccgtctatgagaaagcgggccctcaccagacaccaccagcaccttgatcttggacgttctagcctctgaaactgtaagaaatacatttctattgtgcatgtgctatccagtttatggtatttcattatagtatcccaaatggaccaagacagatgcccattagacatccaagctggagatgtcaaatagagaattgaatatacaaaccttgaattcataggagaggtctggactcgggtcagaactttgggagtcataagactgaatgatcacttagagaataagttcaggtagaaaagagaagtccaaggactgatccctaaaccactccaatgtctaaaggttgggttgaagtgcaacaagcaaaggagactggaaagaagcagccagagaagaaagaagaaaaccaatagaatgtggttcctggaagccaagagaaggtgattcaaggaagagagagtggtcacttatgtcaagcactgcagatagctcaagtaagatgagaactgagaattggctgttgaattttgtaacataaaggtcactggtgatcttgatcagagcagtgataaaagtgagttcaagagagaagggaaggagacaatttggagattataagtataaacaaatgcttcaaggttttagtaaaatgaggaggacagcaatggggcagtagcagtatctagaagaggaattagggtcaaaagagggtttattaacttttttaggtaggagaaaaaatattcaaatgaaaagatccacctcctgcattagaatgtaagcttattgagggcaaggactttgtcttgtgcatattcagcaccttctatggtccctagcacatagcaggcactcaataaattttgttgaatggtgaatgatcaaatgaatgaagaaatgaataaataaacaaaagtagatgtcaatgagttgagcaagaaatactagcaggatagagtggcaggtgaattgagtagcaccttggctttagttctagtcattcctgccacactcctggcataccaaacttatcccaggcccagacggcttgtgaatgagttggcatggcacaactccctttgctaagagggcatgttatatctctgtagtcacttgttccagggagcagacaggctgttggactgtaagaatcaggtgcagccaggtgagactgtagagtccaggagtgtgccaaaagagatgcccctttgcatcatcaccattctctggtcctgatctgtctgtgatgcaggacatgggtgagacacatgctgcactggcatcccagcctgctcttacttgctggagggtagttaataacctcatgtaacacaggccaaggagcagctaaaccaaagtttaagaagaagaaacacatgcccatgcagtgaccagaagctttggcacccggctcatctcagttgctgcattgcacaatccccacaatttaaggtgatgggttggcccagtggggctcttgcatggtgcctatgactcagtttttgctagaaagatggcatggccccactccaggctggcacataggaggtgctcggcaagttttgaataaataaaccccttgggactgaggaaagaatgcttctttcgctttgcggagttcttcagtgctcagccagagccagattgtgaatctaggcagtctggcttcagggcctgtagactcagccacttaatttatacatgcaaggtattgggttttattgggggagtggtggtggtggtagtggtattattttttataaaagtaaaaaaaaaaaaaaaaagccaggtgcagtggctcatgtctgtaatcccagcactttgggaggccaaggcaggtggatcacttgaggtcaggagtttgagaacagcctggccaacatggtgaaaccctgtctccactaaaaatccaaaaattagccaggcatgttggcaggcgcctgtaatcccagctacttgggaggcacgagaatcgcttgaaccaagggggcgaaggttgcagtgagctaagatcgcgccactacattccaacttgggtgacagagtgagactctgtctcaaaaataaatatataaaagtttttttaaaaatcttgctatcacattatccaaatattatatccatattccctctcactggggcacatactacttgggttcctttgcctattattgttttgctttttggtagagaactcctaccatacccaaccatattaccttccccttcttcaaaagagattcccaggaatcctaatatcccacagaacataatctttccatttccagaaaggaatatggatgcctgttggttttgtccctttgtgtcttcacaagtactgagtgcctaccatgtgtcaggtcctgttttagtcaactggggatatagcagtgaccaaaacaattttaaaaaatcccaccctccacaacatcacttccatagcattcttgccaaaaaatgcactaccttaatctaactgtaagaaaaaagcagacaacacctgattgagggaaactctacaaaatagttggcctggacttgtcaaattgtcatgagagacaaaggttgaggaagcatcacagattagaggaggctaatgaggcatggcaactaaatacaatatgagatcctggattggatcctagaacaggaataggacattagtagagaaactgggaaaatgtgaataaggtctgtagatgagttaatcttattgtatcaatgttaatttcctggtttcaataatcttagtattattatgttaaggtgttaagattacaggaagctgggtgaagggtatatatggtaactctctgtgctatgtttgcaattttcctgtaaagtctaaaattatttcaaaataaaaaattaaaactagccctgccctcctggggcttaagtgctggaattgacagccagagagagaagaagggagggagagagagaaacaataagtaaaacaatcaggatattatttagtatattagcaggcaatggatgttatggagacaaagtaggaaagggaaatgaggagtagaggggctgtattcaagtaggatggtcgtggaaggcctcactgagatgacatttgaacaaagcctttaaagaagagggtgcaagagccacaaggtagagcacaccagtacgagggaaatgcaaaggtgctgagggcatggaatgcctgcccagtttaaagaaccacaggaagcctagtgtggctaaagcccaatgagcaaaatcagtttgccgcattctgtggttttaaaggtatcggaaagagactgaccacagaggaaagattagggaagtcaaacaaaggacatcaaatggaaggcctgctgttgtcctctgtttccaaccaagtcacagatgacagaaacatgaagggaaggaaagagcagggaagtaaaatcgctgaagtctagaatcactgtccaatttctggtgagtaaatagatccttattaagcaccataacaagtttctgagtctcctgtgttttattcctctccaagcactgaactataattaatgctgagtgtggcactggtatcacacagcctgtgacatcttcctgattttgtgctgtgtaaaatcatgagaagtgtaattggtagcacaaacgggtgggctgatttttcttggactaatgagtggaaatgatgaaaaatccagaacatttttttgatttggcttatgtttattatcaaaaattctcgacttattcaggtagcatcacttggatgtttgaggcctggtaatgcatgcactaaacagtatgcagtcaatgatgttgcttggcaagcagccccctggcctgatgtatacttacaaaagacaggccaggtaccagcggggtttcctaagggttcctcagctggtagctttgactgaggatgcttcctcttcaccaactatgcagaagcagatatccacatgggaggagccagcctaattcatgggaggcttggtgacagcaatgttgttttaggaacatctttgaccagtccacacaagagtgcttaaaaaaaaaaaaagattgtatgagaggatttagtgcttagtattctgaaaagtgtaaaatactgcataaggtattactataataataattattattatgtactatgatgaggtttaaagaaattaaaaggtctatagctataatgttttctagttccttacttgtttagtgttatgaaggatgccattaccctctttttagaaaggacagctaccattttgagcacttactatgtgccaggcactataataaatgccttgcatgtattgtttcatttagccctcacaataacaccatgaagtaggtactgttgatatccccattttaaaattgaggtaagtgaggctaagagatgttaaataacttacccaaggttgcacagtaagtggttagaaccaaaattatatgcaggagattggctctagaattctgtgtccttacgtctgtgctacagtaccatttaaaataagggatgcaggacacacatgctctgaaaaggcagatttaggtctccaagagggaaggcatcagctctgcttttggggctccatacacaaggataactgttaagaaggcccgaagcatgtggggcagctggagctcagactgatgtacttggatgtctgaagaggtgctaaggggctatctggcatcccaacttgaaagactgagctaggatgaagagcaatggacaaactctgaattctagaactacccagaatagccgtcacccacttcaccccatccttatgtctgtgaggaaactagagaggcagagcactgctgacacgtgcccaaggtcacacggttctctagagccagcagctgcagtagaactctggtcttcaggctcccagttcagtgctcatcctccaaccccacccccattagcccctcgcattcagtgggcagcagtcagaaagaaggcatctccttttgagtgaagctactgtctggagcagtggttctcagtgtagcccagggacctgcaacatcaacatcacctgggaacctgttagaaatgccaattcttgggtctttccctggaccaactggggctggggccctacaatgtgtgctgtaacaagccctcttgatgattctaatgtatgctgaagtttgaaacccactggtctagactgacaagcaaagcactgagtgctgcagatatcaatatgcatgtggagcatcaacttgcacagcacaaaggatagtcttcatagggaaggaatgtggaaaggactgcagccctcgagccacacctgcagcacagtgtcaccttcaaacacacatgatagtcacagatagatacacagagactgggagggagggtgtagccagtttttgttgatcttcagctgcatcaaagataatgtagttttgccagctcagcagttcgctagagacatgccagctactcggcttggtgctgtggaaggtgaagtccctgcacctcggggaaactgccacccaggattatagaacttccaaattgggagggagcttagagattatctactccattatccacctctaccactccttggtaatggcatccctgactggcactttctcagcttcagcattacagggccatagtgagagtgagctcagtttcttttaggacagcttggaggtgggagggagaagggaacttacacacaggtaactaccattacaaaaagtagtataagtgttagagccaatgctgtaagaacacagagccaggaggaatacattttagctgtgggagatcagggatgacttcatggaggagatgtcctttgagctgggcaagatttcagcaagcagacacagtggagtaggaggggttatttccaaagaagacaatatcatgaaaaacacttgaaggaatgaaaatccagaacaaatttcacaaaactatttaggcaggctaggttgagaggacacattctgcaacgagactgcttagcttaaaatactgactctgcaacttactggccacttgactttgggcaaattattgaacatctcttggcctctgttttcctacctgtaaaatgaaaataatacaacatacctgtgctatatcatattgggttgggagaaagagtaaatgagataatgctatgaactagctaacacagtgtctggcatatagcaagtgctccaggacagtttggcaagctttcttcatatataacaggaaatttgtttggagcactggcaatagaactgagagtagtggaggtaatctttgatactaggttgtggagagagcttagagtgccaaactaagaatttggggcttttattctgaaggcaggggatatgcgtagtaggaggatgaatgggaacagcggcaagggatagagagagttaagaagccactcgatcttacttaaggcagtgacaagttacctgaaaggaacaggacgagaatcaggttcagaggagagatatttgtgtgagtgtatgtctgaactatactgtcacatataaacctgactttgggttaacagcctgaaatgtacacatgtgtctattaaataattggagaataaaaattaatggttggagagaatattcgtcatttgttctattgtgaaagacaatcctttgttagctcgagtgaagctatgtgaaatattatatcctatgaaaacacttcctaaagttggcctttttgtaagaaaatttgggatatgtgcaattcacacatacttgatcaatttaagcacattctgttttactggcaggcaccaaaatctgtaataagacaaggagtcctccagtgaaagagatgattagagattgcaatagcagtgcacactgagctccaattaaggaatttcctaatggttgtctaggaatacaagtgccctccatttgggctttggtgataactagagtattctttagttgttaatcagagtgaacacaattcaaaatgttctcgactcgtgggtcagagggaatgatctcatttggcacattattgagtttctgagaagaggaaagatactaacagctcacaaatattttgttattgactaactgcaaagatgcatctgttaaagcaatccatctgagttggctagttctctcgaatattaaagaatatcaatatatactaaaagcaagtcaatttgtcaagcatttacaaagcaactttgaagccaaatgataccttttctgccttcccttctcttctagaagatactcacaaacacatacaaatctggactaaattccctctaacagaccctttgtaaagaaagctcactttctttggctgcagtgacacagatgtttgggtgggagggggtgcggagggtggcggaagcatgctggttcaatgcttgagaaacagtgctgcacccaacagactgaatgtcatgaattctttgtcagctccccctcagaccctccaggctttccctttgtctgctaagggatggaaacagaacagatacattgaagccggtagactgaccagctagattgacccaaattcattcaggaaatgcaaaagcctgctggctcctgggattagctggctggtgtttgaatcgctacccatctgtacatttccttctagtccagtgcagccccagcttgctacatctgctcacctcagcagcttgctttccaagacaagataatttgagaagagtctagttgtgagaaagcaatgtccaatgctagggaaactttgtggcaagcccgaagagaaatttggcccttatggtaagtgatttgctatatccccggtgttcttttcccaccatctgcccttgctcttctctaattctaggtaatgcagccaacttgtcaggcttagctttgtcgagaggatataccattttcaaggcttcattttttcataaggactgtgctaagcagctgtaagaaaaaataggatgaaaaaatgaatgttttgtttacattagtgaggtggcatcaaaaagcaatgaggaaaggcccagtacatctcatagacagttaattatgtcagaactcagactaaaggagacatggaggtctagacaaattatacccagggtttaccctgctgacaagagttcctatcccagcaatagacaggggtcacagaaaaagcctatagcacagtatttctcagccctgcacattagaatctcttggaaaactttaaaaaatatatatgcagagtcccctccctcagagattatgtcttaattgctatggagttagggccacagcattggtactttttaaaagctccccagatggaaaacaaaattgccacaaaggacatcattgagacaattagccacatttgaatatggactatatattaggtaatataattgtgtcagtgttaaaattactgaacttggtaaccatggtgctgtgattacgtaagaggatgtcctccttcttaggaaatatgcactaaagtatctagcggtgaaaggcatgatgtctgcaacaaactcaaatggattagggagaaaaacacctagaaatgtaaaggaggaataaagcaaatatggcaaaatgctaacaatttggctcatctgggtgaggggtatacagggtttttttggtactattcttagaactcttctgttggtttaaaattattttgaaatacaaaattctttttaaaaaataaaaaataaaacagatcccctgatgaaataaagcccaaccaaatttggaaaccattgggttcagtcaaatagagggaatggggacctgctatagataggtgagactgaaagcctttctgagacattatcctacatcagtgtttcttccactttaatgctcatacacatctcctggagatctggttaaaattcagtttctgattcggaaagtctgtagtgggacctgagaatctgcatttccctttctttctttctttctttctttctttctttctttctttttttttttttttgataagttttccctctgttgcctctgctggagtgtagtggtgtgatcatggctcaccgaagcgtcaactttccaggctcaagtgatcttcccgccttggcctcccaaacaaaatgttgagtttacaggcatgagttaccatgcccccctgagattctgcatttctaatagactccctggtgatgccaatgaggttattccatgggccaccctcagagtagcaattcttggactgaattaccccaccataaatttgtcagtcagtaaacaagtattttggaactgcaagaaaaattctctaagtggagtgggcctgcagagttctatggattggcagccccatcatcttgaccccttgaccatggcaactccccgtgagggattcagaaagtctgcagtggggcccaacctgccctgtgggagtcactctgatccacagaacagaacagagcacctagcagaataagcataaacaaaggcttgcagcaaatggaagaaggtatgaatggtctcttcaaaagcaagtttatgatacaagtcccaggagaagtgcagccctttccagtgggtggcagtggagccaagctgaggctcttatagagagcaacatagttctgatgaagtgtcagggtacaggctgcgtgggtccagctgcctcctccaggtgaggacccctttcttagaaataaaattccaaggaggattcccatttcatgctggctgtggcatgctttgagtttgttgcttccactgtaagtggagaaccaaaatgtctctcacttggaggaccctgcttccatcagaacttcccaaaccttgctctaccatttccccctcaaggtagctcctttcccctctgcctgtgtgttgtgattgtgctttccatgcattgaattagaggctatcctgttatttatatcttccttgtttacatccaaatcgaggccaactagtgtgaatgcacagaaggcaactgagctttactgagcatgcaaccccagagaaaagctctagaagacaaatgagaaaggccctggagttggtcagccctgagtttgtatcctcgctttaccacttaataagtgtgtgaactcgggcaagttacttaacatctctgagctttgggttcctcatctataaaatagggtcaataattgtactgacttcatagagttgtgagtattaaatcaaatagcgagtacagcaagtgctcaagaaatggaagatagtcatggacttgatgggcatttattaagtttcttctatgtgtagacaaagagtagttcaaatccagtctagtcctacttgctagttgtgcaatcttggatgagttgctttgttttacctctctgagcctcagttccgttactcttaagtgacactggtgctggtatataaatcacagaattgctgtaaggaataagtgaagtcagacatgttaaacacatgtcaggcacatataaatgtgctcagccaacatgaaatatcataattgttgtggttatcatgtcagctcttctctgagcacctttgtattatgagatttacttagcagccaagcacactttgcagcctcctccagtagaccctctccaatcttcactgtcatttccctgagggcggaggccctatcctttataccatttctggtgtctccatgacacctggcagtgagtaggtgttcagtgcatgaagcagagagcactatgctgcaagcacagccatcagaagcatcactgcctgggttcaagttttagcatgtccactttacttgctgggtgactttctagcaactcctggatcttctctgagtctccattctctcacatgtagtaagggtgtgataataattcctacctctggggattgctgcaaggattaaagctgggtacatagtgagagcttaataagggttgagtgttttaattgctgttattatttgagaaaagtcttacagtcaaggatcacaggagctactctgagaaatcatgcacacacatgcatagatacacacgagtgggcagcactgagaggacaggttacaggaaagacacaaataggcatttattgcccatgaaaggctctttgaaccccaagccagagccagtgtctgcctaaaattttctctgtaaccatggtactgagagcccctgagggtttttttttaatattgaagtaaaattcatataacagaaaatttatcattttaacatgaagaattcagtgacatttggtacattcacagtgttacagaaccacagctcttctgaattgattacccctttaagctggctgtatccagaggaaggcagggctcattgccttctgtaacccttcttgtcactattccatacctcttcacatccccactttgtttctccttcctcattttttcaattgtactctctctctccactctcctgctctttgggggcaaagggatatgtgtctctgatatacatgtacttttaggaagagtgaggatatttacccactggaaagattccaggtctaaaagatggcactggaagagtgcagaatgggactggtgaagccacttcttgccaggacaggcttggcacacctgaaagcaggcacagcacaatgtcagctgcccattgaccttagtcttcgtggccccagggtcaacagacaacctgaaaaggcttattatcaattatgacgtctgagaatcacagtcctgtttgttatcatgtcttctatctttggcctccccgttattatgagtaaatttgcttcatattaaagcatctattgcagaataaccttcataggctccacaacctcacagaatctgctttatatttgtacctatcggcaagagccacatcttaaatatattaaacaataagaataatactgcatatgtactgaattattcctgcatgccaagcactgcgctaaatgtgtttcatgagttatctcataaatgaatccttacaatgactctaggggccaggcattgttaatatctacttttaatagatcaggaaactaaggcacagagccaatggctgatttgtccaagagcaagtgacaaaacccatgctttacacggctgagtaatattgtggccccataatcccaccatggataattaacagaaaaaaaaatattcatttgcaaccacagacagtagcttccttcatccactgctagactttagtcttggttcatgaacttcctagtttttgacgttaggctgttcacctaacccatctgaaactgtttcttcctctatataattgtggaaattgtcctgccttacctcgctcagatttatgagtataaaatataaaaacatgcagggaatgtttttgcaaaatgtaaagtgctatgccaatgtcaggaactgacatcatgaataatggcttcttgggattatgtgagaaccacccagtttcatgctggggaattagagctccctaggagctctgtgataaccccgggaagctgcaagttcttctagccaaatcaaatccttgacaagccacgcccatttctactcttcatggttgtgtgaactcttaagtgctagctgatatggtttggatctgtattcccttcaaatctcatgtagaaatgtaattctcagtgttggaggtggggtcttatgggaggtgattggatcactggggcagattcctcatgaatggctaagtgccatccccttggtgatgagtgagttctcattctgagttcacataagatctggttgtttaaaagtgtgcagcacctttcccctgactctcttgctccctctctcaccatgtgatatgctggttcccccttcaccttctaccatgattgtaagtttcctgaagccctcaccagaatccaagcagatgttggtgccatgcttgtacagcctgcggaactgtgagacaattaaacctcttttctttataaatgaccaagccttaggcatttctttacagcaatacaaaaatggtctagcgcactagccaacttctctgaactcctaatctgtgtctttaaaatgtacttggaacagcactggaaaaatcctccacttttgatatatccggggctgaataaacccagtgaaagccttataagatgtcttctgcctgttctagttttgaaaaatcacagcctacctatcacagaggttgagatgcagattaacttgaggtgataaatttgaaagtgctttgcacagtgcttgcctcatagtgggtgctcaaaagatggtgcctcttttgtgattcagattgttattcttggggctgggggtggttaggtaggatgccaaagaagagagaggctgcagcaaggggaaggcagtttgggcagttgggactcctagaccacacggcttgccaatttcctgattcctcgaaatgaaggcatgattttgaaacacagctgcctcttactcacacaaaagcagtttatgcacaaggctgtgtctgacttcccatgtaggttatttgtgtttcccagaaatgttgggaaggtgtaggaagatgaagcctaattaagggtcttcctgttccaccacacttcatctccctggcatgcaagtggtttagcagcaaagcaggcagacaaaaagtctctcagcaagaaataacttttattatccctcaatgtagacatgcaggacagtggaccagaaaggctaggaagcagtggagggtagcagtcttttaaatactacatatcattcttttaaagaattattaagtgttttcagaaattgtaaattttccacgtattcattgccctcagtgaaacaatgcacaggaatgttctcctccgttcttctgcttctgcagtgtaagcagtattaacagcctgggttcaaatcctcccacaaccttctttgtgcacatgcaaccttctttgtattcaggcatgtaagacatccataggggattttgctgtttgtactagaatgggattgtgagatatatgtttctctacagcttggcttttgcacttaacagtgcatcacagacctcctagcacatcagtagttatagatctggtacattctttcaaaccactacatgatacttcataatatgaacaatatgaatatgccaggatttattaaactgtacatctatcgataagcacttgggttgtttagaacattgtagtcattctcagagactttttgtctgcctgctttgctgctaaaccacttgcatatcagggagatgaagtgtggtggaacaggaagacccttaactaattataatatggtaaacatatttaccagtgttggtaaatatggtgggaaagattgctgggtcaaagggttttaatttacttatggaaaaattgcttggctgatattcataaattgcattctgattccctcatcctattatcaaaaagtttattgttgatcagttaagcagatttcatttgccttcccaataatcaacgtatgacccatagtaaaggacggttgtaaagagtgggcatccaaggatatgatcttctcttcattgggatcccagaaatggtgggttgtaatttatctaactggactaatttctccagatgccttctttcactgacacaatccaattattctcctgccttttctagccacgatcaccttaggctcaaccttgagaaacaaaaagaaaacaaattttgttggcagcagacatgttttggttctccctcagataaagtttcctttgcaggacaataaaaggggaattggaaaggctggaaaagtaaggtgagcacaagttaacagaagatgaggaacatcaatctgctttactaaaggaattacttttgcaaaagtattgctgaatagtgcttttaagtatcaaggacatggtgggtacatgggggttcactgtaaaattatttcacatttgttttacaaactcttaaggtgttatttttttatttgcatttttttgagacagggtctttcactctgtcacccaggcgggagtgtggtggtacaataatggctcactgcagccttcactttcctggctcaagcaatttttcctacctcagcctactgagtagctgaaatcacagccatgtgtcacagcacccggcttattttttaattttttaaaaagatgtggtctcgctatgtttcccaggttgggccgaagcaagcctcccacctcagcttcccaaagtcttgggattacaggcgtgagccactgtgcctggccctgttaagatgttcatatgtggtttgatttataaaaattctgctcacatgccactttccaggcataaaatatctgtatcaagatactttgctgtgtgtgatactttatgctttttaaagcaatttcatttcacaatccaattctaccctcacagcatcatagtatgacaggaatcactcttctcatttgacaacagagataattaggcctggagaggtaaatgacttgtcaaaagtcacatacataattagcagcagagctaagccttaaattagggattccccatccagcatttgtctcacttggggaagatgggtagaacatgagaccctaattccatctctcattaggtctctgcttgagtcttatttggcctaactcaatttctgttttacttcaggcatgtagatccatgcttctttccatggctaatataacactgattgagcaccagtaatgcactaggtgctctagagactattgaattaaatctggttgctgccctgtagctcctattctgaatttgttggagcccaatctaaaatagttattgctctgcacagatagtacaggcgtataagaacatttctccaatctaagcttgtatctcaccatttttctttaggacccccaacagaatttcttcttatcaggcaggaatatcccacaactggtctctgagtagtcttaaaaaacagccctttattttgcctgactcactcttgaagatgaatgcatcagcttgttttctcttccagaataacatacagaggacagctttctcttctgaggagtcagaagttcagttcgcccaacatggaatgacttgaggtacacttgaatggtctctgtgtccctaaatatcttcctcatcagcagaaatgtcctctttgaagatgtgattccttgactacttcctgcctcttcatgttgtgtcagttacgtgatccattaaccaggctgtatgtatatcctttgaaatgtttcaaacatctttccctttgctaaccactcccacttgccactggctttgttatcttaaacagcaaagtcccagcagatctccctacttagcatcttttcctccagtctacactatatgctactggcaaaattatatttctaaaacaaagctctgattatattattcccctagtcaaaaaccatagtcggctttccactgcctgttgcagtggtgttcaaagtccatttgttcatttgtctgtttgttctttggtttcaaatcagcagcaccttttttttcaagtaaaaaaaattaggtagttaagatcccaaaatgtaaagcagataaaagtagacatgccttaaaaaatatgtagacacactgtagttgaagtgagaagttgggggtgagaaagtagggaagctctgggccccttgctcctggcagaacccttggtcctcagggaacacagtgtgaagaccactggcctgctcataagtttaaaatgcctttgcttgccattcaagactgcactaacctggccctaaactgcctctcccatgagacttccaattgtccttaaaggaaccctttgcttcagccgttcgttctgctctctgtcttccccacacaactgggacattctttacctttgcactgctaagcccccaagcctgaaatgtccactactgttcttggttcctgtctgacttgcattcaccctttgaaaaccagctctagttctacttactttaagaaatatttgccggcttccttgttccgcagggactcacttactggagctgtaatgactttatcttccaaaagaacaaaagagaagcagcccaggaaataaattcctatcaactctgtttttatgtgctccttctggctagagaagccttatgatgttaccactctctgaagtccctcttctgtaaaattgggacaataatagtagtcatctcagggattatgcaaggattaagttatatcaagctcctagcccagggtttagcactagtaaatagtataacttactagttatactagcaagtgtaactggtaagtagtataactagcaagttatactactaactagtatagtaagtagtatagtaagtagtataactcgcgagttatactactaactagtatagtgactggcttcttttttgtgactggcttctttcatttatcataatgtcctccaggttgatccatgttgtagcatgtgacaggatttcttccttttctatgactgaataatattccactgtatggatatatcatactttggttatccatccatctgttgatggacacttgggttgcttccaccttttgactattgtgaatatgctgctataaacattggtgtacaagtatctctttgagatactgtttttgactcttttgaatatatacccagatgtaaaattgctgtatcatattgtagttattgttttgtttgcttgatgaatctccatccagtttctcatagtggctgcaccattttacatccctaccagcaatgcacaagggttccaatttctcacatccttgcaaacccttgttattctctgttttcttgttgataatggccatcctattgggtgtaaggtgatatctcattgtggttatgatgtgtatttccctaatgattattgatgtagagcatcttctttgtgcttattagtcatttgtatatctctttggagaaatgcccattcaaatccttccaccatttttaaatcaggttatttgttgttgttgttgttgctgttgctgttgatttgtagaagttctttatatattctggatattaatcccttaacagatatgtggtttgcaaatatattctctcattcaatgggttgctctttcactcttgattgtttcctttgccacacagaagtttttaagttcaatgtagtcatatttgtctatttttgctctttagtgttattttaatgtgtctatatcctgtcttctcactgaaactcaaagctttccaaaggtacagtgcatgattcctcttgtgttgtctgttgtgtcatgctctgtgccacgcacatagtaggtgctcacgaatatgtaccaaccaattaattgaatctccatatgcacattaacctattatcagccatgagtgccttagcaaaattatttttttagttaactggaagcttagaggatagcatctatgattgggccaaaggagagacataggttggaggagtgaatagaaaacatggggccttctcaggaagaggagactctatggcagcaggtggggacattgtgcctgacatacggaaaggtccccataaatgttagctggtatcattatttgtgcactagctgtctgagacagggagaggcaatgctgggataactgaatggaaatatgagaaattcaaaagagaaactttttgtcagcttgccttcttaaaagtatgtgtgtgtgtgtgtgtgtgtacatatatatgtgcacacgtgctcaagtgccaagatccaaatttgttttgcgaccaggaagataattcactgtttgcgttatttccaagagtaaccattaatgcaggtagagaggaggaccacaaatgtgattactattcagtagactctttttggatgatgtccatgcattacttatctcacatatactacatcagtgctaaagaagaaaggaaggaaagaaggaaggaaggaagggagagagggagggagggagggaggggagaagaagagaggagaagagaggagaggagaggagaggaggcaaaagaagaaaggaataattaggagttgattaaagcacctgccctaggactcttggagataaataggattttctgacctgttactttattttaaaattaatgttgcctttggggctctcagtgctaaatagtgaaaactcaacaaagatagtagtccctgctttgggctggaaaacatcacaagggaaattagaaaacaccttgagatgaatgaaaatgaaaatacaacatatcaaaatttatggaacacggtgaaagcagtgctaaaagtgatattcatggctataaatgtttacattgagaaagaagttcttaaatcaacaacctaacttcacaccttaaggaattaaaaaataacaagctaaacccaaagctagcagaggaaagagaccaataaagattggaacagagataaataaaaatagtgaatagaaaataaaataaataaaatagaataaaatagagaacagcaatgaatccaagagatgtctctttgaaaagatcaacaaaattgacagagtttatagctagatcgactaagcaaaaaaaagagaagcctcaagtaactaaaatcagaaatgaaagcacagacattaccaaaaatgttaaaggaataaaaagattataagggagtacaatgaagaatggcatgttaacaaatgtggtaacctagataaaatggacaaatttgtagaaacatacagcctaccaatattgaattatgaagaaatagacaatgccaatacacctataactagtaaggtgatgaaatcagtaatcaaaataatttaaaggaagaaaagccaagatccaatgggttcacctctaatttccacaaaacatttaagagtaattaacatcaatttgtttcaaactcttaaaaaattaaagaaaagagaatatttcctaacttactctatgaagccagcattaccctgatatcaagctagaaagagacactgcaagagaactacagaccaatataccttatgaatattgatgcaaatatcctcagcaaaatactagcaaatagaattcaatagcatattaaaagggttatatgccttgagtaagtgggatttattcctcaaatgcattgatgggtcaacattaaaaaaatcaatcaatattatacaccacattaacagcatgaaggggaaaaccacatgaccatctcaagttacacagaaagagcattttacaaaattcaacacctttttgtgatttttaaaaagaactcaataaactaaaaatagaagaaaactacctcaacataataaggccatatatgaaaaacctacagctaacatcatgcttaatggtaaaagactgaaagcttttactcaatgatcagaacaagacaaggatgtcagctttttggcacctctattgaacatagtattagaatgcctagacagacagcaattaggcaagaaaaataaataaaaagaatctaaattgaaaaagaaaaagtaacattatctctctttacagacaatatgatcttctatatggaaaatgctgaagattttattttaaaaactattagaactaataaatcaatttgggaaattgtcaggctgtaaaatcaacatacaataatcagttgtagttctatacaccgacaacaagcaatctgaaaaggaaatgaagaaaacgatttcatttaaaatagtgtcaaaaagaataaaatacttaggaataaacttaaccaaggagacaaataaatgtgtactgaaaagtataaaacattgctgaaagagattaaagacacaaataaatggaaatatggaaatacatctcatgctcttagattgaaagacttaacatatttatgatgtcactacccaaagtgatctacagattcagtgcaatccttatcaaaaccccagtgacttttgttgcagaaataggaaaatccatcctaaaatttatatggaatctcaagggaccccagatgagtgaaacaatcatgaaacagagcaaagttggagaactcacacttcttaatttcaaaacatactacgaagcttacagtaatcaaaatattgtggcactgtcataatgacagacacatataccaatggagtagaagagagcccagaaataaaccctcattagatggtacctttttgtacccttttgacaagggcacaaagtccattcaatagggaaagagcaatctttccaacaaatggtggctgggaaaactggatatccacatgcaaaggaatgatgttgggcctttaccttacaccatatacataaattaacttaaaacagataaaacacctaaccataataactaaaactataaaactcttagaagaaaacataggggaaaatcttcgtgacattggatttggcaatgatttattgtatatgacatcaaaagcataggcaacaaaaaaatggataagttggatgtcattaaaattaaaaacctttatgtatcaaaagacaatatcagagtgaaaaggcatcctacagaatgagagaaagtatttgcaaatcctatatctggtaagggattgatatccagaattgtaaactcaacaacaaccacaaaattcgattataaaattatgcaaaggccaggcaaagtggttcttgcctgtaatcccagcactttgtgaggccaaagcaggaagacggcttgagcccagtagtttgagaccagcctgggcaacatggcaaaacaccatctttacaaaaaaaaaaaaaaaaattagcctggcatgtctcctgtagtcccagctactcaggaaactgaggtggcagaattgattgagcctaggaggttgaggctgcagtgacctgtggttgtgccactgcaatccagcttgggtgacagagtgagaccctgcctccaaaaaaaaaaaaagaaagaaagaaaagaaaaaggggggggggcaaatgatttgaatatacatttctccaaagaagatatacaaatgacctatatacacatgaaaaggtgcttgacatcactagtcattggagaaaggcaaatcaaaacaacaaatgagataccaccttacaccagtaggatggccattttacaaaccacacacacacacaaacacacaaaaaataacaagtgttagccaggatgtggagaaataggaactcatgtgcattgctggtgggaatgtaaaatggtacagctgctatggaaaatggtatgataattcctttaaaaattaaaaatagaattaccatatgatctagcagttctacttctgggtatatacccaaagaaattgaaagcagggacttcagtagatatttacacatccatgttccttgcagcattattcacaatagctaaaagttagaagcatcccaagtgtgcaccaacagatgaataaagaaaatgtatatgttactcatcctttgaaaggatggaaattctgacatattctacaggaatggatgaactttgaagacattatgctacgtgtaataagccagacaccaaaggacaaatattgtatgattccatttgtataaagtacttagagtactcaaatccatacaatcagaaagtagaatggtggtttccaggagctgagaggaggggagaatggggaattgttggttattgggtatacagtttcagttggggaagatgaaacatttctggagagagtgatgatgattgcacaacaatgtgaatgtaggcctgagggaggattaagatggcagataggaggcaggactagcttgcagctcccactcagacagacagagcagtgtatagagactctcatcatgaacttttgctccaagaactaccacaggaacataccagggaagccgagagaatccacagaccctttgaaggaactggatcaccactgcaggttccctgagatgtcaaaaacctgtgtctgtttgctttctcagccagtggggaggcttgtggtctggggtaagttctcagccctgatcattggctgcctagaaatagacttggtgctgttgtgggggtatggtggaagtgagaccggcctttaggactgtgggctctgtgggaaaggggtgaggcctgtgactgccagctttccaccacttccctggtgacctgtgtgacttatcagaggcagtcataatccccctgggtatataactccactggactgggaacaacacccccatcccccacagcagccacagcaaacactgcataaggagaggcggagctcagacatgcttatccctatccccaactagtggtctttctctacctgcccccgggaagacaaatgtcataatctcttgggagctctattgcccttcctacctcctgagaaacctgaatacttaatcaggtgtctttgcatcctccttgtagggccacagttgatgcactcctgaaagggttacctcctggctgggggccaaccaacacaaaaccagcccactacacaaaaacacaaccaaagaccctcacagagtccattttactcccctgctacctccaccagagcagctgctggtatgcaggactgcaagacctgaagacagattacatcacaggactctttgcagaaactccccagtaccagtctggagcccaatagctccactgggtggctagacccagaagagcaaaaacaaatcactacagcttagctctcaggaagcctctttcctagaggaaggggaaaataacacattaagggagcacccatgagacaaaacaatctgaacagcagccattgaaacctagatattccttctgacatgagaaggaaccagaaaaacaattctggtaatacgacaaaacaaggttctttaacaccccccaaagatcataccagctcaccagcaatggatccaaaccaagatgaaatctctgcagtgccagaaaaagaattcagaaggtcaattactaagctaatcaaggaggcactagagaaaggtaaagtccaacttaaagaaatcagaaacatgatataggatatgaacggaaaattcttcagtgaagtagatagcatgaataaaaaaaatcacaaccgcaggaaatcaaggacacacttagagaaatgcaaaatgcactggaaagtctcagtaatagaatcaaacaagcagaagagagaacttcagatctcgaagacaaagctttcaaattaacccaatccatcaaagaaaaagaaaaaagaatttttaaaaatgaacaaagcctccaagaagtttgagactatgttaaacatccaaagctaagaataattggtgctcccgaggaagaagagaaatctaaaagtttggaaaacatatttgagggaacaattgaggaaaacttccccagtcttgctagagatctagacatccaaatacaagaagctcaaagaacacctgggaaattcatcacaaaaagatcaccacctaggcacatagccatcaggttatctaaagtcaagacaaagaaaagaatcttcagagctgtgaggcaaaagcatcgggtaacttacaaaggaaaacctatcagattaacagcagatttctcagcagaaaccctataagctagaagggtttggcgacatatttttagcctccttcaacaaaacaattatcagccaagaattttgtatccagagcaactaagcttcataaatgaaggaaagacacagtcttttccagacaaacaaatgctaagagaattcgccactactaagccagcactaaaagaaatgctgaaacgatctctaaatctttaaacaaatcctcaaaatacaacaaaatagaacctccttaaagcataaatctcacaggacctatgtaacaataataccatgaaaaaaaacaaaaacaagttgttcaggcaacaaataacacaatgaatagaataatatcacacatctcaatactaacattgaaaatagatgacctgaatgctccacttgaaagatacagaatggcagaatagatatgaattcaacaaccaagtttctgctgtcttcaggagactcacctaacacataaggattcacataaacttaaggtaaaggggtagaaaaagatattccatgcaaacggacaccagaagtgagcaggagtagctattctttttatatatatatatatactttaagttctggggtacatgtgcacaatgtgcaggtttgttacataggtatacatgtgctgtgttggtttactgcacccatcaactcagcatttacattaggtatttctcctaatgctatccctcccccaggcccccactcactgacaggccccagtgtgtgatgttcccctctctgtgtccatgtgttctcattgttcaactcccacttatgagtgagaacacacggtgtttggttttctcatcttgtgttacattgctgagaatgttggtttccagtttcatccatgtccctgcaaaggacatgaactcatccttttttatggctgcatagtattccatggtgtatatgtaccacattttctttatccagtctctcattgatgggcatttgagttggttccaagactttgctgttgtgaacagtgctgcaataaacatacatgtgcatgtgtctttatagcagcatgatttataatcctttgggtatatacccagtaatgggattgctgggccaaatgctatttctagttctagatccttgaggaatctccatactgtcttccacagtggttgaactaatttacactcccaccaacagtgtaaaagtgttcctatttctccacatcctctccagcacctgttgtttcctgactttttaatgattgccattctaacaggcatgagatagtatctcattgtggttttgatctgcatttctctaatgaccagtgatgatgagcattttttcataagtttgttagctgcataaatgtcttcttttgagaagggtctgttcatatccttcacccatttttttgatggggttgtttgtttttttcttgtaaatgtgtttaaattctttgtagattctggatattagccctttgtcagatggatagattgtaaaaattttctcccaatctgtaggttgcctgttcactctgattatagtttcttttgctgtgcagaaactctttagtttaattagatcccacttgtctattttggcttttgttgctgttgctttttgtgttttactcatgaagtctttgcccatgcctatgtcctgaatggtattgcctaggttttcttctagggtttttatggtgttaggtcttacatttaagtctttaatccatcttgagttagtttttgtatatgatgtaaggaagggatccagtttcagctttctgcatatggctagccagttttcccagcaccatttattaaataggaaatcatttccccattgcttgtttttgtcaggtttgtcaaagatcagatggttgtagatgtgtggtgttatttctgaggcctctgttctgttccatttgtctatatctctgtgttggtacaggaccatgctgttttggttactgtagccttgtagtatagtttgaagtaaggtagagtgatgcctccagctttgttctttttgcttaggattgtcttggctatgtgggctctttttgtgttccatatgaaatttaaagtagttctttccaattctgtgaagaaagtcagtggtggcttgatagggatagcattgaatctataaattactttgggcagtttggccattttcacaattcttatatcagacaaaacaaactttaaagcaaagcagttaaaaaaggcaaggagggacattatataataataaaaggactagtccaacagaaaaaatcacaattctaaatatatatgcacctaaaactggagctcccaaatttattaaacaactactagacttaaaaattagatagacagcaacaaaataattgtgggggactttaatactccactgatggcactagataggtcatcaaaacagaaagtcaacaaagaaacaatgaacctaaactgtaccctacaacaaatggacttaacagatatttacagaacattctacccaacaacttcagaatatacattctattcattagcacatggaacattctccaagacagaccatatgataggccacaaaacgtgtatcagtaaatttaagaaaatcgaaattatatcaagtactctcttaaaccatagtggaataaagttggaaatcaactccaaaaggaaccctcaaaaccatgcaaatacatggaaattaaataatgtagtcctgaatgatccttgggtaaacaatgaaattcatatggaaattaaaataattatttgaactgaacaataataatgacacaacctatgaaaacctctggaatacagcaaaaagcagtgctaagaagaaagttagtagcattaaatgcctacatcaaaaagtctgaaagagcacaaatctaagatcacacctcacagaactagagaaacaagaacaacccaaacctaaacccagcagaagcaaagaaataacgaagatcagagcagaactaaatgaaattgaaacaaaaaaatacaaaagataaatgaaacaaaaagctggttatttgaaaagataaataaaattgatagaccattagcaagattaaccaagaaaataagagagaagatccaaataaacacaattagaaacaaaacgggagatattacaaccaacaccacagaaataccaaagatcattcaaggctactatgagcacctataagtgcataaactagaaaacctagaggaaatggataaattcctggaaatatacaaccctcctagattaaaccaggaagatacagaatctccaaacagatcaataacaagcagcgagattcaaatggtaatttaaaaattgccaacaacaaaaaatgtccaggacccaacggattcacaggtgaattctatcagacattcaaagaagaattggtaccaatcctattcatactattccacaagatagaaaaagagggaatcctccctaaatcattttataaagccagactaataccttaataccaaaaccaggaaaggatataacaaaaaaaaaaaaaagaaaactacagaccaatatcccgaaagtaggacatagatgcaaaagtcctcaacaaaatactagcaaaccaaatccaacagcatatcaaaaagataatccaccatgatcaagtgagtttcatatgagggatgcacagatagtttaatatatttaactcaataaatgtgatacaccacataaacagaatgtaaaacaaaaaatcacatgatcatctcaatagatgcagaaaaagcatttgacaaaatccagcattcctttatgattaaaaccctcagcaaatttgcatagaagggacataccttaaggtaataaaagccatctacaacaaacacatagccaatattatactgaatggggaaaagctgaaacattccccctgataactggaacaagataaggctgcccactttcaccacttctattcaacatagtactggaagtcctagccagagcaatcagacaagagaaagaaataaagggcatccaaattggtaaagaggaagtcaagctgtccctatttgctgatgatatgattgtatacctagaaaactctgaagactcttccaaaaagctcctagaactgggaaatgaattcggcaaagttttaggatacaaaattaatgtacacaaatcagtatctctgctatacaccaacagtgaccaagctgagatcaaataaagaactcaacccccttcccaatagctgtaaaaataaataaataaaatatttaggaatatacctaaccaaggaagtgaaagacctctacaaagaaaactacaaaacactgctgaaagaaatcatgggcaacacaaacaaatggaaacacttctcatgctcatggataggtagagtcagtattgtgaaaatgaccatactgccaaaagcagtggacaaattcagtgcaattcccatcaaattaccagcatcattcttcacagaactagaaaaaatatcctaaaattaatatggaagcaaaaaagagcccacatagccaaagcaagactaagaaaacagaacaaatctggaggcatcacattacctgacttcaaactatactacacagccatagtcatcaaaacagtatcgtagtggtataaaaataggcacataggtgaatgaaacagaatagagaacccagaaataaagccaaacacttagagccaacttatctttgacaaagcaaacaaaaccataaagtgaggaaaggacactctatgtacaaaaaatggtgttgggataattggcaagccacatgtagaagaatgaaactggattctcatctcacgccttgtacaaaaattaactaaagatggatcaaagacttaaatctaagacctgaaaccatgaagattctagaagattacatttaaaaaaaaaaaactcttctagacattggcttaggcaaagacttcatgaccaagaaccgaaaagcaaatgcaacaaaaacaaagataaatagatgggacttaactcaactaaaaagcttctgcacagcaaaataaataatcagcagagttaacagacaacccacagagtgggagaaaatcttcacaatctatacatctgacaaaggactaatgtccagagtctacaaagaactcaaacaaatcagcgagaaaaaaacaaacaatcccatcaaaaagtgggctaaggacacgaatagacgattctcaaaagaagatacacaaatggccaacaagcatatggaaaaatgctcaacatcactaattatcagggaaatataaatcaaaaccacaatgcaataccacctcactcctgcaagaatggccataataaaaaataaagaaataatagatgctggtgtggatgcagtgaaaagagaacacttttacactgttggtgggaatgtgaactagtacaaccactgtggaaaacagtgtgaagattccttaaagaagtaaaagtacatctaccatttgatccagcaatcccactactaggtatctatccagaggaaaagaagtcactatatgaaaaagatactttcatacacatgtttatagcagcacaatttgcaattgcatacatatggaagcagccgaaatgcccatcaatcaatgagtggataaagaaaatgtgatatgtgtatatatacatatatatgtatataatatatatgtgtgtgtgtgtatatatatatacatatatatgtgtgtatatatatatacacacaccatggaatactactcagccataaaaaggaatgaaataatggcattcacagcaacctggatggaactggagactattattctaagtgaagtaactcaggagtggaaaaccaaacatcgtatgttcttactcatatgtgggaactaagctatgaggacacaaaggcataagatacatttggctttggggacttgggggaaagggtgggagggggtgagggataaaagactagtcactgggtagagtgtacactgctcgggtgatgggtgcacaaaaatatcggaaatcaccactaaagaatttattcaggtaaacaaaaaccacctgttccccaaaaacgtattgaaattaaatttaaaaaagtgaatgtatttattgccacagatttgtacaagcaaaaatgattaaaatggtaaatttattttatgtatattttaccacaatgaaaaaagaatttgttagaaatccaaattgaaattttagtataagggaaaaataataatttaacaaaaaaaaagcaattaaaaattgaagcctgttttgtggtagaactaaaccaatatggaagtcagctagatacatctgttaataaaagttgggttgataaggtaaataaaaagcaataataggagcaaacacttagtaagcacttgctgtgttccaagtactttacaaacattatttaattttcacaaccacctgtggggaagctactgttattatccccaatatacagatgaggaaagtgaggctctctgttgagaccaggaagttcactgtgttgcctctaaaacacagtctcagctgggcacagtggctcatgcctataatttaagcactttgggaggctgaggccagacgattgcttcaggccacaagttcaagaccagcctggaaaaaatagggagaccctgtctctacaatttaaaaaaaaaaaattagctgtgccacagtggtgcactcctgtaatcccagctatttgagaggctgaagcaagtggattgcttgagcccaggagatgcaggctgctgtgggctgtggtcatgccactgcactccagcctggtaacagagcaagaccctgtctcaaaaataaataaaacaataaagaaataaagaaataacggcctctacctttgagcagatcacaatcaacaaagagaagcctataggcaatgataaaactctacaacatcatacatattgcaaggaatgtaggtatgaaatgctacaatagaacagacgaagatgcaatttcagttgaccctggaaccatatgggagttagggttgccaagcccccacacagtaaaaatcagtatataacttttcagtcccccaaaacttaactactaatagcccgccattgaccagaagcagtactgagaacataaacagtcaatcaacgtgtattttgtatgttatatgcattatatactgtattctcacaataaagtacaataaagtatgccaggaaaaatacaatattatcaagaaagtcatgaggaagagaaaatacttttactataccatactgcatttatcaataccgtaagcttgcatcatctgtttaaaagatgaatcgtctgtctgaaatagtgggccactgcagctgcagacctcaatctacagtacatatcaagcaatcaactttttcttgtagtgtcttgacttttctctgcttcttgggagcacttccagcatgactaatggcacttcgtgtggatctcctggtgttattcaaggtttacagcattgcactatatgtgatgaaaaacatgtaagaacaacaaggatcactttttactgtgatctgcaattaactggagagaggatctgcttacttgaagatgattagcatcacatggcattttaaggaacactcataatacttgagctcactacaagaacaacaggaggttggctacaaaatattacagcagtacagtgtgtactacaattaattttatgcagtcatgatttaatactgcatcattacatctgcttacatttctctcaactgtgaatggtgccatgtatggtctgtttgtgcataagttttgataaattttaactttttataatagatttgtgtatttttatgggagtaaatgataaaatatatgagtatctacatatattttatgcattcataacatatctttttggtttttttttaaatatttctaggcaacatggttcatctccgagttttcttgcccgtgttcactgaggagaaattttgtgtagaagagtggtagagttgatgtatgagaattattgggaatgtgtagtgagaaggaaggacaggactgaaaagatctagaaagcttaagagaagggctgcttagttcaactcaacaattgttaaagatccgatttccatatttgccaccagaattttcacatgacactccctttgagagactacattaattgtggagtttatttggctttaagattccaagaagattaaagccaaagattaaactactctatttatgttggccaaatagatgggtgggtggatggatgaagggatgttgaatgtatggatcatagatgaatgaatggatagttgaagggatgttggatggatggatggagctagatggaaggatggctagactattgctagactgagaaaaaggaaaaaaatctgagcttcatctgcttgtttcctgattgtttttgaagttcaggtagacctgcctcaagacatcatgaaatacttcctggttattttccacttctttaattacattttaaatgtacctaacagtgatacaaatgctgcatttagcttagttttaatacatttgaatgatgttaattctcactgtgaaagtttaagctacattacaagtcggtttgtagtcagctgtactagtaactgtcttagaatttggcaactggcgaacaactaactccacagaacccacctttacccttgtcccaaccaaattgcagcatgaactagtgatgtggtcaaagccagttgtttgaaatgactgattcagtggaaacaagacatttcactcattagcatatatatgcaaaacatataaattgattacctactgcaagacatttgtctcacatagctcctatgtttggggaggtcacagtctagtgaaatagatatgtggaacaaggaactagaatacagtaagtgaggactagattggaagtaggtagagagagctaggcaagtctagagcaaggggtgatgagctagagagggtcagagaaggctttgtatgggaaagaggtactgggaatccctggaaaccaaccctaaaagattaggcatcctcctgtagagaaaaggaaacaaatgaagggattctttgagcagaaaacagaagcaacatatattttaacactttctggttgatgctggcccatcatcatgcttagtgactgtagtgactaaatgtctatggttaaatcagttctgatttccagacatttggtgaacaaaatcagaggtgggagcagcttttcctttattgttatttgtttgattgtgtacttgttgtttctttttgcctccaatacaattaatgtcttcatctttctcagcctactttgacttttcagcagcggacagaacattgtcttatttaggggttactatcgcaacctcattttcaacttttgccctctcttcttctcaggtgcaagagaacttaaccatttagggacccatggatggaattctgtgggtctatgaactgggatttgtatttttactaatatctaactgaaagttagcttttccctcgattaccaatgtaggcaacaaacaacagtattagcaagagttgtgattttatcaccaatagaaatcatattttcctgtaacattacggctgtggctgatatcttgaaatatcatttgtgtgcatcactatttcaaaattacagtagttatgagacccactactgtaacttgttaatgaagcacataaatgactacatcacaaatctttaaaaggtatttcaatattgttcatttccttagtaatcttatatatttaattttatacatttaaagacactgttttgagagggatttactggcttcatcagggggccatagcacaaaaacggttaagaggctctacactgcatttcctataattgcttgttctagaaagtaaggaataacacatttctttttggccaccatgttggcagctttcattcagaaactttcccaagcttgcaaacatttagatcaatgctcttgaagaccattacatcttggttgcatttgtgtaactatagttttttaaaaaaaggaacagtatgtgcaaactctggttttcagccaagccttattctttagggcaccagacctctgggtgtaagataatccatgtattgctctacttgcagctactgttcctgttatttgcagggacagccagaaattgcgatttgggtagctcaccatattgcatttaaccattcttcttcccaggatgacctgtgaactatgtacttgtttagatcaaataaagataatgaaaaacaaaacgaaaactgcccaatgctgagcacagacgaggcaggcacttgcagacccttattagaaaagaaagaggcatggaagacatgtaaatttcatctgatgggggcaattttgctccgtttccctttctcctgattactgaagtgaagggagaagggaggaagattggctcgattgtcaaggaaatgaggtagtttgggtcagctcacgggtaactcaggccctaatgaggtagggtcttaatgagccagatcttcctccttgtcctcttcttaaagggctcttcataggctcattgtcagtttgtctcccatacttatgtacttgtcttctttcccctcattactaacccgcaggaaggtacacttgggcatatatgtcagtgtatgactcacacagaggatttgagatgtgatatacatacacagtttcacttgatttattatcagcagatttagatatgctggccctgaaacatcccaaatctatagagtgaaagagagcctggtagagctcacacatttacaccctccctctctctgtacacacaggggcaacacacacacacacattctttatggccatagccctctacacatctgtgtcacaaacagctgtgacgaaccaaatcttgccacccatcacctacttctgtgagaggtgttacttgtccaagcactcatgtctgtgaggagcatgcatttccaaatgtgctgtgcccctcctctccctcctcctcctccatctctacagatccaaacacacacgcaggtattcataatgcacaggcctaaatgtcgaggtcaggtatcctttgcctcacaggcactgtacagatctgaaagatcccacattgactgcactcaccttgctgtcgctgctgactcaatgaaatggaacttgccctaatttgtttttaattttggtagacatctgagctggcaaaggaagaactcaggtggacccccttgataagacttttctcaacatttgggaatgcagctcccttggctaagctagccagctatatagttacaggaaaggctggggtgtctgctacccacgctttttaaaatgattccccaacaccaaattagccaactgcgcttaagtgattcctatttgactaattgcttttaaggagtctgttaaaacccctcacttactccagcccacactccgtcagacattgcaaaacagcactatggttggggcagtggctgggaagcagctatggttgctaggatggagacagcctggtgtgatggcttgggtgggcccatgttgtttttattattattattttgcaattatgtgagaggagcattatctcatatacttttaaaaaaagaatcccactgtctcatcccttaggtcattcctgtgccatcactccagcaaaactgtgtactctttatttcagtttcaaactcttgtctcccctctccctgccatacacacaaacacacaagtgtgtgtgcacaattctaccatacagttcttcttctttattttatttctgcattttgttttccatgaggaaggcagctagagagtgaaactgaaggatggcttattttctgggtgatagtcacagtaacctacttgaagggttaaactatgcccaaagggagagaagctccctcagaggggttgggggtcggggaaagagagaggaaaaaaaaacagtgagagatagagagacagagaaactgaaaaggaaaaatcccagaggagatttttgaaaagatgatcctgagagcaaatggaggtcaccttccataagcaagactatggcccactgcttcaatgaccacattgtcattgcttcttcactcatccccttctgacagtgtataaaatccagcttttacataagcttctttggctggttttttagtcaacctctttattacacagtgatgcttctgtttcagtccttcagtaattccccaggtccgaaccagtatattacaaagggccaaaggatgggcttgctgtcaccagttatctggtcttttccccatgacaacatctgcatcctgtctgaggtgctgcacccccttgaaactgaccttgacagatgtgttaggacttgtagtgtaggggaatgaccttcagactaacagataagagacctaagttcaattccacctctgctgataactatatgaccttaggcaagtctactcttctctgggccttactttctcatcttttaatagaaatggtggctgggcgcagtggctcatgcctgtaatcccagcactttggaaggctaaattgggtagaaggcttgagctcaggagttcaagaccagcctaggcagctagagatggagaaatcccatctctaccaaaaatacaaaaattaactaggcatcatggtgtccaactgttgtcccagctacttcaggggctgaggtggaaggatggctggaatccagaaagtcaaggctgcagtgagccgagattgcaccactgtactccagcctaggtgacagagtgagaccctgtctcaaaaaaaaaaaaaaaaaaaaaaaaaaaaagaaagaaagaaagaaagaaaggaagaaagaaagaaagaaagaaaaaaagaaacggtaatatctgccttgccaacctcattgctttgttgtgaggctcaactaagatgtcagaaaaccatcctgaaacacaaacagtgctgtgataatatatgtacttgtggtcaacaaaagtcaaggattctgcctcttgtttcaattctgcactctgcggggacttacccaaatctctaagcctcagtttgttcaccattaaatagccattacaatgcccagagggagttgtaagcatttggctggatttttccaaaccacctgttgttctttactgtgggtagctgatgccatgctggggactgaatggtgcctggcatgagagcagggtggaagtggtgtggtgtgccagcaggcagaggctgtggtcacggctgtgaaacattattagctggatgtttccaggttttcctagagagagaaagagaatagaaagaaaattctttaaaaatagaactttaagtgctgtgcaactacatgatattatgttttagtccctctcatttattattcttaactctgtgttggcaccatgttaagttccgtacataccgtatgtcattccatctttgcttcagcccttgagggaagtattaaatagatgagaaaattgaagtttggagagaaagtttaagtaggcttctcaagattagcttgtttagaattggcaaagtcttactccaaagtctaagatcatcttgagagatggataacactagccccaatttacaggtcaggagactgaaacagagaggtaaataactttcacaaagctaaacaagctaaacggccagtcaatggaagagactgatgccaaagcccattcttgttttccctacaatgtaaaatgtggaccttgggctcccagtgtattgctaaatccatcagttcatcagtctctaggcagccatttcctgaaaatgtactgcagggggcttgttgaacacagaccacagtccaattgagacactaggaattacatgaggctaagctcaactgtccaaaatagcagctgagtctattaagtaggtagataggcttgtggccccaacaacagctgtttcctcacacaagcccaaagcacaccattatgtgagaaatggtctaaatgtgttgtaggccttttatgctttgtattagtccattctcgtgctgctatgaagaaatatctgagactgggtaatttattttaaaaaagacgtttaattgactcacagttccacgtggctgggaaggcctcaagaaacttacaatcatggtggaaggcacctcttcacagtgcagcaggagagagaataagagttggacgaagggggaacccccttataaaaccatcagatcttgtgagaactcactctcacgagaacagcataggggaaactgccccccatgatttaattatctccacctggtcctgctcttgacatgtggagattattatatcaaggtgagatttgggtgggcacacagagccaaaccatattagcttattaccaatttctttacagaaatcttgtccaatttatagtaaccacgcatgagagtgcccatttgagactccttgccatcatttagtcccccgattaaaaaacctcttatttgatgggtagaatttatatctgactgttgagtcatttttatgtgttttatcactaggtaaaagttgaatggtttttacatactcattagcaatttacaattcctcctttagatattgtttgaatcttttgcccatttaaccattagagtcttaggttttgtttgtttgtttgtttttgagccagagtctcgctctgtcacccaggcaggagtgcagtggcatgatctctcctcattgcaacctctgcctccgaggttcaagtgattctcccgtcccagcctcccgagcagtcgggattacaggcttgcaccaccatgcccggctagcttttgtatttttaatagggacagagtttcaccatgttggccaagctgatctcaaactgctgacctcaagtgatctgctcacctcagcctctcaaagtgctgggattacagtcatgagccactgcacccagccaagtcttagtatttttcttaacaaatttataagctctttatatatgaaggccatcaaccctctctcatgttgtggtgactattttttaaagcttactgactccctacaaatagtttgaaattgagaggatttccttttgggatttgtttgggttggtgtgaatggcttttttagccttctcacattccttgttcattcaaaaagtggtctctccttggtattgtggctttaccactcaaagaaaagcaagtgtttcagttctgggcagaaatagcatgaatattctcttccatttaattatagagactcagcgtaaccctggcaagaaactaaatcgagcccatcaagtagcagacagtgaagcccaactgtattcctagtatagtgcctgttacatagtacatgctgatgaaaagtttgttgtaaaattaaagcatgcatgaatctctccccaagaaccatgtattatcagttatagcttcatgtctcatcacctcagttatgaggcaaactatcttcttttttctcttgaactcttcattttcaatatttaaaaaacctgattatatcaggaacagggtatctataggtattcatagacctttaacactaataatttccctttcatgaaggggctcataaggttccccaggtttcttgtgaatattatggagaggcttgcaacatagtgattacaatcccaggctttagtgacaaaaagatgagagttcaaatccaattctgcaatttactggctgtttggatgttgacaaattatttgacctccctatgcttcaacctttatatatgtgaaatgaagatgatagtagccccaaactcacagggtaggggtgattctgagggttaagtgaaataatgtatgcaaagcatcaggcatggaataaataagcactcatttaatggtagctacaattattatcaacaacaatgtattatatgttgggggcaggaagcaaggatcaggttagtatcagggactatagcataaagggcattgaatgtgaagtcccaacaaatagattcacgttcaaattctattatcaccctgtgactttggagaagttccttttcttttgtggacctggtactttgacagtaagtgtcctgccatcctctgctcacctgggctgggataccatccccacccttcttacagaagcaatggcttcagcccttgaatctaccttgcagtcaagcatgataaaatcccttctgaggttaagtataatgaggtgtatgggactccaggaagagtaggtactaaggtgggtgcagtttataaggaggtagacaggttttacccagtaaaagagcttttcacagtgtagtggttaaatgcatagtgtcagaagccacattgcccaggtcagaatcctgactctgtcatttactagctgtgttgaccttaggcaagtattttagcctctctgacacttagttttcttacctgtgacatgaggataataatagtatctacatcataggattgttatgaagattaaatctttaatgtttataatttgcttagatcagtatctgacatatgtaaagcacaatataagagttttaaataacaaaatagataaaaataagagctaattaagaattggagggagttctttgatgggtagtgagtttcctttcactctcaggacatcatcagaggctggaggtattaaatatattcaagtaccaagagaggattggacaagataaacttgatcatcacttcctgatcaaaagttctatgacttgctttccaaggtcaccatggcagacttagacccaacttaagccataacttttcagtagatatttttcctcctctgctgctgtcaccctcatttacacttatgttttcttggatgacattttaaaattgatcaatacaattcacaggtatgaagggcagcttaaacctgccacccttcccttgctcacaaagcagctattactttgaaagccagttttactttctgcctttttgtcagatcttagccaaatttgattgacaagaggcttttggtgaaactgtttcattcgtgtgctggatgtcacttgctgacttacagtctcctcatttgtgaggtccctgatgctattaaatgagaggaattatcatgtcataaaaagaatgccatcagctagtcagttttatatctgacctagctgtacttgcatctgccatttgactttagcctcttatttgggcagagaatagcatccattcatccaccctccaccacctgtcactctcactaaagaccagaagaagtctgcctccaggtgaggtttctcagtgatggactgatagaaagagtgctggagttactctaagctcagcagaccaggctaatgctttaatagaccatgtagacaaagggcagtgaaagaactagggcagaaatgattttttacttggagaatcagactagattgtagcccacacagatgcagcctcctgaatgattggaggagtttcagtattcccagccccgccctaggctgaaatccaaaccgggaaggcaaggcaaggtgtgagcacataggtgaaggaatttccctcaagcagaggcccaagctcagaaggggtcctgtgaggcacataattcctagggtcttggctgaggcaagtctgccaaccctgaaaagccaggggatttcctgcatgttagagaatggctgaggccctggagtattttaaccactctgggaaaagtagatggagcaaaaaaaaaaaaaaaaaaagaagaatcaaaaagaaagaaagaaaaaaaaatgtctccaagacaccatcagagaagtagaaggtggaggtttccctgaagaagaagactcaacctggttccagagagactgccactcagcaactgcaagtatggccttggaatcggagagacttgggttcatgtcctggcttagccaagttccaccgaatgagttacttaaactcaccaagcttcgatttccccttctctaaattacagatactaataaaagcccctgattcattgggttgttgtgacaattacattatacagaatgtaggtaaagcacttagcactcttggcaaaaactaagtgcccagtaaatattaactattttaatcattatcatcataatgcatcaattactggaaacagacaaatataactttaagaaaatatagatacattttatatacttttcaatgcatactatatttcctaataaaaccactatttaaaaaaggaaaaagaaaagcagtatgacagagtggttaagaatgtatgacaaatcatggttcacactcccagcttgaccacctatccctgtgagtgtctaggtaaatcacttggcctcttgaggctcataggaccaaccgtgcaggatattgtcagaattaaataaggaaacccccataaagtgtttagtatagtgcccttcacagaacaaactaagatttatttctagttattatcattatgggttttcctctgcaactctcagccctcttgtgttccacttgattctaccagtctttagcccattattacaagctgtaccagagggaagttcagagtaacactggcggtttcctgggtgggggtagtcgagattgaaactatcaggccctagggtataatccagtggtagtgaaatggggtaaagcattgttaggaacccagcctattaactaaaggcactgtggctttaaaaggtaattgttttccagtggcctcccagagctgagtcagttcctcagtggaccctgtatcacgatatagctcctttcttccagcccccatcacagcagccaattcaacacatacactcctggctgacgcatttgccactttcttcaaatatttgctaaaagcttcccaaagcaggaagccttgcggttgcagagcattctctgagagaaatgaagcaatggtttctatggcaacactttggcacttattagtgtttgcgtaggcactgaggcaaaagctggggtccagacaagcccttgctgggaagggatgaggagaagagagggcttgggatgcaaaattgctctcactttgccctcttggtagtccttagggacagtcctgggggagtgtttggggcacaatttggccatatagagacagtctgaactctcctggggcagagattgcctcactcagtaccacctgtctttgccaccaggtttagcttccccaaacactccttcactgtgccacccctctgcccaaaagctttgcttcttttccccagtatctatagatcaagtgcaaatcatggcatttgtggccttccacagactccttttttcagaagctgtagctgcctccctcactgtaccccctgtgccttctacttcagcaagatggttcaacctcatcctacctccactccctgttacactgcaggtgtttctacttcccacctctcttccataccattctccttgcttggacttcctgataccatcgcccatgtatccaggacttgcctttccttcaagacctgtcttaagcctcagtttcttcaataaactttattggaccaccccaactcagtggaattccattctctgaattgagattgtattactactcagatctgtcatgcatttgacacttaaacacacactgccttgtatgttgttttattactgcatatatatacttttttatatatgtgtgtctttattactgcatatatatttctttattactgcatatatatgtgtctctattcaacaaatagatgtctctgtctagacagtaagcttctccccaaaaggggacttttaaagtgtttttctgtttttccacagtgccctgctcataataagaaattaattagacattatatgcacagggtttaacccggtgcctggtatatagtaagtgctggagagatgtgtggtaccctcgaatagttcttgattgataccctgtacctccattgccacttccactcatgggctgcatatggtgtccctggacattcatttagccttagccttggagccttcatgagccattaggttggcaaaactcagtgagtgaccattggtcttatccacaccatctcctgctgcccacccactcaccactgcagccctcaggacaggctgtgtcatttttagagcccagtgaaaaacagaaatgtgaggcctcttgctgaaatagttaatttcaagacagtgagagtagagcattaaaccaaggatagggctcttcagagttggggccctgtaccacggcacaggctatgttgcacacccacaaggccagccctgctcgccatcctacttttcttgtgccgtgttccaagttcctggcacaagagacaggggaaatccacatgcggcaaccacatatcaaatggctctagactaactgaccaaaatccaatgatccaaaagtgaattcattgaatggccaagtgtccaaaaaacaaatttgtgatgtctgtcttttattttgccctgcccttgcctttgcccaggctctgcccatgcctctgcctgtgcctacatctacactttcatcttctcacttcccaggtcttagcaaattaaactataaaggcaaggctgcatctgttttatgtccctttcccctcatgttctgatttcttttgaatcagtcatgatttctttgggggctgaggtgagcagccacatgaccactccatacttcactcacgggacagccagacagtagagattagtaaacattcaagagttaaaagctgaaggccaggggtggtggctcacgcctgtaatcccagcacttttgtgaggctgaggagggagaatcacttgagcccaggagttcgagactagcctgggcaacatagcaacaccctgtctctacaaaaaaaaatgtaaaagattagccaggtgtgatggcacacacctgtagtccaagccattcaggcagctgaggcaggaggattgctagagcccaggagtttgaggctgcagtgagttatgattgtgccactacattccagcctgggtgatagaatgagaccctgtctcaaaaaaaaaaaaaaaaattaaaagctgtaagcagaggatgtcatagtcttaaaatcatacttttaccctgctcatggataatataaaactgtaggacagtctcactccgtttcttcaaacacagtaagcatcattttatagtctgtctctggtatgtccaacatctgaagtctttgagggtctgtttctgctgtttgctctttctttagactcctggtcatggtctcttatttccttgtgtgtctggttatcttcatgtgctagttgttgtatttgaaaaactatttgtagtagtgatttgaagcccagaataaagttatctttcttcagagagagaatttgtatttgctttagtgagaatcctgaggcattgctagtctggagtaaatttaagtttactaattaagttttcctagacagtataaatgcaatctgctgctccccaaggttcatatgtggtttacccttattctgcaggtataatcatttggagccctagttttctgtggggagcatttcctagcagacttctcaccttctattggatctggactatgatttctgtccctcttgacccacaaggttttcaatattaaagttgaaattttctggcatggaaaaatgcccttagagtgaaagcagctacatccatgcttactcatctctttaggttctcactatcacttcatttttgcctaacaatacttaaataccttgttagtagttctttattgattttaagaagatttttaaaaaacagattttctgatttccggtggcttcaaccattataagaaacccaaagtatgtcacatgcaattctctcatcatgctttgaagtaggcaggtagactgggaggctaaaactatacatattttgtagatgggaaaattccatgaagttacttgcccagagccagacagtgaattagtgacagatcttgaaagagaaatcaggccccacatgttaccatcacattctcaaatgatgaagaagtattatttcccctacttatgccaaatgctgggaggatggcctttggttgctcctacttttccttccatcttctgtcatcattttatagtctgtcttctcccaaggggaaaccttgctttgttcatttggtctttgtaggagacccctagaaaaagagttggcaacttttgcaaagcagtggtgtcaagattcctggtcttctcctttcctttattcccaagtaccctggtcactcctgggatgttgctttagaaacagggagagggatgtggcagtggggcctgatcaacagcaaacacaggtgccttcttggctatggtggtggcctaattaccatgaatgatcaacgaggtctcctctgccgtctgccattgtctcccatcttctagtagcagtccctcaggtgcagctttagagaagctacataccagcattctggaagtgcttttacgcatgagtgttaatttttccatctgtcctgtcatctgtgactaccagaagttgatcttggaatgtgtttaagcaggttagtggaataaaaactccaagaaaacctgacattttggaattgcccatctaagctggatcattgaaattgtgaaccagagccttttagggaaggggttggcataagaaactcagaaatggctgggagatgaaagtttcaggctatatgacctatgacatgaaagcttacagtggtatacacagcctctgcaagagaagcccaatggacagacatcccagttacagacctctccagaccttttctcctccccaaatgaaattgacttccatcttagagcttaggtactgttagctattcttcccaagtatccttgacagatgctacaggtataatcaggtacaggtgtctgtctggaaagatgccaataagggcaagcaattggaaaggtgcccaaaatgtatacaaaattaacttggatgtcaatttgaacgtgctaaggtggtttgacacaagtgaaaggcagaaccatgctactaacactttccactatgttatgggcagatattgccaggttgccagaattatgtcatatttttattttcaacagttatattttctggcattttgagcacagcatttctattgatatttgagagggattgtggataatttagcatatggttatgggtttctttttcatttaaataagagatttcactaagcttgctatctccctgtatgtgatgtgattgcactcactgtctgatgttctgatgtttttttccccaggataaggagaaggaagctaataggaaagtttataaaggaaggcaattaaaaagttggatttatgaaatagaagttggatctattctgttaagtaaaggatgcatgtcttgccaacagtcatgcctagtcatatacctccagcaatagaggctctgttgtcctgagcaacattattatcttcttctaggaagttatggtctcagaattctaggaaactgcttccatggctgatttcactccaccacacctgccgtttccatggaccatggcgaggctaagctgtgggtcagtcaataaccctcagctgcattgctgatgttggtctggggctccattggacagaaaatgtttgacactgatcacctctatttgaccctgcttctgagctattgtttctgccatttccccactaattccaggtaacctagccttctcatttactgatctaagtttcactctgtaatctcatctcttattgttaacaagagccacctggctatcctccttaactgggagcgagaggagagcctcgtctgctgctgggcagagaaacttgtatgggggctgaggctgggaaaggcaagtaaggtcattttctgagtgcttactatttgctgggcactgtgctgggtgctttacacatgttaactctactcatttgctgtcagcgaaaggaagggtagaaaaggctcaaccctaaaggatgagaggctgaatttgtgttgttgttgttgtttgtttgtttgtttacaatagatggaatggtattgtgtaagggagggcttactccacaaagattaaggagcctatggtcaaacaagagtatgacttaaaacaagtcattttcctttactgagtttcagtttacccccctgtaaaatggccacatagtctttgctcagcttaccatatatacttgttgtgaggatacaagtgatatagaatgcttagaaaagtataaaataaaatattgcataatgtcatgtgaggcaatatagaatagtagttaagaaccagactacagatggggtgtaggattgcaaatctcagcccagcaacttgctacctatgtaacctcggacaagtcacttaacctctatatgccttagtttcaacatctgtaatgtgaggatatgaatagtacctgttcatggggtttttgtaaggaaaaataagatagtatgtgcaaaacattcagaatagtactagcacatgataaatgctgcataagaactgtttattattacaaataatagataactatgaatattttaggcccctatctttcccacatgcactctctcagtgttgtaacccttaatgcaacagaacttggctaatgctgcaagtcccgttatattgtacatagctctctgcatgccagggcacataaccctgccgtagaacacacataggccatagcacttggctatataaggaggtgggagctcagtactcccagtggatgagagaaaggcctctgtaaaactggatggcctctgaggtaaatgccataaaggattcatttacataaattcagaatgcttcttaacttttcagaaacatgtttcctgcattaagtgagatatatctgtatatagaggaagctgcagagttatagcatccctctacaacatttattgagagacaaagaggactaatgcgtgaggatgtgtgagataaaaagaagactaagacatagtccccaaccttagagagttgatcatttagtaggggagataagacatatagtcaagctcaacatgttgtaagacagaaccgtgttatcagagtaaatgagaacatacatatatcctttataagctgggaagactatataaatgccaatggttttaggttttttttttttaaacaagccttaagaattgcaaagtgctgtaggagatagagaagaaaggaaccatttcttactgggggcatcatggaaagcactgaagcatgagtagtctttcaacaggtagaactgagggcaaagggcaccagcaaagccctgcagatgagaactcactcaggatatgaagggaccagtaagtagcttgtgtcggcttccgcatagaatacacacaggagtcttcctgaaggatgacaaagctggaaagtttggctggaactgggcttaaataccaggctacggagttgggcttatttaggaggccatggggaattttagagcaggggaattgcatcattcaaacttcccttttggaagtcactctgacagcaggaagtgccatctcctctggccgcctgaaggacttttctcctgcaatgctatctctttctcttctgcatcatcaatctttctccagagatatgcagtggcagcctgctgctttcaaaaaacaaacaaatgaaaatcttttttggctgcatactctctttctatttctctacagccctgatagcacactgtctagaaaaaaaagtctatactccttgtttccacttcctcgcttatcaatctcttctcaacttgctttagacaagcatctacccccaggtatatcattgtcaatatcctcatatttttgtgaaggtcactagtgacctccatggagtcacatccaacagtcctttttctgcaatactcttttctcttgattttccaaactcagtactcttccagctttcctcatctctctctagccattccttctcagtctcctttgttgactatttcttctctatgtcatctctaattgttggcacacccgacggctcagttctagatcctcaacttctctttatcagtactcttatttaaagtgattttatccagttccatactttaaaaaaagtctgcctgttgatgatgctcatattcatatcttcagctctcacctctccactgagcttcaaacttatatattctcctatctacctaacatctccacttaggggtctaatagcatctcaaattttatcatggccaaaaacaccctcttgatctgtgcacttaccacatctgcaccaaattatttctactgcaggcttccccttataagtaaatggtaccatttgtccaagaccataacctaagcctcattcttgatcctattttctcccacccaacacatcctcttcatctatctattaacaagttctattggctccccctcaaaaacgtataaaaatccatccatgttgtctatctccactgctcccacctggcccaagccaccaccatcttttgcctagaccactacaattgtctcttaactggtttgcacacttctactcttgctcttctatatttttactactaattatggggcctacagtgaattcttcacaaaaccttcaaagtgaggttttaaaaacataaatcagatcatgtcactcatctgcttgaaaccatccaatagcttcctgttgcaattaaaattcaaactccttccgatggtttacaagggccctgcgggatttggccactgcatgtctcttcagcctcatcttgtgccacactccctcttgctcactatgttttagtcttactgtctttctgttctgttaacaagccaattaaggcctctgcactgctcttttctcttcttggaatgttcttcccctagatctttacatgtgacaggcttcttcttgccctttaggtctcagcatagatgtcacttcacctcagaaagagttttcttcaccatgtaaagtagcctcccttccttgccatcacttcctaatacatcagcctgttttattattgttatagtatttatttatgtcaaatcatcttatttatgtgtttattacccaatccccacacacaactaggatgtaagcaccattagagcaggaaccttttctgtcctattcacccttgtatctcccatgcctggaacagtgcctggtatgtagtagacacacaataaatatatattgagtgaatgtggcataaattaattagcagcagagtggttactgcagtgatacaaacaacaatcaataaaggttttaattaaattggtggtagtagtaagtgagatgaaggaggaaaaatcagtattagactaatcccacccaaattgcatttaaaggcatttaatacagaaaatttatcctaagtcactatttctagtacagagtatcaaaactaggaccacaaatcaattaagcaataaataattatccattcattaaccaaaaaaagaaatgaaagaataagtcagtggaacttggtgtataggagtagaaagaagaatgatgattccatagtttcttgccattagaacaaaataggaaatttgagagaaaaactgctggtaggtgggagggaagaatgacaggtttggtatagaacatgctgatttttactcatcctctgaggcgtctgggagactgcctcagtgtgagtttagaattctacaggaaggactgaggagaagatagagattaggtacataatcagcatagccatgagagttcaaagcaataggagtgggattccttgaggaataaaaatcaactgaaggggataggaaatctttatttcaagggatctgtctatcacatttcttagctcccaggaagtataactagaaatgtggattataataatttccattttccccaggcacttccccacagttcactccctctcttgaataactctgtggatgttttttcccaggtagggggttcctggtatgggctgtgaggaagcaccgtgatcctttttgccatcagcccccatatttatgcctctcactactaacagggacagatatcaagataagcaatggagaatgcctctaaaagattttgtggtcttttgggggaaaaagcctagctataaagaaagttatcacttctattttgctttttccaatgcaaatacacagtctgatcccttaaataccagaagcgatgctgtcagcagcaacaacttaaaaaaagttcaccccgatatgtaaagctttttttgtaaatcagacttgctccctaatgctgtcagttgaagaactgcccttataatttttactcactgccaacctgtgccttgccaagatgaaggagctcatctgagttagtagtagaactgggttgagaccctcagacttctaggcccagcccttcacctcacgagcagctgttggcagcaatctcagattgttattctaccctctttctttgcttcatcttgaacccttggtgggagccaaaagcctatcagagactgattgttctgctgctgttggcagattggcaccagccagtttcaatgcttgtgcaaagagcatataataggtccctaatgagggcaagacaatgagtgtttggttttgattgcagggcttatttgtcgtgtgtctgtgtctatatctagtccctacaaagcaaacctgttggtgggacagggcaggcaggagaggaggaggctgtgaaatagagactcaaaggacaaagtggcaagtggtccaaggctctgcagtggttcatagctataggaaatggaacctagaacttagtcctgtgccttgggccttgggcttgagcagaagagagaggagtgggtttgggtggtcacagtgggctgttatattctgaacaagacagaacagtctgaatttgggttctggaaaaggaatcaactcctgttgggggaaaaaagtaagctctattggagcagtaactttgtttgtcttcttcacctctgtatccccagggtctagaaaaatgcctggccatagtacctctacaataaatatttgttgaatatgaatatgaatttttttctgaatagaaatctcgagtctttgagattttattgattaactcagcttgtctagcggaagcctttccctggctttcactggaagaatttaatttgtgtaacagtccaggcaataagccaaaaccccacagagattgctttttagaattgctcttgtgcccatttgctttattttcgctttcctctagacctggtcttccatattgaacatttcgagatgttttttctcctgagctaataatctccataagctcccatttttcttgccccatcactgggttgctgatacaatctgaacctctgataactgagatttccatttgcttgctgatctctccttagtacagtgggccttatgaacaacgtgtgttaccgtgtgtgtgtctgtgtgtgtgtgtgtgtgtgtgtaagcaatcagaactgcctggaaaaatgaaaataagtaaagagggcaatggaaggtgatgattcacacataagtgaaatgattagatacttctcagcctgtcactagagtcttatgaatactagacaggaagatacctttgttaagtaccaaatctcaaattggccctaaaatggagctctccagttcaagggaatggttgatcttccaaaaacaggcagatggtgaatccactaactcttataatctccaaggtcattgtaaagtaggaaaccgggaagcctggaagataagtaggcccatggctgtaaataaggcttccagttggcctgtgaggaggactttgggaacagcagctactatccatccttggccctgcctgagcctagctcctcatgctgcctaattcagaaactatagccatgtactcccagtccctctctcagcttctcccaccatctccagaaactgctgagggagggaaaattaacattaagttagaaccagcaagcattgaagaagcaggcaagcatcagaggtgaggaacaacctataagtcaataacaggagagtgagtcttttaggacaaaccttggaatgttgaccagagtctcaagaaaatgttttacgtagctgtgtgcttaaaaataactgagtttttgtcatagataatacaaatagtcaaaatttcatcctttagtccctctacctcgtggtgttaataataatgacagccaacatttattgagtgcttactatgtgccagacactgtcttaagcaccttatgcacatcatctcacaacttcatttaattgccacaacaattcccatggtgggggtgggtacaattactgttacttccagtttataaatgataaagcagaggttcagagtagtgaatgagttttcctgattcatacagctactgagtgatagagaaaggatttgaagcaaggttctctaacctcagaaccacatctgttaaccaatacactgtaataggtcttttccttcctttgactctttttgcttaaaccacaattgtataaagacttaagttgatgcaatagcaatggaagtgaaaaatattgtaagtgttttgtcttctttcatggaacaatgggtttagtagctgccatacccctttaaccatgtcagaaaagcatgaaaaaacagcatatattggtgtatcatataccgttattaaataataagccatattatatatgttattaaactatgaacagacagcagtagattttactgtggaaacttttgatagacgcacagcacaagtatctcataagcacaattttattagattcacatgtttattctgagatctgtgacatattcaggaatatacctcctgtgtaactgaggtaaagggtttctgaagccaggccttcttgtattttttcttccaggagggaactgaggttatagataggtgtatactccaagtacacttgatagagtgagctgtgccaggttgaggaatgagtttccattactggcttaggagggggtgaaagtgggggccacagaaggttctgaagcttgaggtgcacaatgctttttgtcagcttgctaccagtgtcagtgcaaatggggaaaggcttgatgtcttccaggacacaagactatttaagcttaacatcccaggaacatattcaatactgtccagagacttctctttctttatctgaacagatatttaatgatagaaaggtgtaggccagtgagtagtcaacaataggcaacgattctagagtactgactccctatgtactataattggctgtaatttgctcaaagattcattctaggcgcaggcactttctacatactccataccattaggcaggatcttgccaagatggagaccttcggacctgtctacatacagtggggtagctgtctgcccaactatgaccctcatgattatgccataccacactggacagctcccatccagcccggagctctttcctctttccttgacacatccctcagggcccttatccactgaatagcatgagcccagacagcacctcctcagaccaggttcacaccaccatactccaaggcaaccctccaggcacttatccatgctcctaataccaataaacagcctttgctcacaagagaagctatatcctaattgtgcatgtagtaagagctttcttgttaagatcacacattagctgtgatacacactgagacaagtctgctttccactagagtctaccttgcaattacacaatctggatactggcctttgtggcctacccagccactctttactcagtgaggcaacccttgtgcagattagagctctcagtggactctccaatacaacgaagcaggccctaccatcctgcccctctgcatgttgtgtccatccccaccaccagccaccacttcccacaagacaatcagcccagagactttaattgctgggtctgctgtgaggctggcctcaccagctctcaccttcactgcagcttatacggctgttttgctcacagaaaggcaaccatctccagaggaggatccacatctcaccatatgcccagtgaagccactttccagtgcccctagtcagtgctgcattatccagaaggccagataagtatgtgcttagagaataacactgtgggggcaccaatcaaatgatttttaaaagagttagaaatttgatatttaaaaagctgaagtagataagaaaaatcagagctgtgttggatttttttgtcatctgttgtatggcttataattgtttccatgtgaattacagagaggaaggtagacacaaaaatgttttcattaattagggcttccaaaggccctattttggccctgccctctttgtttctccatacactgtgagccagccatctgctaccatccaaaattcctcatgctattcctggaatagtaatcctaccacaaggaacaatatctattcagaatataccagtaaggtcacatcaggtgttaaaatattgaaatacttccatatctattgacgaagagccattgccctgatcccttcctctgcaaaccccctgcctccaccatcacctcagctgcactagactctccctaaggatctccgggcccccttataatctaacaactgaaggcataatacttgctccagcatcctgtttcaatgtttatactgattggtcagtgtccatgcagaatctgctgttaaatattttgaatatcaaatataggaaaggtcctataactgctgcaccaagcattatacagctttctggggctcactacttacatgcatatgtcacttggcaaatctcttccaaaccagagaggatttctgaacacttggtgcacattgtacaccaaccactagaccacactaccattccctatatttacatggactctttgccttgaggcaatctctgaataggcagcacctcagctgagctcttcatgaggaagtcctccagatacttaccaatcctgcacaccatgaggaaggttttaactctgcctcctcttcatttattgacttgacctgccattccctacttcccctataccttggcaacccatgatctggccattgcacattgcttcaaaacaaggaaatgactgacaagactaggtccacataggcaataccagtccttgcaaactgagacaaccaacctatgaccccgtaagagtccacatggaacatagtgtgttggctcctaatgtgggtcccacatcaactcttcacagagcatttggcaaaacttgaaaccaagatctgtaatacaatttccaacaattcaatggactttctaaatagtcaagtccaaaatcccttcttccccaggaacaattctctagctgtgtcaagcctgtgaaaccactcaggacactgactggagcagaaccacacctacttttcacacagcctgagctaatctctaaccagaacaggatctacatcaaccatcaacgctgaccaggcaatcatatacacagccactcctcatggcctgaaacaaaccctaactaggccagggagcaaacatcagtctgcaaaacttgaggcaaattctgagcagaacagaatcttgaaggagctgctaagatgactctagtccacagaagcagcctccatttcatgaaacagcctatgaacagaccaggcatatggtcccatgcctcacattcatctcctccctttccctcctcttccctctttctgcccctttcttctttcccattttctcccattccttgaccctgttattccctttctctctcacccaattcactgccatattatttagttgttataataattttgatctccctagtcacagggaggggaaaatctaggaaacttctaagatagttccagccccccaggcaagtctgctgttgaaagactgggcctactgtatgagaatcagtgcatggagtttatgttcctggaaccagaatggttgtggaacaaaaacctcttttctagtaagcaagcccccaagccagctgttatgatctgagaccagtccccaagtgaaaggctcaggttcagccagattgggagggaccagaggagactctgggtaaaaaagtcaagtagataaactcttccatacctcctgctattccaagttttggtctgccacattaggataaatatttgcttaaaaaatccctcatgtgtatgtttgttgtcaagcttttgcattagatactacacaaactataattcattgtccctcatgttccttgaacccatttctgcccaattctctccttttatcacattccttaagaccttttaattcatgtttatgtacatatataggaacctacacagagtactatttgtgtatggttttttaaatatatgctatgcagtacatatcattttgcaacttgatttttcactaggcattgtcttgaagatcttgtcatatacatatagacctagttcatttacataaattgctacataatgtggcatatgtaatcactctatgtaattattcctttcttaatggacatttaagttgtttccaatgttttgctattacacatagtgattccgtgaaagccttagtttctgcttccttgtgtaattgaactggagtttttctagagtagatactaagaatggaaatttctgggtcatagtgaatgtcccccctttttttactttaatagatactgcaaattgtactctcaagtggctttctgtatttacattccaataaagtgtgtaaacatgcatgtttcctcaatcctttgcatgcattttttcaagtttttattttgaaaaatttcaaacataaaattacacatctgacaaaggactaatatccagaatctacaaggaactcaaacgaatctgcaagaaaaaaacaaacaatcccatcaaaaagtgggcaaaggacatgaacagacatttctcaaaaggagatgtacaaatggccaacaaacatcaaaaaatgctcaacatcactaatcatcagggaaatgcaaactaaaaccatgatgaggtaccaccttactccttcaagaatggccatgattcaaaagtcaaaaaataaaaaaatataatttacaatgcatatccatatgatcaccacctagattcaataattaaggttccatgtctgttttatctacctatcttttttgatgaaccatttcaatgtaagttgtaaatatcatgattcgtgacccttaaatactttagcaagcctctaaaaataaggacattctcttacataaatgccagttattttcacacaatatcttatcatacctacaaaaattaacaataatttcctaatccttatatcatttaatatccagttaacattcaaatttcctcaggtgtcatcaattgtcttttttaatgttttattttgacagccaggatccagtcaagtttaactaattgcattttttaatggagatattattaacatactaaagagttcaccatttaaaatagaacaattcagtggtttttaatatattcactagattgtgcaaccatcatcactaattccagaacattttcattgccctgaaaaggaagcttgcacccattagcagtcactccccgctctcccctactcctggtcaccagcaaccactaatttactttctgcctttatagatttgcctattctggacaattcataaaaatggaatcatatagtatgtgccctttcatatctggcttcttttgcttagccatactgttctcaagattcatccacattgtagcatgtatcagtacttcctttttaaatagccaaataatattccattgtatggatataccacattttggtgattcatgcaacatttgatggacatttgggttgtttctaatttttggtttttatgagtaatgctcctatgaatattcctatacaagtttttgtgtgggcgtgtgttttcatttcacttgggtatatacctaggagtgaaattgttcagtcatatagtgactctatgtttaacattttgaagaacagttgaactgtttctgcaatggttgccccatttacattacaaccagaaacgtatgagggttacaatttctccaaatactcatcaacacttgttattgtctatttttttgtgtgtgttagagccatgttagtgggcatgagacggtatcttattgtggctttgatttcaatttccctgatgattaataatgttgaatatctttttgtagtttttcaccatttgtatatcttcattgaagaaatgttcattcagatatttgccatttttaattgtgttatctttcttatggagttgtaagtgttccttatatattctagataaaagtgcttcaggagatttacgatttacaaatattttcttccattctgtgggttgtcttttcatttcttgatagtgccctttgacacacacccaaaaaaagtaattcaacttattgagtttttttctttggttgctttcacttttggcatcatatttaagaaaatgatgcctagtccaaacacaaaatattgacccctatattttcttctgagtttcattgttttagctattacatttaggtctttgaccatttcaagtaaagttttgtatataagacagtggtcaaaatttattcttttgcatgtggatatccagttgtctcagtaccatttgttgaagaaactgcttttctcctttgaatggtcttggactctcaattctgttccattgactgacatagctatctatccttatgccacttggttactgtcactttgtagtaagttctgaaactgggaattatgagtcttcattttagatctttttcaagattgttttgcctatcacgaggccctggtatttccatatgaattttaggatcaacttttccttttttttttttttttttgaaaaaaaaggccattggaggcttttgtttgcttgtttgttatgtttttgatacagggtatcactttgtcaccgaggctggagtgcagttgttcactgcagcctttaactcctgggttcaagtgaccttccacttcagcctcccaagtatctagaactacaggtgtgtaacaccatgcctggctaattattattatttttttgtaatttttttgtagagacagagtctcacaatgttgtcctggctggtcttgaactcctggcctcaagtgatcctcctgctttgacctcccaaagtgctgggattacaggcatgagccactgcacctagttaaaaaagagcattagagttttgatggggattgcatcgcatctataggtcaatttgaagagtgttgccatgttaatgttaaaccttccaatccatgaacataggatgtcttttcacttatttaggttttctttaatttcttccaacaacgttttattgttttttttgtgtacaactcttgcactcctttgcttaaagttattcccatgtattttataatttttgataccattataaaagaaaatgatttattaatttcattttctgattgtttattgctaattcatagaaatataattgtttttctgctaatcttatatcctgcaaccttgctgaacttatttgtctaacagttttttagtgaattcctcaagattttctatatacaagattatgttattcgtcaatagaaatagttttacttctttctttccaatctggataccctttatttgtttttctggcctaattgctatggccagaatcctcagtacaatgtttaataagagtggtgagagtagacattcatgttttgtttctgatcttaaggagaaactttcagtcttccattattaagtatgatgttagctgtgagtttttcatcggtgtgcttcatcagattgaggaactttccttccctctcttgtttgttgaattttttttatcatggaggaatgttggtctttttcaaatgctttttctgtatctattgagataatgtggggttttcccctttattcaactaatgtgatgtattacattaattgattttcgtatgttgaatcaatcttgtattcctgaaattaatgccacttggtcatggtgtatattcctttttataagctgcaggatttaatttgctactattttgttgaggatttctacatctctatttataaagaatactggtctatcattttcttttcttgtgatgtctgtctggttttggtatcagagagatactggcctcacggactgggttaggaagcgttccctcctcttctggttttggaggagtttgtgaatgagtagtgttaactctttaaatgttttgtagaattcaccagtgaagacttcttgtcctgggcttttttttaattgttaattcgatatttttatataagtgtgttcagatttataatttcttcttatgtcaacttgatcttctgtgtaattcattgcattttgttatgtctctttagaatcttatgccacaacaatactcccacattttccaccccaggacattgacttttaaagacatcaggttgccttgtagaccgtcttgcattctggatttgtctgattgtttcatcaagctgtcatttaacatgttctttgctttgtatttactataacctgaaagttacatataatgtcttgagcagagtcaaatttaacatttttattgccaatacttgatttttttaaaaaaaattacattttgaaaattgatagatgaaggtgagagctcatggttaattagtggtaaaattgaatagatttttagacttattggccatttgggtttcttattccgtgaactgttggcttttattctttgcctatcttgctattgtgttgatcatctttgtcttattgatttgaaggtgtttattattatattctagataaaaatcttatccacatttttcatttacttcttcaattcacctgaaatttatttttgcaaatggtatattttaggcaagaatgttatttatttaaatgtattttttaacttatttaaatcaattttatctattgtccagataaaatgtattgaatagtcgggcttttcattgacttgagatgtcacttttattatatactaaattcccatatatacatgaatcagtactttttattatgccctattgatttatttttgtctagtcatgtgaatacattttaattacacaatgtataatatgctttgatatctgtaaggggaagtatctcatatatttttaaaattgtcttggctattcttgtacattcacttttcttttgaattttagagttcgcttgtcaaaccttaggaaatatcttttttattatgtagattgtcattgcattcatcttataagattacttttgtgagaatttatatccttaacataatgagtcttccatccataaacaggccctttttcatgttgttcagtacatttttgtagttttctccgtaaaaactttaaccatttttggtcagatttattcctatttatttcagagcttttttgctgttataaatgatatttgcttttctattacattttccaattggttattattggtgtataggtaaactattaattttgctttgtgaaccttatactcagtcacttgttttttttttagagacagggtcttgctttgttgcccaggctagaatactgtggcacaatcacggctcactgcagccttgacctcttgagctcaagggatccacctgcctcagcctcccgagtagctgggactacaggcacccaccataacacccagttaattttttaaattttttttgtagagacagggtctcgctatgttgtcccagctgaacttgaacttctgggctcaactggtcctcctgccttggcctctcaaattgttgggattacagctacgaggagtcaccacactgagctcccagtcacttttaacaatgcactaagctctaaataatttgtcacttcatttttaaacctattttttctctctcattgcattggctaggatatctagtaccactggaatagtaattgttaatgatcacccctttcttctatttcattttaatgagaatgtttctaaattttcatgattaaagtaggtttgctgtaggtttctagtagataagtttatgaagataagttggtcctaatttactagaagatttgttaaacgtgaatgtatggtatactgtgtgtggtacgtacaaacttgagaccaaataccacatttattagaaaataattcataggcagcatgggcccctgggctgaagagcactggcctcagttggactgaactctgagaagatggaatctgccaattgaagccagacatctgtagaatctagaagtgaagaatttcccagagagaggtctctgggtataccatacaacctcaggcttaccaggaagtagcatcttgcttgcaagaagagaggaagaaagggctggcctggagggcgtccaggctcagcagatcatattcctactacagactgttgcctgcccacctgcctgcctgcctacctgccttaggttatgaagccaattaggaacagaagaggataaagaactgtgatttgttccactttccaactctccattaaactgtagaacccatgggtaaggaaattactttttttttttttttctgcctcagaagacaaagagcattcccttggagattgtcatcttgtttttatggaagccactacctagagttgaatagctttcccctttccatgctatactgtcagcagtgccacatgacatcttcaactactgctacctaaaaaaaaactcttacttcctaccctagcctggaataaccagtggctgaagccaaatgcctaagaggtgctttcctcaaaagaatctctgtctcccacacttctgggaaataggtggaaagcagaatgaaacaaagtgttccttagtccagttgtagtcaaatggaagaactgaatatttatagacctggatttcttatactagccccttccctcacttgctgtgtgagttgggccaaatcacctaaactctctgtgcctcagtgggagagaggacaaaaatactatctaccccaaaattcattgcaatgattgaagaagatttgtataaaatgcttagcaaagagtctagcaatttaagagttcacaaaatattatttgttaaaatgcaaatgaatgagattgtgagaatgctcagagagtgacagggaagaagagccccatcttattccatatctatctatctccagtgacatgcaagcagatactaagttatctaaatctaactaaagagaacaaagattccccacagataccttcagtagccccatgctttggattcaaccatctctttttatagggaagggcagacacatgaaactgggcattcattgcaaaagcaatgactccttcgagaccagcctggccaacatggtgaaaccctgtctctactaaaaatacaaaaattagctgggtgcagtgggggtcacctgtaagctacttgctaggctgaggcaggataattgcttgaaccctataggagaaggttacagtaagccgagattgcgccactgcactccagcctgggtgacagagactgtctcgaaaaaaaaaaaaaaaaatcaatgactccttaaacatggaaagaagctctatattcctcaatattgaggccgctgaagaaaaataatcaatggatacctctactgctcaagaaagctggactccaagactaacttgattcaacccctgaataactacaaaattatcctggtttcccagggattttattagcaagaggaacagaacaatcaagactgatctagactacagacccctttgtgtaccctgagctatgctactctgtttactaatatgaacatcagaatgccttgattgcttaaaggagaaactaggtgttatgtataatttgggctctgacatgctcctactttagacgaataatttcttatttgaagaaagaggatgatactgcgaatcatatatctttccacaggactcgttgaggaagaaaaggagatcattttatttatttacttattttttattatttttaagaattttaacttttattttagattctgggggtacatgtgcaggtttgttatctgggtatattctgtgatgttgaggttttgggtacatttgatctcatcacccaggtagtgagcatagtaccaaatagttgtccaacccttgtgcccctccctccctccctccccctctagtagtccctagtgtctattgctgccatctttatatccatgaatacctaatgttcagctcccacttataagtaaaacctgtggtatttggttttctattcctgaattaattcaattaaataatggtctccagctgcatccatgttgctgcaaaggacatgatttcattcttttatatggctacatggtattctatggtgtatatgtatcacattttctttatccaatccaccattgatgggcaccttggttgattccaagtctttgctattgtgaattgtgctgtgatgaacatacaagtgcatgtgtctttttggcaaaacagttattttcttttggatatatacccagtaatgggagtgctgggttgaatggtagttctgttttaagttctttgagaaatcttcagactgctttctgcagtggctgaactaatttacactcccaccagcaatgtataagtgttccctttaaagacttttggtggagtctttaaggttgtctaggtatagattcatgaaggtatagcattgtccatgaagatagatagttcaacttcttatttttctatttggatgccttttatttctttctcttgcctaattgctctggctaggatttccagtactatgttgaataggagtggtgagagtgagcatccttgttttctttcagttctcaaggggaatgcttccagcatttgtccattcagtatgacattggctatgggtttgtctagatggctcttattattttgaggtatgttcctttaatgcctagtttgttgtgggtttttatcatgaagggatgttggattttacctaatgctttttctgtgtctattaagatgatcacgtttttttttttgtttttcattctgtttatgtggtgaatcacatttattgatttatgtcaaaccaaccttgcatgccaggaattaagcctatttaaatgtggtgaattatctttttgatgtgctgctggattcggtttgctagtattttgttgaagatttttgtgtctatgtttatcagggatattggcctgtagttttcttttttgttgttctgtctttgctgggtttggatatcagggtgatgtttgctttgtagaatgaattagggaggagcccctcctcttcaatttgtttgaaatagtttcagtagaattagtatcagctcttctttggctatctggtggaatgtggctgagaacttatttggtaaggggctctttttgattggtaggttttgaattgctaattatgtttctgaacttaatattaatcttttcagggttccaatttttttcctgactcaatcttggaagattgtgcattgccaggaatttatccatttagtctagattttctagtttgtgtgcatataggtgtccatagtaatctctgaggatcttttgtatttctgcgggatcagttgtaatgtcatctttgtcatttctgatcatactcatttaagtctttttctttcttaatctaactagcagtgtattgacgttgtttattcttttgaagaaccaacttttggtttcgtttattccttgtatggatttttgtgtcacaatttcattcagctctgctctgattttatttatttcttttcttctggtagctttgaggttagtttgttcttgtttttctagttcctctaggtgtgatgtcagatcagtaatttgagatctttctaacttttttaggtagttggttagcactatcaactttcctattaacactgcttttactgcatcccagagattttggtatgttttgtgtctgttttcatttatttcaaacaatcttttgatttctgccttaatttcattgtttactcaaaaatcattcagaagcaagctgtttaattttcacataatttaattttcacatagttgtgtggttttgagagattttggcattgatttttattttgattccactgtggtctgcaagcatggttggtatgattttgattttttaaaaatttattgacacttgctatggccaagcatgtggtccatcttggagtatgttccatgtgcagatgagaaaaatgtatattttgtggttggcaggtggagaattctgtaaatgtctattaggtccaatatgtcaagcgttgaatttaagtccagaatttctttgttagctttctgcctcaataatctgtctaatgctgtcagtggggtgataaagtgccccactgttattgcatggctgtctaaattgagaaatagataattttaaaacaaaacaataacaatagttgtactgcaataatgctgccatttaataagcatatagtccgtattgtgtcattcaattctcttaacaactctgtgagatatgtactattaacttgtctatacaacatatgagaaaattgaagctgagagaggttaaataacttgctcagagtctcatacgtaatatttttaagtttctattgctattgcaaatgatatttattttcctatcatgtaccctaataagttgttgatgatgtgtaggaaaggtattgatttttgtagtctgatatttcatttaaccaccctcctggacttttcatatttgttctaatattttatccgttgactacctcagatttttatatagccatattgtttgtgaataacaaaaattttgtctcttgctttcgaatccttattctcttatttttaaatttattttataccttattgcattggttaggacatcaccatgttgaatagtaagtggtaatagtggccatctttatcttgtttctcattttaatattttgtcaataagaactaccaatagcaattcatatttattgagtactttatattgcccgagtaagtgcctttatatattttatatcgtttaatccttgcaacaatactatgaggagtgtactattatttttctcattttttgtggatgagaaaagtgaagctcagaaagagtaagcaattttccaaggtcacacagcttggatggaaccaagatcctaactaaggcagtctgactccaaagcttgtactcataatcaaaattacctcctcagaattttcacaagatttgttgaggaagttctcttctaatctttattggctatggatttttaacatggatggacataaaattttgtcaaatgtgttttcaacatctgttgagatgattatgtgatttgtctcttagtctataattgtatttaattactttaataaatttgctaatgttaaactatgcgtacattcctgaataaactctacttgattatagtgcatcattttaataagctgctagattctattttttctagaatttttatatttatattaataaataagattagtctataattttctttttctttcttgtcctgtctgtctgatttggaggagccgtccatcttgttgtaccctctggaactatttctataaaattaaagttgtctgtgatttgaaggtttggaattacccataaaatgtttagcctttcaatttgttctattatttttctatgattttctactttttattgggtaaattttagtaattttatttttctaaaaattttctcattgaaacatattagtttaaaattctatgtagtattattttatttttaatattaccttggtacctatatttgtgttcatatttggcttcctggtgatattttttcaccttcttcattttttcatattagtatttaatgaaggtttgactcttaaaaacagtctcgttttatggatcatctataatttatttgttttctatttaacagttttctgtttttatcttaatctctcccttccaattcccataggcttgttttatttttattttagctttcaagacagagtctggctctgttgcccaggctggagtgcagtggtgcagtcatggctcactgcaacctctgtctcctgggctcaagcaatcctcccacctcagccacctgagtagctgagatcacaggtgtgtgccaccacgctggctaatttttgtatattttttgatagagactggtttttgccatgttgcttaggctggtcttgaactcctgggttcaaacaatctgcccacctcggcctcccaaagtgctgggattgcaggcgtgagccactgtgcccgacccatgggtctatcttactgtgctgttttgtaaaactaacacctggacttgatagcttagttcgttgacttttcatttgtttataatttctaatatgtgaatttaaggccatgtttttctctgaatattgctttacctgcatctaacagacttggatatatacttcactcatcatctttgattgctaaagcatttgcaatatcaatttaagttcatcttcaattcaagagttatttaaaagtgtgtttatgtttttaatttatagatatatattgcgttgagcttgtgtaatgggagtggggtagttggttatcactttactgctgatttctaattacatttcagtcctgcatagctgatttctgagcccgtattctcaatcgatacaaatggtaatagtctgtcgcagtgtgtgcctctatttcccaatctagaggcagtgtgatgttggcttttttatattcagcaccacctgagagtgagcatttaaggatgtgagaaatgagacttaatgtcagttctcaggagtcagttggtccacttagagacatgtagtccctttcttacagacccctcttcacgtttggaaagaaggtgtttgtcttatgagccctctttgtcagtcaggacacatcatgttgacttatctaatcctactggtttgtagctacacttcggtttctgggtagttggttatgggcatatcccataggttgtgtggcactgaggaagtagaatattcaaagtcctgtcctggagaaaaaacaatccatctgtccatggaggctaagagttctagttagtttttcttccagttaactccactgccttcttgctcttcaaacctactgtttctaacaaagaggatgatgtatatattaccttctatattactatatatttagatattcttagcaagatacaaacaatacaaaatatgtatttgtcttgcttagcagtctagatgaatgcttcatctcccttggtgcctcatctgtaggaacacagtatcattgccttgtgacacaagtctgtatctcgtatctcatatctcagaacaggggcctcctttagactgctttcatggtctctatctcctcccactgctactggcaatacctttactgacacctcacacatacatcctgagaatagtggggtttaatttgttttccaaatgaatagggttgtcccctcccccaagtggactccagaacagtgtttcctttctgtgacacttccattgtttttaatgttcttacttccttgacgacccttaattggggtcttttgcagactgagactgactgcctttttcattttctcttctgtatcactaatgacagtgcagaataaagtggtacctaacattgtgttctgctaacctttctgccagatagccctatgcattgcattatctattagtttttttctgttttatggtcaattttctacccattcaagccactaaaaaatgattttccattatatgggtacaaggtaatcctgagacaaaacaaacaaacaaacaaacaaacaacaacaacaaaaaacagaccttcagctgtgattccagggtagggtagttgcaccaacccacagctgttatgaagcccctatctttatatagctgaatttgatcatttatatggacaacagctgaatttgatcatttatatggacaacagctgaatttgatcatttatatggacaatgcaggttagtcttcaactgtgtatgcttccagtgaggttacttgtactctgtgattcaaaaagttctggtcatttgtctaggccacagcattcctcaaaaagagacatgatacctttctaaggctgagccacatttgctgtagaaaaatctttgcaattcctttgcagcagggaaatttttgcaactcaagatgaagtggggcagggcgagaaggcttctttgactgcaaaagtatctgaaacgaagggtaaggcctttgtgtacttgtagtcatcattatacttcatgaatagctctttcaaatgaatcatattaatagatctcttagaactggaagggactttgaggctacctgatgtagttcccttctttcagctgagaacgatatttctttaatctccattttataggtgaggcaactgagttccacaaaaacaatgccattctgtagtctcaggttcacctgaaaacattgcatttgactctgccactgttcatacttagcccaccttttgatagtctgtcttattcactgctttgagctcatgatgctctccaaagagcccaaccaggttgttacatgctgtgcccctggtagggagaattttcatacctgactcccataattgagggcagatatgacacattcctgtttgccgatagagaattgtatcctttaatgaagcaatactttcctgagcctctggagctgcatgtggttctttcacatgcaacctgtcatttttccaaccctttgatgtattaaaatattgtttccagtgatatttcacagtgcacatgtaattatcaggtattggactctagaatttgtgtaagttgtcccatctaatgggacagtctattccttgcttacaccattcagctggatgctaaaactgttttgggaattttcacctacacccttgacaagactagttcagtaaggccatatttggtctttggaaacagaaagaactggattcaaaccttttctccactatgaaacagtgaccacataagtagctgtgttacctaggaaacatcactttaagcattctgtgcctaaatttccttatctttaatggaatattagtaatgtatgtctcatgggtttgttgagagaatagagataatgtacatatggaatttagctcacataatgactaccacatgtaaggatttaatacactattattattgttctcctcctcctcgtcatcatctctctatatttcagagttgctataagattcttaaacaaaatggtgtaaactatatagcagtttctcatctctagtagagtctcaaaaatagcaactcttatgagtatagttaattaaagcactggaaatattaaatgaagctgtcacatttcttgaacatggcttatttggtcacacaggtggtttatcttgaacaaatagtactgttcaaattttctaattcaagtccacatgttccagccagagagtagagtggtaaacatcatagaatcctttagaaattgatactttctctgaattttcccattaagtttctcagttttctaaatacaagactaaaacacactcccagaaaataatttcatttgagtgtagaactgtgacaaatgatatcaccaaggtagctaacaaacagatacacataattttcaaggcaagatttctagatgttctctggttacttggtcttaattatcctttgatgtcagcaaccatctgctcaccctttcacatacataattacccagccaaacttgtacactgtactggaaatttcaaggggttaagattaagaaagaccttgattctacttgcaatctccactacttgctagctctatgtccttggccaagtctcctaatgtgtctgaatatcagttttcatatctacgaaattgctataaaaatcatttcccaaccacttatccaaaatccttggtgccaaataagttttataattcaagttttgtgggctttttattttaaaaatactgcatgttgcataacaccttcagtgggacagaacccggtaatcaatcacatcaatatttctgcaacaaagcatatgaatagttacactgagagtgcctcatgtcaattcacaacaagttttgtcaccaggcaagttttagcaacaaacttatgaaaaactgtttggtcttcagagctttctagagtttgtaattattaatggtggactgaaacttgtatctgatcacatgagattgttctagggattacatgaaatgcattatgtgtagcaggggtcctgatgagagtgaattgatattctgacacatctgggtatgtgaagacccccatatgtttattttcttgagataatctgcagaaggcaaaaggctttatgcagaggagggctgtgtcagaaactgaatttgtagggatggaggagcaatctgataagatatgatggtgtttgttctccaaggacagtaaccaagtttgaaagtctgagctagggtggtgggagtgggttgttggggagatgttgctgcagtaagaagctgaagatgtttttctcacaggagcctcactcagatacaggttagaagcaatattgtttcagtgtccaggtgacaaaattatagcacagaactgaaaggggcattcctacccttctatgtagacccattgttggtttcagacaaagctgccagaaaagagggcagcaccatttaagcccctcagggatgtgtagctgggagcacttcagaatccatactcccccacagtctagcgggggcctccatgttcccacagccacaggtactagtaccatcagtagctggactgggttggaggggctaccactatctttcattagaaacacaagctctgtctagtgaaaatggacacataacataccaaaacttatggaatgcagcaacgttccctattaagagggaagctgatagtagaaaatgcctacatcaaaaaagaagatcttaaataaataacctaacattacacctcagggaactagaaaaaagaacaaactaggcccaaagttggtagaaggaaagaaataataaaaatcagtacagatacaaatgaaatggagaatagaaagtcagtagaaaagatcaataaaagtaggagtggtttttgaaaaggtatacaaaattggcaaatgtttagctagactaagaacaaaggagagaagactgaaaatcagaaatgaaagaacacattgcaactgatgactaaataaaaacaaatgatcataagaatctactatgaagttatatgccaataaattagataacctagaaaaatggatacattactagatacatataatctacaaatgttaaatcatgaagaaatagaaaatatgaacagacaaatggtgagtaaagacattgaataagaaataaatagtcccacatcaaggaaacgctcatggtctgatgccttcactgctaaattccaccaatatttagagaactaataccaattcttctgaaactctttcaagaaatctaagaagagggaatacttccaaactcattttatgaggccagaattaccttgataccaaaaactgacaaagacataacaacaataaaaaattaactgcaggtcaatacccctgatgaacatagatgtaaaaatcttcaacaaaatactagcaagataaattcaacagcacattaaaaataacattctttatgatcaaaaaggatttatctctggggtgctagaatagttttacatacacaaattaataaatgtgatgcaccaattaaaagaataaaggacaaaaaccatatgatcatttcaatagatacagaaaaagcatttgacaaaattcaacattctttcattataaaaactctaaatacattaggtttagaaggcactatgatttggatatttgtcccctccaaacctcatgttgaaatatgattcccagtgttagaggtgggggcctgttgggaggttattggatcatgggggatgatccctcatgaatggcttagcaccaaccctttggtgataaacgagttcttgctcagttagttcatgtgagatctggttgtttgaaagagtctgagatctctccccttgctctcttgttctcactcttgccatgtgtcatgcatgttccccattcatcttctgccacgattataagcttcctcaggccctcacccagaagctgagcagatgttggtgccatgctttacaggctgcagaaccgtgaactaataaaccattctttacaaattacccggccccaggtattcctttatagcaatgcaaaaatagcctaatacagaaatttgataccaaggagttgctgtaaagatacctgaaaatgtggaagcagctttggaactgggtaacagataaaggttgaaaaatttgaatgttgcagaagaagacagaaagattagggaaattttggaacttcttagagactcattaaatggttgtgaccaaaatgctgatggagatgtgggtagtgaagtccaggctgatgaggtctcagatgtaaatgaggaatttattgggagctggagtaaagatcattcgtattatgccctagcaaagaattaggctggattgtgttcatgccctaggggtctgtgtgtgtttgaacccaagagtgatgactttgggtatctggtggaaggaatttctaagcagcaaagtgtttaagagatggccaggcagcttataacatcctacaatcagatacaggagcaacgaaatgacttaaagttggaactcatatttaaaagggaagcagagaaaaaaaatgaaaaacttgaagcctagccatgtcacaaagaaggaaaaggtattttcaggagtggaattcaaacaggctgtggagcaatttagattatcacaactaaaagggagccaagtgccagtgtccaagataatggggaaaaggccttgaaggcatttcagaagtctttgggacagctcctcccatcacaggcccagaggcttaagagtaaagaatggcttcatgggccaggcccagagtgccaatgccccgtgacacctcaggaggctgcttcttgcatccctactgctccagctccagctgtggttcaaagggccctagatacagctcggaccactgcttcagagggcacaagctgtaagccttggcagcttccatgtgatgttcagtctgcaggtacacagaatgcaagagtgaaggaggcttggtgacttccacctagatttcagaggatgtatgggaaaacctgaacaaccaggcaacagcctgctgcagtagcagattccctgacagagagcctctactatggcagcaccaagaggaaatgtgaggttgcagcccacactcagagccccaaccaggtactgcctggtggagctgtaggaagggggttgctgccctccatacacaagaatagttgagccagcagcaactcgcatcctcagcctagaagagccacaagcactggactccaacccatcagagcagctacatagtctgcatctagcaaagccacagaaatgaaactgcccaaaaccttgggagcccatccctcataccagtgtgccctggctggtggacatggagtcaagggagaatattttggagctttaagatttagtgactacccttctgggtttagacttgcatggggcctattgccctttccttctagccaatttctccattttgtaatgaaaatgtctggtcaatgcctataccgccattgtaccttgggagtgaataagttgttttttttatctcacaggctcataggtctccagatgagactttggactttggagttgggacttttgaattaatgctggtatgagttaagtcttggggggactattgcaaaggcatgattgtattttgaaatgtgagaaggatgtgagatttgaggggccaggggcagaattatatggtttggatattcgtcccctccaaatctcaagttgaaatgtgattccaatgttggaggtgagacctgttgggaggtgactgaatcagaggggatgatctctcatgaatggcttagcaccatactctaagagaaaagtgaattattgtgcaattcatacacgtaagatctggttgtttaaaacaggctgtgtcctccccgcttgctctcttgtttccagctcttgtgatatgatgtgtctgcttcccctttgccttctgccatgattgtaagcttcctgaagcctcaccaagagcagatgccagtaccatatttcctgcacagcctatagaactgtgagccaaaataaccctcttttctttataaattacccagtctcaggtatttcttgatagtaacacaagtgaactaacacagaaggaatgtattcaacacaatgaaggtcatgtatgacaaacccatagctaacatcatacttagcagtgaaaagttgaaagctctttgtttacaatcaagaacaagacaaggatgtccactcttgccacttctgctcaacctagtactggaattcctagccagagtgattaggcaagagaaagaaataaaaggcatcccattcagaaaggaagaagtttaaatggtttctgtttgcaaatgacataatcttatatatagaaaatcccagaaactccaccaaaaaaaactcttggaaattataaattcagtaaggttgcaaaatgtagtactgctactatacactaataatgaactatccccccccaaaaaatcaagaaaacagtctcttttataatagcattaaataacaaataagatatactatttaggaataaagaccaaggaggtgagagatcgctacactgaaaactataaaatattgatgaaagaaattggagaagatacaaataaatggcaagatgttccatatacatggattggaaaaactaatattgttaaaatgtccatactacccaaagcaatccacagattcaataaaatccctatcaaaattccaatgatattttttcacaaaaatagaaaaacaatcctaatatttgtgtggagacacaaaagagcctaaaggaccaaagaaatcttgagtgaaaagaacaaagctgtaggcaatacaatgcctgtcttcaaaatatatcacaaaactctattaatcaaaacagcatggtactggcataagaatagatatatagaccaatggaacagaatgaacagccaagcaatagacccacacatttaaggtaaattgatttttgacaaagatgccaagaccacacaatggggaaagaacagtctccttaataaatggtgcgggcataacttgatatccacaggcagaagaataaaattagaagcttcactcataatatacacaaagactaagtcaaaatgggttgaagacttaaatataatacttgaaactgtaaaactactagaagagaatatagggaaaaacctctgtgacattgatctgggcaatgatatttgacctatgaccccaaaagcacagacaactaaagcgaaattagacaaatgggattacatcaagctaaaaatttctgcatagcaagggaaacaacacagtgacgagacaccctatggaacgggataaaatatttgaaaaccatgcatctgatgagggattaatatccaaaatgtataagaaactcaaacaactcaatagcaagaaaacaaataacccaattaaaaaatggaaaaaggacctgaattgaattgacatttctcaaaacaagacatgcaaatagccaacaagtatatgaaaaaagctcaacatcactaatcaacagggaaatacaaattaaaaccacaatgagatatcacctcatacttgttagaatgactattatcaaaaatatggaagataagttttggtgaggatgtggagaaaggggagcctatgtaaggcacaccttcttttattgtactttgtttaattgtgctttgcagctatcatagttttttttttgttttgttttgtttttttttttttacaaattgaaggtttgtggcaacactgcatacatcaagtcattcagcatcattttccaacagcatcttctcacttcacatctctgtgtcacacattggtaattctcacaatatttcaaactttttcattattcttatatctattatattgatctatgatcagtgatactactattgtaattgttttgaggcaccatgaactatgcccatataagatggcaaacataatcaagaaatgttgtgtatgttctgactgctccaccaaccagctgtcctcccatctctctccttctccctctcctaagccctgcctattttctgagacacaacaatattgaaattaggccaattaataaccccaaaacagtctctaagcattcaagtgaaaggaagagccgcatgtctctccctttaaataaaaaactagaaatgattaagcttagtgagaaaggcatattgaaagccaagatagacctaagctaggcctcttgtaccagttatccaagttatgaatgcaaagtaaaagttcctgagggaaactaaaagtgctactccagtgaacacatgaatgatgagaaaacaaaacagacttattgctaatatgggcaaagtttgagtggtctaggtaaaatgtcaaaccagctacaacattccctttagcaaaagcctaatccagagcaaggcctaactttcttcaattgtatgaaggctgagagaggttagtaaagtgccaaagaaaagtttgaagctagcagtgattagttcacgagatttaaggaaaaacgccatctccataacatgaaactgcaaggtgaaacagcaagtactgaaggagaagctgcagcaagttacccaaaagagctagctaagatcattgatgaagatggctacactaaacaatgaattttcaatataacaaaacagccctctattgggagaagatgccatctaaggactttcatagctagagaagtaaatgtctggcttcaaagattcaaaggacaggctgactcttgttagaggctaacgcaaccagtgactaagttgaagctaatgttcatttaccattctgaaaatcctagggcccttaagaattatgctaaatctactctgattatgctccataaatgaaagaacaaagcctggatgacagcacatctctttacagcatgatttactggatattttaagcccactgtttagatacactgctcagaaaatgattcctttcaacatattactgtttgctgacaatacacctggtcactcaaatgttctgatggagatgtacaaggagattaatgttgttttcatgcctgctaacacaacatctcttctgcagcccatggatcaatgggaaattttgactttcaagtcttactgtttaagaaatacattttataaggttataactgccatggatagcaattcttctgatcagtctggacaaagtaaattgaaaaccttctggaaaatattcaccattctagatgccgttaagaacatttgttattcatgggaggatatttaaatatcagtattaacaggagtttggaagaagttgattccaaccctcttagatgactttgattaggtttaagacttcagcagagaaagtcagtgcagatgtggtagaatagcaaaagaactagaattagaaatggagcctgaaaatgtgactgaattgcttcaatctcatgataaaaattaaacagatgaggaattgcttcttatggatgagcaaagaaagtggtttctcaagatggaaagtactcctggtgaagatgttgtgaagattgttaaaataacaaaggatttgggatattacatgaacttagttgataaagcatcagcagggttggagatcattgacttcaattttgaaagagttctgctgtggataaaatgttatcaaacagcatctcatgctacagagaaatctttcacgaaaggaagagcccattgatgtggcaaacttctctgttgccttattttaagaaatttccacagccccccaatctacagcaaccaccaccctgatcagtcagcagccatcaacatgcaggtaggaccctccatcagcaaaaagattatgagtcactgaaagctcagatgatcgataacattgtttttaacaacaaagtacttttaaattaagctatgtatattgttctttagacataatactattgcatacttagtagactgtagtattatgcaaatgtaactttcatatgcactgagaatccaaaacatttgtatgaatcacttcattgcaatatttgctttaattgaagtggtctggaaccaaaccgtcaatatctccaaagtatacctgtacactgttggtaggaatgtaaattagtacaaccattatgagaaacagtatggagggtccacaaaaagttagaaatagaaccactatatgatccaaccatcccagtactgggtatatatttaaaggaaatgaataaatatgttgaggatatagctgaattcccattatgtgcagcattattcacggtagtcaagatatgaaattagcctacgtgtccatcaatggatgactggataaagaaaatgtagtatatatacactatggaatactattcagccttaaaaaggaaggtattcctgtcatttgtgacaacatggatgaacctggaggacattatattaaaggaaagatgccagggacagaaagacaaatgctacatgatctcacttatatgtggaattttaaaaagttgcttaactcagaagcagaaagtagaatagtggttaccagaaccggggggcaaggactggggagatgttggtcaaagggtataaagtttcagttagataggagaaataaattcaagagatctactgaacaacatggtgactgtagttaataagaacatattgtattcttaaaaattgctggccaggtacggtggctcatgcctgtaattccagcactttgggaagccaagtgaggtggatcgcttcagcattcaaactcttgagctcaagagttagagactagcctgggcaacatggcaaaaccccatctctacaaaaaaatacaaaaattcaccaggcgtggtggcacatgcctgtactcccagctacaggcagaagtgggaggatcgcttgaacacaggaggttgagatttcagtgagctgtgaatgaaacactgcattccagcctgggtgacagattgagaccctgtcacagggtctcaatagcaagagaactagaattagaaatggagcctgaaaaatgtgactgaatttgaaagaaaattgctaagacagtagatttttaactgttcttactataaaaaaaagataagcatatgaggtaatgcatattttaattaggtcagtttagccactctacaatgtatacatgtttcaaaacatcatgttgtacagaatatatgcaattatttatcaattaaatatatatgttatatgttatatatgtcatctagaatttttcctgacagatgatagacatttagcaatgtttttaaatggatgatattctcctgtatatttttctcctccttccttgatacctgactgtgagtttcttaaaggcaaggagcatggatatagttctagctttgtatcttctatgtctagcatgcttcttgacacacaataggtgttcaaaaataaaaggttgttcattgcatttaattgattttacattttaaaattgataatacattttaaagacaaaaaataagtcataaaaataagaccatcacaatgaaaaattacgaagaaaataaaattaaaaaaaatgaaagttccttaataagaggaaggcttttggctgtcgtggtcccctctggatccccagtaactgagcaactgcttgtgactaagaaacgtttgttgatcgaatttgttggcagttgacattcacgaagagagtgagagtggaagaacaatatgaaaggactgttcctgacaactattagaaataactgggtagagcttaagggggactgaggctctctattacataggtggggatacaagtcagtgaaatttgagttatgaaagtgcatgccatttcatttgtaatcaaggtgaggtatggcctgaggaaacttgaggcctaacactttataaaggttcaaaaatgtcttctgttgagttctgggtattagatagctaagcttcatgtagacaccaagtgggtcttggaaagtttctcattataaagaagaccttgggggtggggtaagtgtggacaaacaagggcttattctggcaagttctcattgggcttagttgctccatttgatctttgtgatgttactttggaagaagaaaggggcaatagtcattggttgggaaaacaggaaaaaggaaaccagttttacttggattattactattaaggtgaattcatttgcacccatgccctggctaagcatggggaaatgcaagtgatatatgtcaactatctagaatttttcctgacagatgatagacatttagcaatgttttttaaactgatgatattctcctgtatatttttctcctccttccttgatacctaaccatgagtttcttaaagtcaaggagcacggatatagttctagctttgtatcttctatgtctagcatgcttcttgacacacaatagatgttcgaaaataaaaggttgttcattgcatgagacatgttgatgattaggatatggattattatatgcaaattagtgccaaagaaatatttaaaagaaattattttctcccaaggtgatttaatcccatctgatatgaacactaataatttgcttagctaacagttttttgtttgaaacgcaaaaggtaagtttattccaccctaggtctgggattattacaaaactgagttggctagatccaaatgaatgtggttttcctgtttggttttcttgtcatggctttttactttcctttcccataaatcaaaatacagcacagaaagtctttttcttcataagatttggtatgccatggctactggtttcagttggctcacatttcctaagtaatcccttacctcattctggttcatggctatttttaataaggccttcatgacttgctgctctcctaaattagtttattcatttgtctgcaacttgactttaaaaaggctccacttgaggaggctcaaatcattattcattccatatcctctctcacttatgacaaggctagattttgttccctttctctgttcccagatttattcatatgaaccctctctgttccttaacctcttctttaagtggaacatttcctcctttcctttgccacctgaaatatgctctaaacattcgaactgatgaattatattcttgtttgtgtccttccttcttcctctattttcatctcagccatttcttggcctctttgatctactgctacaaataagacattgtctctgaatgtttcattctggaaggtgcagctctatgctcttcacagtaagcaagggagagattctccactcatgcagtacctacaattgctctacgctttccccattgcatgaaccaactcttttctttctacagcatgactttcacttggttcacaaatactgcatgccttttggtgcttggcagagtgctaggcattgaacagagagtggtgatcgtggccttgccagcaagcactgatcttatttatttagtttatggacagtcaactctttcaaccatgctatggataaaagcagtttcaaaattatttttatctttttgattgcagatgtactcatcctgattaatcatacattaaaaattactttgcatttcttgcggtataaaattcaacaaccctatagtgtgctggagaactgactggctggtccattcaaatgtgttcatggaatatccacagggggccatacaatgtttgtcctatttttcttgcacacacatttctattgcttcctgtattagctatctttgtaggcatctggagggcaagggccaggtctatttgacgtgaattgtagggaaactaggtcagaggcacatcactcttttgtgaatgtgttatatattcaacagattattgatttactggatttaatggattttcttttctctgtgctttataaggaaagaagtaactgttaaatgaaacaaaataagcacaggctataaatgtttagccctaactgtgaggagggtttaaacatgggttgcttatcttctgtgtcttctgtccttattgattttcatattccaccctcagctcaagctatgcatttgatattgttgacttctagactgctactttggggcctgcctcccttgctgcgatgtggatggatgacacccattttttttctagttaagcagagtaactgataagttctgatgtcaagtttgtcgatgcttcacaaccagggaagtttttaactacattgtctgacagctgagtcatccagcctccaagcctttctatgatacatttttctttctaattcagaaactttgaaactatcccttcgccaactcaggggaatgtgtggggctttatgtttcattttagtgccttccttttttgtgtgtgatttggtgcagtaaattatctgaaaaacgactacccctttttataggagctttacaaatgacctactgagtaaatggcctagtccatgtctctgggccgatatagaaacagctttgggctctcagttcacccaaaatggtctggggagagaatctccttagatgaaaatgtattttaacttttttagtacaagcaggctttccaaaggtggcagaaagcatggaacttatcttaaagtactgagttggttttagatgtaattttaaaaacaagataatttgattgtttaaacacgacagtttttttttaaagtaatacgtcatagccaatcaaaattcccaagccagaaaaaaatgtttttttcaatttagccagtctgctttaaatctaggatatcccaggggcttggctaaactagccatgagattgctccccaaccccactgtcacctccagccttttaaatcaaaaagcataaaaatgtatggcagcaaagaaagatgctctgaggcagggactagccttgactcctaatatggtcagattgcaattaaccagaggatcagcagctctgttaggcattttaaatttctgtttaactcaaaagccttatttttgtttgaagcttcttggagttgagtcttgctttaaagtatgaatgcagaagtctgcctttgaaaacatggtgtggattactgaaaagatggtgtgaatgactgagaaccctggaggtcgtgggtatcagaaccaaccttgttgggggaaggactctttagcagtgtgatttgcaatttttcttctccaaaatatccctctttcatctactccccagacgcctgcagtggtgtctacattttcacctctgcaactcattcctttgattgaagcattgttgcccactccagaaaggttctcctaaaatacacagaacctaaaaggagcaataaatgaaatcgataagaccgtacagcaaagaagtcaatcagattgtctcctttctagatacaggaaggaaacgggcagtgactgtagctcattgggctttggggtatctgggagaagtccttaaaaggaagactggaacacaggaaaggaaagaacacaataaaactaatttcataatatttttaagaataagcctgttatgtccatggatcattagcttaaaccgtagagagaagactgtgatgtcagcttgtgtgtgtgtgtgtgtgtgtgtgtgtgtgcatgtgcacatgtgtgcactgggcaggggggcggtggggggtgggcacttttttcaaagtgcaatataacaaaaaatattattctttgaggcgctgtttgtgggattctagatagtttagattttaccacaaatctgtaagagaaagtaaggaatttgaagattgtgtcatataaataaaacaggatacactcaccatcaccctcccctaccaagcaaatccaaataaagcctagggttgggggaagaatgataaatcctcagtccccacccccaatatagttgtgatagatgtctgataatttcaaccggagtgtagggagaatggtgttctgtctctttacctctctcttaagaacagaattaggggatgtaaattgcaaaaaacctgagttaagagttctttctggccttacatggtggtgaaaattaaaaagggtcaaagacaatctcacgattagtgagaaagtacacccttcccaccccctgccatctaccaatcccatttacaaagacgccccatgtctttcaaaacagagcccgcaaattaccatgaaaatctgccccaacagactgtgctcaagtagaagtcagagcttttgttagcaggggtttgtgggggatggcaccatagcgaacacagttaagcctcactaattccctgaatgagggaaaggccaatcttgatttgtaagaagcttgaatttgaaaatatgtttaaagaaatgccatgttattatttctaaaaacctgcagtcaaactgctggctggggtctgtgctctgagctgcctagactctcaaggcctcaaacaaacagataaggactataattagcatattggtaatttgaatgcaaagtgcacttagagtggcgctttaaaaacgtgtgttagcgtactctcctagcaggctgtcacttttctatgtttatagtattaatttgcctagcaacttgccccctttcctttttggcagtaaactttagcctcacatgtcagaattcgttaaattttccatattagcagctggaatgaacaagtaagtgtgtgtgtgtgtgtgtgtgtgtgtgtgtgtgtgtggcagggtttgctgtgggagagaggtggtgaaccactttttaaaataattatgaacatattgtaaacttctattctgctgacctttaaaattcatcagttaattgatatttatttattgagtagggaatgtattctcttggatgattaaaaagggtaggaggggcaagctgtttcaaatgtccttcccctacaagtggtcgtatcaagtgaacatgagagaacattgactgtaagaagttcttgcattattacaaaaaaaaaaaaaggattgattatgaagtgcaacaggtgcttaattatatgaaacaacagcacactgagatctgcatctatcaaacacatcttccatggtcagccaatcctgtgtgcacatattaactttgtttgtaaattcacacttgagaccacttaatttgaagtgtgactgagttctgtttgggaggggaaaacagaagagaagattaatacagcttcagttttacccaaatattcaatatcttcatcattttgctgtggacgtggaagaaaaaggggatgttcattaccagaacgaaccatctggtaatcaggacagggactgcaaaaaaaaaaaaacaaaaaaaaaaaaaacagaagacaaaaagcaaacaaacaaaaaaacctgggtaaagcctccaagaagatcaaatttaatgccttctccttgagaaattccccccaccccaccccattccacttcctggccttcttcagacactcagagacatcagacactgagggagatcaggagagaataaccacaagcctgtggaagaaaaatagtccttaagtaatgaaatccctaatacagtggttcccaaattttgctgcacatcggaatctgagattagaacctgaggagattttttaaaaatcctagtgtccagattcatgctatccaattaagttagaatgtctaggggtaggggccaagcactagcattttataaaaatcaccaggtggttccttgtgcagccaaatcgagaaccactaccctaatgctttcccactttacatgcatttaatttatatttaaccttcccaattaccctaagaagaaggtgctgttggatccctcatttcacagatgaggaaactgaggttcagagggactaaatacgttgtccaaggttatcaaactataaaatagtgaacctgggatttgaaggccagcggtttaattacagagactgcatgctggacgtctatgtaataatgtccctcctggcttttgtccttgtatccagtaccattacactaaatttgatatagaacaatcccacatcaatgtggtgagagtttattagacatctgttatgtatatcatacccattttagtcacactgtgagcctctaggtagattctaggaaatatggctaacttctgatcattcaaggggttttctaggtaaccctggcttggttaccatttgttatggtaaagcttaattagccaaagactgtcagagacaagactatagtcccacaaactcaaatttattgtgtggtttaagaactgagtatctccagtaataaatacaagtagcaaagcaggtttaaggcatcactggtaagaaaggagtagtcactcaaagtaggcggtgtagttatggccttttacaactgccgtgtgaccttgggagaaagtgttttctattaactttgcagctggctttatctgtccattctcccagcctgattaatggcagggctgctttttcttagctcaaactgactttcactctttcagttctggggaagttttgactttttcaggttttggtccttttcagaaagggatgagcccgagaaaaatattgacattcagattaactattaataatgttgctcctcttcagccaagttggtaaaatagttaatggaaaaatgtatgtaaaaaccaggcaagtctgaataaagtcagtatttgagttagtagtcatatactaatgtcagtttccagggatttgtcaatgtactgcggctgtgcaaaataaaatcaatataatatatcaaaatattgggggaactcggtgaaagataatgggaactctctgtactatttttgtaactttgtgtaagtcttaaactacttcaaaataagaaagctataaaagatgtttaatgggagaacaggtttgtgttgattatctaaataagacttttctaaattagtctgactttaggcttttccatgaataacccaaaattggttgtaccagtgttctcttttatgcttctagatttgaatattgggtactgtagtgatatcagtggattagtcaacatccatatccaccaggtacagatccctttgggattagaaatataagaccagtttgttcatcaacaagatgccatttgagtagagtctggaaatatgtgttcaatatcattgggtagggaaaggagggagaaagttgtggtaggcagagggaagatcaggaggaaaggcacagagatatgaaagtcaaggcacatcaaggaaacagaggaagtttgatacggctgaccctcggggtataaggaaggagtggtgggaaaaaaccctggaaagatgagttacagctggagtgtgacaatctggatgtgattctcctctctgtgaaattaaagaatttagacttcttttgtagtacttactacatctgtcttgtgtcatagtttcctgggtgtatattttctcttcccaactagattccaagtttcttgaggagatgccccaagtttgactcacctatgtagcgtccgtagcacctagatgtgtgttttgcacttagtaggaactgaataagtctgtcctaggaatttctaatgtaccacaaagacgccactgatattccctctcaagaacatctggagccccacgagaatatagagtgaggtgtttacctccagggaaatgaaagtcgcaagcagaaaagcccacaaccaatctccctcaatctctcttcatgtagggctttggggactgggtttggccatgccctaccatctttgacacatagccctcttttccccggaccatgcccataatgaagccccttgaagagaggtaatgtgctttgccttagtcaatttggcattccactcacacctccctctatttagctttactggagggttgcagaggttcctcactccttcaccacctgttcctcatgtctctggattatagtggatacatgagttcaagagggacctggagagggtagatatggaactcttcaagattgtttccaggatttgcctgacataaattgtctgagaggatctccaccatttgccttttggtgatttattttctcttcgcctcctgagagaaatgttctattgctcaccatttcagatggttgggtgtggggatgggggcacttctgttcctgacaacctcattatgtggttatcaggagcagacactgcccaggttgtcacgacaaccagcaatgattcaaagcttccctgaaaggtctgtatctccggcaaataatcagcctttagctctcagcagatgctgaactgagcagccaatcacaggtgagctggaaaaacatgacatcatagtccagccggtccaaaaaaaataaaaataaataagatttggttttctctttacttccttcattctttatcccctagattttgttttctactttctccttctctttttccttcttagtaaaatggggagagcaatgaaaccaactttccaaattcaattcactctgcaggttggacttaggttccagtagtgcagtgattgagatcatgtaaggaaggaatatataatatgatccacttgggagaaaaatcaaacagagcatcagctcaattaaacaatgtggtttgatatgtaggaccatggtggaagcagggctaattaaaaccaagtcagaggagaggaactttctaattctcatattaattcacccagagccacctggatttaattgtcttctgcttttccttcactaactccctggtggaagggaacagggcaaaagctgggggcttcagaaagctcgtaggttctacagggcaggtctctaatgggggataattgtagtgaaagaaggtcaggagaaatccttcattcccaagctgccaccatttagggagcatatgtaaatgcgactcatcaagtctattaaggagatgtatagctcagaaatctgttaaatctgcttttgttccattagctgtttgtatccatacaacaatccaaggagagaggcaaggcgagttcgacaaaggagaaaactagtgcccagcgaaatttgagtcttgttcaggatttcctctccagaggctggaatagaacctgggtttcctgatttccaggaaagaactcgaagacccaagagaatggtaacttcccagccatgggctttcctctttccctcacctctgatttttcagagacctaggacaagacctcttggcatctctgatgctccttgctctttgcccagcaggtaacccacaatgctgcctgccacagaagagcttgagacccctatgatgggcatggggaggcaggaaggaaggggctccattgcaccagactgcagtaatggcaacgggttgtagtgagcggccctgagtgaaggaggagtaggcactgtgctcctagccaatgctgtgcaccagctgccaaaccccaggttcttttgtattcaaagagtggggacactttttttttagtgcagctgctgtagcaaaagatgtgaagactgagatccaaacagacccagagtccactactgggaacaacttctggctgtgggacttgaggcaggggtgggaagggagcaaggaaatctgggttgcttttgcccagtgggttattcattactgccttgcattcagtgcctgcccaggtatggctcagctcagtctggcacaccatagccttgattgctacacctgaatcattgacctggcattcagacctctttcaggatagcaggggtagtttgcttgcttttgtcttaaccaaaataagactgtatttcctatttccccttttaatgatgtttcttacaagtaaaatatagcatatgcttattgtaaaaacatacaaacaagacagtagtatataaagaaaagggttaatgtcccccatcatatacacatacccacatgtctttcctaccctcttttattcccagagtgtcccctttagcagttaaaacacacacatacacccaattttttaaacaaaaataaaatcataatacacgtgctgttctgcattttttcactcaagaatgggtcaaggagtattactatttcagtacagaggggtctatatacttggttttttaagctgatgcatagtagtccaaaatatgtatctaccataatttatttaatgattcacttacttgggcaggagaaaactttgggaggtgatagatatgtccatgccttggatggtggtgatagtttcacaggtgtatacttattcccaaactcatagagttgtatacattaaatatgtacaactttttacatggcaatcatatttgacaaagtggctaaaaaaacaacagttcccttactgagggacatttaggctacctttcatgtaatatttttcattcttatataatattcagcataacatatttcaacatttcttgacatgtttttatgaatatattcataatcagattccttgagttggaattgctgggtcaagtggcacatgcattttaacatttcctaagtactacccacttgtgctcccaaaaggttgtgccatttacactcccgtcaattgtatatgagagtgagcaatgttccttttatccaggatttgactgaaacagtttgaagatattcatttcagtttacttctgttattaaaagccccatcccagcgcttctcacttctcatgtgaatcaaggggctagttgggttggtaaagacccagagaagatatacaactcaagtggccatatagggtggcagaacaaacatagaactgagaattggagacctggtttccaggaccatctctgtgaagcactggacaggtaacttcaaacccctgagtctccattctctcatctatgaaatgcagatcataataattgccatagtaaactgttgtggttgttgtgaggatcagatggggagatacaaaagtggtttgtaacctgagaagtaggatacacatgccaagtggttatgatggtagtgttgtaatacccttaaatcaaagagctcccaagcaagagaacagtgagttgggtggtaaaaatggtgagttgaggggaaaaattacacagatgaaatctttaagatatttcagattggaatcccttcctgagatctcccatgcagttgccctatattcttggagaacaaaccatgttgacagtaaagactgctttctcgtatcaagaataacataggttatcaccctttcataggaagaccctaggcttgggtcttaagtccagtcctctttctatgacatcactatgctttgtcagtcacctaataggattttgtccacatgctactttctacaatcactagggagaaaggaaatacacccatgaaatgtttaaataaccatgtgtggtgactgcataaatagctctgagttatagctgaggtatatgggaggattagagtgaaatcaaataccttctcattacaagttaaatcaatagcctagaagacccaagttaaatcattagccaggaaaatccagttatatttttctatttcttaaaaaaggttcttgtttaacccaaataaatgcattttacaaatcagagatgttaacattgaataaattacattcattttgatttgtgatttttttagattatttttaccatggtgtagaaaaaaaccagtgggatgtggttgctttttttttttaactccaaagttagttaaaaagatatctgtaaaatcactggagtcagaaccatcctgattccaacttattaatgaaggatttgagaaagagtgttgtatatttttgcattaaagacaaccacgacaccaaaaaagctatttttaaaaatgcctgattttttaaaaatgccaatcttatatagtctgtttcttttaaagcaagtatgtattttaacaaaaccagtaataccacatttaattcttagcagtagtaaactgtatcatattagaaaaagcatggactttggactcatttcgatacaaatcccagctctaccactttctacaatgttaatgtaatactcatatatgcattaatatatatattttgaatttaggaaaataaaatgcaaactgacccttaaaaatggtctggattacatcgtttacttagtctttgcctccctctttcttgttttggcatagagtggatcattgttgttgtttttctcaattccctgtatcatcacaatttaaaatgaatcagtccaaaagaggcatcccattcttcaactgcctgagatgttttgtctggcgaatctgtagctctttttttttttttttttttttttttggagacggagttttgctcttgttgcccagactggagtgcagtggcgcaatctcggctcactgcaacctccacctcctgggttcaagtgattctcctgtctcagcctcccaagtagctgggattacaggcgcatgccaccatgcccagttaatttttgtatttttagtagagacggggtttcatcatattggtcagactggtcttgaactcctgacctcaggtgatccgcccgcctgggcttcccaaagtgctgggattacaggtgtgagccaccgcgtgtggtcatctgtagctcttttgtacgacttttactaaaaggacctgggcagatatattagttcactcttgttcttgaaacctattttgttggcattatggagaaattattgctggatgttacacagtgtggagaaaattgaataaaagttcactgggaagggtcatgatctattttggccatttaagtatgtgaggatatatttatctttatgaaaataaatttgaaagtagaaagaaaaagttactcataatactactagtttaacccaacggttacaattttatgtcctcttctgatcgttttctgtaggcatattttacatcattataatttgaatgtccttattgttttgtattatttgactttttatggcagcttactgtcgccttgctgggattcaccataatttacataatctagccaaatcatggggagtatggattttggagtagcaagagattatttttggagttagattttataaagctttggccatctgcaaaaatttgaaccgtatcctaaagacaagagaaagctttgaaggtttaagggaaaggatggacagagagaatcgcatttaagctccatttgaagtagagttatttttattttttgtataattccttgctttttggaatgtgtgtgcttcatatgcagaaaagtagtttcccgatctagactgccatctctttgaattccactgccacatctgtctctcttagttttctgtgtattttagagattccgtcagtttaacctgcctggctgacaggtggtgtcccaaatcgaaaccgttttttcccccgaataaagtgtgcccgtgtagctgtacagatttcgtcccctgaaaattcatctgaaatctcaattctcctgaggggagcaattaaggaagatacatgaactctcccctcctctccatcctgtcaggtgcccctcttttttgatggccccacctctgtctagacaaccctgacagtgtagaagtttccatctcctttccctttccctctccatgttccctccccttcagttttttccccctcccaggcgcttcctgcctggaaacaaaagattggtccccagtagcccactcagggcgattttagttttatgctcaccatctgattggcctaggtaaggtgcagagctcgggtgacgtaatagcagagaagggctagggagcggttgccgagcaggggctctaccgcgggcgggcagctgtgccagctaaccgtctgggatctcgcactgggggctgcagcttttccccgcctcgagccagtgtgcgggggcgggagaagagccagggggagcgggctgggcccggggctgcggctgcggccgcggggctgcggctccccagccccgccagctggagcgctcggaggtagaggaaaggtcttgacggggtggctggatccgtggcaggtaaatcccgcgactaactgcacccgggctaccgcgggggagggggtggctgttggatgatgctttaaggctgctgggcagatgttctgcctttccggacccccctcctgtcctgtttgtgccccagcctcgagtctcctacgtggctccccggagccctgagaccaagcgagcagtttgcatgatcccagttcgcggacaagtgggtgtgtcagggccgttcccagagggccggggctccttcgcttggtcaaaccctagactcgtttactggggcctgggccgcttgaggcaaaacccgccttgaaagctacgtcagcctgtaagtcttccctttcacccccccgcccgcccccctacccagccccagtagctgtgacagcagttccctagaaaaggggagggggtgtggccacggtctggccaagtccggggtagaacccccccgccccttacacacacacacacacacacacacacacacacacacacacacgaggaaagagaaaaagtgacgattttcttaaacgggcgccttcccctctttcttttatttttctttatccccctcccctttttttggtggggggatggtaataacagggggacccttttcttctcctgtggggattggaatgatgcaataacgcccccagaaagctcagggtccctggattggccctctctttgtctggggagcagtgtcattgggtccactgcctctccttctctcctgttccccttagctcgctgggggacattgccctcagtttgtgaactggctctggcaagattactgccgcacttttgggtgaactgaacattttagattcttactctggcaagttttccttccctaggtggtggttaaggggtggggtggggtgggggatggtgggaagagggggatgcaggcaaggagagagatagaggccccacttgtttttttttttttttttggtcccacctttcagaatccagttccagattctagacttgagggttctgggctgttggtctgtagaagcgaaggagagaagggtgagtggcttggctttgggaagcatgatgggggcggttgcagtgctatttttaaaaaacggctttcagcagggaagcctttagccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtcagtgcggttttcactgggccatttgcaaaattataattgggcaagatctgtgatttggtacttgaggcctccaatcaggggcaactttgggcaaaaagacttgatatggtaatgaatgactaacaggcagaggcttggagagagagccatttgtaagcctctgtttctggatacaagtgtcatatcccccagcccatgcaagaagcaaaatgggaagagactaggaggtagcctgggcaagagctgacagctgagaatcctgaggtcagagagaccttaggatgtcaaggagctgaccctgcaagtctccggacaggcagctgggccttgtaggagagatctgacaggaaaaggaggttcacatgcaatagggttataagctaggggacacaggaccctagggacattctcaccagctaaccattcccacaggttgcagaatttcctggtcagaggtggaaatggtatatagggcaaacaagtttgctgaggtcttgggagagggtgagtggtggacataccaggtgagggaaacgagaaataaaaagaactgcagggatgggaaggtgctgacatccgagagtttgctattatgtgttcagagactaagctactaaattaaggttaaagaaggtggccaaggcaaaaaaaaaaaaaaaaatcaggtgtacagatcagatgtagtaggcaggaaggcaggagcaaactagagagagagagaagaaaagtcgtggccttaccaacaacccaaaagccctgaattctctggtgagataggcaactctggaggttgaggcagctgtagctcagccaagaattagaaggatgattctagatatttaaaatcaacagcatccccacccacgtaacccaccttcaggaaccagtagctttaaccaagagaacaagaaactcaatgagcagcagcctcaacaactggctctttcctcctgggtaaggagagggcagtggggaaggacggtgcctcaaagggaagtggaggcgctatcaatctggcctagacaggtaggttgactgcttttacatgggtgggctggggcctggtctgggacccctgctcaaaaaaaaaaaagaaaaaaagccctccttctcaggatccctggggaccctgtgtgcgcagggaactgtgtaaaacctttacttcggaaggtaagtgcagcgttctaggcatctggggcgtacttaagcctccgctacgcgtcccccacccccacccccacctgccgggggctaggcgtttccctctgcagggcctggaatggactcgtctgccaagtcggcactacacagcttctccagcagggggcggaaaagggcctgcagcgacgcgcaggacccgagtcctccatttcaggtgtgatgcttcagcctcggatcaaataatagccacacatttaaaatctcatttagggttaccggagaaccaaatgaacctccgggtgtggcagtctatttccatttcctcccagatatgcgtcgcttcctaccgcgctctgtggctttggaaggcatttgcatttacctacgcggtgattatttgagtcactaatacacacagcctaaccgggggtttaattggaaatgttaatcagtgcaatagatctgtgtctgatttccacatttggtcagttatctgcaggttggagcaatctgtgctaaacccaggggatgcaatgaggagcaaaacggtgcagctacagctgggtctaagtctgggaaacataatggggagatggaccttgaaaactggaaagagagtaacaatttactggtgggaagaggaaatcattagaaaggtgtagtcacagagaggcctgattgctgagatggaataggatggccttggaacccacatggtggagagggaggccagagtttttctttgaggttggagggggctgaatttggagagtgaagttttttaggggccaaaggaccaggaactggggtggaatgaaccctgggagtcagaagtcaagtgttatggagggctagggcctggtctgggacccccaaacacactgtcccagacagtgacagtctgggacccctgttgtgtttgggggtcccagacagtgtgtttgcccctctctaggcctcagtttccttgtctttcaaacgatgaacttggcactagttgttctataaggtggtccatttattcttggtaatgaagacaggtccactaaagtatagccctcttcttcccctgtcagaaaaattaccccttctttttttgtatgccctccagttttagggaaaacaatacaaaacaaccccacaaccacatatatttcatctctttcaacagtgtggctttacttttacttcatgtgaatggggaacaggagggaaaagagaagtccaagttaataatctgctagggaccctataaccaagcccctgaaaggttctgtgtggctgggtctcacagacctgagtggatgggtgggtggcgtatattcactagtggcccttactccctaactcaatctcaaaacagaaagtcttgggatgaaggtgaaggaagggcctggcttagggcgtatatccttctccttcgtgccctcctcccatatctcactgtgagccccaggcactttttggaattcagcaccctaaaagaaacactatccttaacaatcagcacaacagtgccctctagtgaccttaatggggacaattttaagagctccccatgcatccccggtcccagcctggtcaccagtgcccttgtgcagcggttactccttgtggagaaggctcccagtccttccaaccagcctgacagagaaactcagccagccaccgtttcctgcaagtccttctccttgcatatatggatggggctgggggttcacagagggagtcagctccccacaacttcctctccagcgttgtttcctttgggcctgaaaaaggttccaaacctcctttcctagacagcttcggtgctgagcaagatacttggcatgggaaggctctgtggtagacagagtagttgtccatagcttccacctacccccaccgccaaggtggcagccctagtccccagacagagattctgtcaggaagttggaatgcagcaaggtggctgggggtggagttgggttagtgatgggtattgggtatgtacaagatgtgtgcactgatttctacctcagtctccaacaggaggctgagccataggtgtacaacaaggcggtataggcatacaacatgatgtaggcacacaatgcccacaacactatacagacacacaacatggcataaagatatgacacaatacgaattagacacattgcacatacacaaaggatggaagagatgcaattcacatgcaacacagtacagacacatagcactcacacagtagcttattgacatgatcacgtatacaacatgatattaacaggacactgtacacacacacgatatgatgcagactcaatacatgcatgtcatggtagatatgacacagcacacatacacagacatacaacatggtacagggaactgtgcagatatacatgacccagtatgcacatgtgctcacacacaggatatctccccttgccctactctcaacacaacacacccccaggcaggtgagaggagtgtggctaccaggtggaatactgtgtcctgtcagttgattctgcactgactcaagcaagtggtgaaataaaggcaggttgccatggagttaaaaagtggtgctacaattgaggctggggggagggggaggtaagcttcaggaaagctcttgatcttgctctaaaacatggaggttcttggtagtacaggttgggggtgtgttctccttctcttacatcctctagtattgtttcccaccccagtgggtggatgctgcctctgctgtctgccctcatccccagagatgggcagggggcttcttgaggccattcttcctgtgtcctccttgagccccacccctctctggagctttggcagcttgcacccctctccccctcaccccaccctcttgcagggtgagctcacgtagggagggagggggcgagtacaccattcaatggtgcagtgggtgggatttggaaaggctgcctggagtgtgcatgtgggaagcacacatggaatgccagggatgctgggggacagacatgctctggagtcttgcccaagagcaagaggcagacccagagtatggcttggagttttaattccagaagggggaattggagatcatggggcttttcttggctccctaaggcttcaattttgcaatctccgtgtttagatatccatctagccatctctttggattaggaccctgttcattctggtctgtaataaataggtgctagcctgaatcatgcctccttgagaattagcatgtagtttctgcttttctttgaggacaaacaccactgtgggaaggggaaaggaaagcagagtaggaaggattgcagagcttggggttctacaaagagaagatcagcctctcccttgagaggctcaaatgattgtgggaaaaggcagaaagggaggggtcaaagagactcagtctccttcatggttagacatggaaacctctgtgggaaaaatagggtaaattatcaccaagcaacaacagtaaacagtatgtattcatcctaagaaacctggggagtactgtggaagacttacctggtggagacaggagaaggtagagggaagctccaattagggtcagaggctggggccttcagcacctgtgagatggtagcaaattaggagacctcagaatgctgttgcctggcagacagactttttttccacttctccagtgaaagaggttagtgaaaaggggaatggaaatggaggtggagacttagagttgagggatgaactgaactgaactgaatgcagtgccacaacatcaggaagctcacatattcacagagccaaccttcattggccattgtctctcagtttccttttgtccactggactctaccacctcctgtgattatacacattgctccataattatgcagactatgtaaatatttcacatctgtcctatttgatttagttcttccaacacttacccaagtcaactaaggcaggccttttcacttgatactaagcaggcccagaatgatgaggtgactaacagcaattctcagcttgtaactcccaactcctgactcccacttccgtgccctttctggaatcctatgtaacaatgcctttttacacttcttagccctctgattttctagctttcttaagagatattctgaaattcaccagagagattgagaaagagagagagagagtgtgtgtgtgtgtgtgtatgagagagagagtatgtgtgtgtgtgtgagagagagagagagagagagatgtttggtgggagttggatgagggagcagtagcaggtggggaaagaggttccctctcccctacaatgcttctctcagcaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggtgagtaatggagtccagggcagggagttagggatctccaaatccaggcaaatgctgcttttccaccagatctcccaatatcaaagactctgcctagacctcgtgagctaggcctcagggcatgacccctatgttctggggaattttgcccagtacagctgcctttagtctcttgcctccctcccatctctaatatgggaatgacagccttgacctacattttggggtgaggaggagaaacaacataacaatcgttgccaagtccgttgcagatgtcaagcaccatctaagagcttcagtataacacagacatgcttcccatcaagctgtcattttcttttctcctcctttcctggtgcctgggtggcttttcagccacatgctgcaaatttgccattcagttcctatgatttctactgccccataaccttaattttaccttcctgtttgaagtgtacccccaccccttccatccctgcttctgggcctgtcagacttagcttaaaccttcccaaaccttccctctgctttcccacccaaccaagatgcacttcctccaccaggtctccaacagcacttgagtctgtagcgtgcagggtagcacttgctgccctactgccttaaataagtcttgcatggtttctggagtattcatcttaccaggaaaactagattgtaagctcttcaagggcagggactagatcttacagatctctagtctcccttaaaagggctcaaaagttccccagcagctttgcaagttgggcctctctctcttcctctgcatttctttcaggtttcatggcctgtctctccgatcatctatttgtttttttgtctgcctttcaggcaggcattataacttcttctgtcagcttctccatctggcctctgttgctattccctgcagtccagctacctgcttgtagcttgctgtccctctgtctggtcttctgtctatcagttgcttaggcatctctcctattacccaaatcaaaaaacaaccaacaaaattaaaaaaaaaaaacagaaaaactaaacaaaaaacaagcaaggaataagcaatgtagttccctttcacactgagcatacaatgcgcctacagacaaggtaaaactgcagctcagcagcaggtgtttctgtgatgccttcttatgaaagggaagctccagagtttcagccatggaattgaaggtatgaaattacagccttgttgatactgatgcattcaactttctagcgatgttctggtaggggatcctctttaggccttgacggacagaaggtaactaggactgactaaaatgagaagcccctgaatcgctctttggtgttctgtgacagatgcaataataacttgtatttattgtctactgttgccagctctgtgctaggctctttactggcatgataccattttctcctatgataatcttgcaaggtaggtatttttttttctaatagttattgctgtttctgattatacaagtgatactagctgaagttaggtattatcatcattactgttttaccaaggaggagatagaggctgagagaagctaagtaacttgcctgtaacagaagacatgctgtggctttgggaagaaagagacttcctggagagagtttcccagcatccaaagttattttggtatctttagttcatgcacatacacatacatactctcacaagcacattcttgtactcttgtacattcacacagtcacatcatcccctgggctcactcacttttcatactggagtcattcaaaatgatgatcactcttatgccctcaccctcacacacaatcatatttacatacatgctacatttaggtacattcacactgccacaaattcacattcacgtattcacattttcatattgatgcacacaacacacttaccatacaccccaccctcatgttcacagacactcacacctttgtgctattaatatcatattctcacacacacacacaatcatacactttcacacttacattcacacagaggatacaatcacctttgcctgcccaaattcctgtatagtcatacatactctatacacaaataatacattgacattccccctgcacacactccaactgtttcttatactcacagccattcatacactcaatttcatacactccagtgtacttgcattgatgtcatcactgtttcttcctcacagtcacaaacttatcacagggacacaaacgtgcatacatgctcatatatccacgtttatattttctcacatcataagcaccatctcacccacttgcacttttacacttagaattacacacttttgcattcacatacacagagctaaaacaacctccctactcctgatacattcacacataatcacattcatacatagaaacacacattttgccacacattcacactcacacactcactttcttcacactgagacatcatcacactctataccaaacttgcaggcacatacactgaaatacaaccatacacacatatttttataaactcagccattttcactgaaaaccgtcactctaccctctcaaactcaagcacaatcacttacacacacaggtatagtcacattgactgacacatatataggcttattcacattcagtactcatacaaattcacataaacatacatactgcacatgtacttaacactcacatattcactcactttcacattcacgactgtacactcaaaattatacacgcccttattcccacagacaagcactcctccacattcgtgtacatgcacatgtgtaccccctcacacaccatcccccactcgtacatcacacattttcacactggcccaatcacacttaccacacactcacattcttatacattcccactcttctactttcatactgacacacccttactcacttcgctacacacgtttgcaccagtgcacatataatgacatgcacagtcactgacttgcattcatgctagcacataccacactgacatacacaattcacattgcaatagttgactgtgcttcacacaggcaattactgataccacatatgacaacatagactcacactcacaatcgccatgccacattctcacttacattgatacacttacactgacacacctgttcaggaagtcaaacactctcccgtaatccaccatgtactcttactcagactctcacatgaacacgttgacacttaactaccactgagataatcacattgacccacatctattcacattgattcacacatactgctagtgacccacactctcactcatacatactttcccaaactcttacacatccccctcccatcccaatagccctgcatttatatactttctcactgacacacacacacggatacatctaattgcaagaaatagtttatattcacagttgtctcttttttctttgtttgccactagtgctctcctcacccctgctgaaaggttatattggcaaccagttgccagaggaaaaatgttggtctcatccaggaggtcaatgagaaatagatcctttcagagcagaaaggagtagaatttatgtctaggattaaaaaagaaaaggctcaaacccacagatcaagttttccttatcctttccacatactttttcttttttcagaaatcatctccaatacagccttagccagtcctgtccaacacaggttggagtttagatggtgtgtttattttctggaagtttatggcttaacttgctacctcatttctttcctatagtgaaaggaagatgaaggatgtgtttctttatgtgctgttaatggtttcttatgcaaaagtgcatgtctctggttttatatttatgatctggaattgcctgctgattacacacatggaaagggcaggcctgcttccaccaggcacctctaatctagccaggtatacttaataccctgttaaccctggaacatggcactcaaggaaaggaaagagaaggttaatgaactagctggatgataaggtaaatttgtactgtaagtgttcatgtgcgatagtagaccccactgaaatttcaacagctgttactaacaagttacaagaggagatttttcagtaggcgtggataaagacaagctgaaggaagtttcttgcacttcagaaagactgtagatttccctgcaagtggataaaaagaagcacaaacccaggagtgaactaatggatcaggagcctggtgcaagagtcatgtgccaacagagatttgaaaacacaagagcatcttgcaagggtgtctctagtacatggcttctcctgctggagtcaccctggagcaaaaaatgagttcagaatatacccaagctgccatttggtatgggttctagcatgccttagggaagagcttattctctggaatataacccaactccctgccattagattgagaacttctttgatagcaagaactatattatcttactcattttggtttcttgatgcctagtgcaatgctaggtccagaaaagctacttgtgagactcagttaagaaactaaaggggatacctgagcaggaacatcttatcaatacagacccagtgtctctcttcttctcttcctcaatcccagatttgcagtggcattaccagctcagattgaggattgtctgtaggccccacatagagctaggcccagagattcaaatgggtgaaagacacacctattgcactctaaggtactttcatttgtgtgggaaagatcaagttgccatgaaacagtagtatgaggcaacagtctggaagcttgggcatggagggatctttatcatgaaatccagtggtctgtaggctccaaaggtcttgacggttcataagtagttggggacagcagtcagaatttagagaagtcactttccaaagtaaacttccttgtagatagcttgcttagcacagggctgtgccatattcccagaagattgtataacagagtactctgttactgggcctaaagtggagtaataagagtgatctgcagaccttagtgagattattgtacttattaagatctaaccaccacctcctccaagagacagcttaagacaggggttcccaaactctggactgcagaccagtgctggtccacagtctgttaggaactgggcagcacagcaggaggtgagtggtggatgacaagcattacttcctgagctccacttcctgtcagatcagcagcaacattagattcttatgggagcgtgagccctattgtgaactgcacaggcaagggatctaggttgtgtgctccttatgagaatctgatgcctgatgatctgagatggaacagtttcattccaaaaccaccccattgccccatgtccatggaaaaattgtcttccacaaaactggtacctgatgccaaaaaaggttgaggactgctggcttaagagaaacagctgggcaattttacatttggaaatttttggccattacttcaagattcaccaaaggcaatttatataatttgcaggactggctgaatattaggaagagaaaaatgcacctgcctgagtgtgcttgaattcagtgagaagcactgagaaaacccattcccaaacccatcatgcatttatatgatattttatacttttaaaaatgtttaataacccattcttccatttcaatagaggtgttaggagcaccaactctggtatcagccagaccaccatttgaatcccagtttggccacttcctagctgtgtaaccttgtttgagaaattatccccattgcttcttaggccttttggctaagatcaagtgaagagaaattacttatcccccttaagcctcagtgtccttatgtgtaaaatgggaatgacactaatgtcatctacctcatggagttgttaagaggatgaaatgagataatatatgaaagtgtttagcaaaatgtctggcttatagtaaatgtttgacacagtatagagcttattatctttaccatagccctttgaggtaggcaccttcaaagggacagatccttgacataacagagaaacagtatggttctttgcagccaaagattgattttcacaggacttgttgcctgttttcctttaagtctttatttctgcctagccacaagctaggtgtcagtattcattcccactcaagacgatgagtgaaaaataggattagtccatggagtttcctcaactactgtgtctctttaggacatgtttatcttgcagaaatgtgtcctgttcatttagctatcccctctagtcctacttccacccttgaaatcagtaaagccatcagtgatgccacctttatttgccagtacccaaacttgtgggggtggtgagtagaagagattcctaatgtaggtggaaccagcaattggttctcttaccataggcattcttctgtccttgattctgattgttgaaatgtctgttttgtgggtggaagatctgctcattttcaggctttcgtcccaaacgccacagtggaagcacagtttacttacgacaaagccctaagaacattcatgttcatgtaaaagctgtgagtaactgcagaatttaatatgaaactttccgtgacttaggaaacagaaataagtgcacgggcattgatgtcacatagacatgggatggtataatcttactattacatttactagttctgtgaccttggtcaagtgacttaatgaatgtgcttcttcatatgtggaatgaaaatactgtaataacacctcaggggttatgcaagttatgtgaacttgtacctaagtaacttttagcagagtgcgtgggccatgataagatttcagtgaatgatagcgattttgtttatggcttgtgaaatctgtgaaaataaactgtaaacatctattggtagaatgtcttgaattacttcaaagcagttcccaaatgtggatatgtgatcctcacaatctactggtgacgtgatcaccctttctagatgaagaaatagcttcagaggggtgaagagatgtacctaatgtcacgcagcttgtgagtggcagtactaggcttagaaagcaccagttcagatgattgaatatttgcaccttcacttggtaaagcctttgggggctacagttagcaaataagaacaatttgaactgagcataatccttcttgtgacaaaaatatctaaatgtgagctacagtttatctacaaatcgaaccataggtgtttctctttgtatcttgtgcaatgcccagaatgttgcaagagtgaaacaaatgtgacatcataaatgtttggaaagcagtacctttccaaacatagctgagtgacatagggccacagtagtaccattcaccaccaagaggaaaatctttcttgaggcataaatactgtgtggttctgctcatgttgctccagtaacaccaaatgttcagagtctgggaattcttaaaacatacggagacacttcaacagacctgtggtgccacttggccatttctgtcctgacatgagaattataagacatcaagcttagtaaacgttagggagaggatgggaggacaaaaagataggagcacttttggcctttttgtaacatttttctcatagccaaacattcaccttgaagcactcttctcttggtttctatgacaacatatcagttctcccgcctctttgaccatctttctcagggatcattagtcactcttcctcttccaacctctaaatgttggtgttccacagagatctggtctagtcctccttctcattgtgtattcttcctgagcaattgtgcatattcccatgctgatggcctccaaacaaatatcttcatcccacatgtccagctctccattgaacagtttcataatgccaaatgaatgtgttagaaccactgctacaattgtatctgtcttaatattgctatctctgttatgaggaatagatatagctagagatacagtttttccaccacatgtgaattgatgtttccttcaattattttattacttgccatgtagattatacttttcaaagacaagatgcttagatatgtgtcttgcttcccactagatatttctagttaagtttttactgatatttctattgtgtcactggttttatcctcttatctttgcctgttgtagtcttgatagtattattatgtttgttggtaaagtctggataaaaatttagatgaattttctataaaacttattataagtgccgttctattggccaaaaatattataataatttgttcttattctctttagagtgcaattattacaggtggtctaatggttgctaatacaagggacttccaacacattcatatttgttatcagcacactaacttcattagttatttttcatctccattctaagctattcggttattttcatttcacaaacatggaaactgaggcacggttctatttggaatcccaaatgtaaactaaagcttgcaaaaaccattaggccattaggcctcccatactcctctgggcctcttggcatagaaatatatctctaccctgatttccatttggggtcctgagaacagttaatcctatcaaggctggcatctctaccatctttggccaatgtccactgtagagacctctcttgacatctctcttctcctgtcttcctattcccatgctgcatgtgctttctgtctcttgactgattatcttagtgttgtcacttttcaaaatgatttccatgttcctacctggaacatctgactccataggaaaaacctttcccaagtcttcaaccttagacatctgctacattgtcacctgagtaatagttctgaaattcaaagttaatcatgctatctcaccacttgaaacctcttcatatacacaagaggagtccaaaccttgtagaaacgcatattaaacccttcttaattcgtctctatggatcttatttttttccattcctcttttttgtccctaatctccttaatacacgttgctgcttgacctgaaaaatggtgtggttaattgttcttcctaattcaactcgactgtacttcccctgtgaagcctgcttcgtcaggctccagggagtctctgtctctgtccttctatagcaaccttttctcatctttgcactgagatgtcatggctgacatccattatattttaagtctcttcaagggcggggtcaactttgttcatctctcaccctagaacctggtgaactcctactttcctttaataccctgttcaagtgctatatcctctgaaccctccaggcaccattagctacccttcttccactgtcctttcaaagcatccaatgcctaccttagcacataatagacaccatataaatgatgaataaatgaataaatttaagaaggtttaatgatttcttcaggatcacagaaaaatccagaagtagagctagagttagtcattcattccttctgttagaaacaattcttttgggtttataaaaaatctactaaataaaaatcaaccccccaaattaagtctgcctaacaacatgcaacttagttcttaaatgtaacatcgaaggtaagtttctttttccgagtgttatgtgcctaataaatttccccaaagagatctgtcctgcttatatatggatacagttctaaaaatgcttttaggtcttacacatattattttcttccagagttttgagatctattcttttacttatacagcaccaatatcattcagtccagcagaaacaggcccaaggctaataaatctaatctagcatgcttgaagtattcattggttgaaatatactgttgaataataataccttatgccaacctagtgcttcctacctttcaaatcctattgaattcctgctcatccttccataccctgctcaagcgctatatcctctgaacccgctgggaatattagctatccttcctgctctgtccctccaaagcatcttgtgcctacctagattgtatcacactgtattcttattgtatatatgcatgtctgccttcctcactagactagaagctctttgaagatagagatgtgtctttattcttctctctttgtatgcttcctgtacctgacataatacctagtatatatgaatgttggtggtgggaggatgtaaggccaggcagctatgttccctggaacaatatcaaacacattccttgtgtgtggtagtatgatttcttatatagcaataagatgaagagagtcttgcccttttctgaagtgctgtagctcctctttttaaatttttactctcattttgcaatgcacatatccttacttgttttgtagttctatttttgtctgtatatgacatactttttttaaattatactttaagttctagggtacatgtgcacaacatgcaggtttgtcacatatgtatacatgtgccatgttggtgtgctgcacccattaactcgtcatttacattaggtatatctcctaatgctatccctctcccctccccacttcccccaccccacgacaggctccagtgtgtgatgttccccaccctgtgtccaagtgttctcattgctcagttccaacctatgagtgagaacatgcggtgtttggttttctgtccttgcaatagattgctcagaatgatggtttccagcttcatctgtgtccctacagaggacatgaactcatccttttttatggctgcatagtattccatggtgtatatgtgccacatttttcttaatccagtctatcattgatggacatttgggttggttccaagtctttgctattatgaatagtgctgcaataaacatacgtgttcatgtgtctttataacagcatgatttataatcctttgggtatatacccagtaatgggatggctgggtcaaatggtatttctagttctagatccttgaggaattgccacactgtatgacatacattttacatataatgtgtggccaggaatgaaacccactgctggagcctataacctcactcagagctagacacttatttatctgcttacacccatcacttagtatgatgcctagcacataggcactggtaaatatttgtggttcaagtaaatgaattcatgcacagatgggttacttaaggggcctcaataatatattctcagttactatctgtcacctcaaagagtagtacctctctgttttgggctcaggattttttgaaatgaaagtcaaccagaaatgaacaaggataaagcattagttggtatattttcctgtaaaaaggaatgttgggctgacataagatcttttcctctctttatgcagctgtgtgacctatagaccttcattattaagctgtgcagaagagtatagggcatgcctaggtgatctgctaaaggccacaaaaccaactggtgattgactggcataattgggagtactatgacgtagaggatttgtcaggctcaatcttgaagaaaaaagaacactctaagatgagcatcatttgatacagagttatatacatttattatgaacacccgagtttcctcccctttctctctgcccagtgcctttgtcagaatgtgctctaggctacactgcagtctccgcaggaatgagtcaagaactactgactgatttaccctcaggcctgctgattacagctccttccaccaagccctgcttctgttttatctgcagttttcctcccaaaataccctaacttccttcttgtgtggtaagggctgggccctgtgatctcagcttgggggcttcccaggcccacagaaagacttaggcacacagcagtctttgctttgtatgtatatgagcactagggaagtaaagctgatcttgtgctgtggtagacatctactctagcatgaactaaagatgaaccatatattctataagtggacagcagcagctgcaaccaggtagtaaaataataagcattgagccacttgcaaattatgaacttgtataagctgggcatggaaaggccatgggaaaaccaacatactcaatcatgagttcgtccttcagatcaggcttttaatttctaaagagactgctttgggtgtattataatcttttttaaaatacccatgccagttttctttaatgcaaaacatttgtctggtgggcttgaatatggggaattcctacaagtaaggcccttgtcagctaaatgtttatcccccaccattgtgaagtgggatgggtagaaagtaggttttgtcatgtttcattcttccttcagtatttaagaaagcctgtttttaatagatgttatttcctcttccttaaccatagctcccaaatgagatgtttaaatgcatgctcagtataataataatgaaattaaaaaaagtatgggcatgtaaacataggtcaaggggcaaaaacttgaggaagtgttgctgcattttacaccagttcaaattctttaacttccatttctggcaagaagtcacttttttggtgaactgtgagatttgctaaattgatctaagttcctagtttagaaataacaccaaatctccattgccccaggtagctcttctcttcagatgtgaaatggacaccttccctgtagaaagctgatttgggtacagagaaattgggaatagagcaaggacctaggatgatgagccatgatgcacagtttgaaaagcaacattcaggcacctctgtggtatgcaaaaatctctaggaaattcaggaattgaatttccaagcttaaatttgaggacatttgttgatatttcactggggtggatcaataaagagtataattattatccatgcatagtaacagagacaatcgagacccccagagactcaagacattggtttgccatgtcctgcttgcttgggatgttaatctatctaatttgttccatctgaatgcttccaaggatgttatgtgctctgagaactaggaaatgttttcttactaagttttgcttctcttttcttttttccaccaatttctctgaggcatctcttagggtaattacttttgttttttatgcttaaaatatttctacctctattctttatggatcttattttctctttttagaagcatcaatattggaaacaaaaagctgaaacctgtaataatgcatcggtttgcaaatataagtacatgtaagataatcattagcattttctgggcattagctcatgaagcacacacaatgaataataaagtatggtgctgcatatgtttagaggcttaagaagtcatttgaaaaataactatacttaagaaaaagaatgattttttccttatatgcagtatatggagtctggatgctggattatacctattgacttcctatttgcaacctgacgttgaaatttgcaactataatatgctggcttcttggactcaattaatgtcaagttcctgctgaaaacaatggaagtcactcataaaaatgttagcagacaacaatactacagcagaactgacctcatttgcttgtttgtatgagagagaacatgaatgtatgctgtgtgagtgtgcttgtatgtatgtcagcagtgagctatctcttacatgatctaagattgaaactaggtggctgtaaaaagagctagtgcctctctttcttgtctggctgcttttgcagatctcctgcctaacaagtagctcagctccttctgatcaaatgatcttagaattggcttccctccattacacactgtaatggtatctccctagtgaggctctctgaaacagcacacccctgtctctgatagcagagttcccttggtgagtgctccagaagaggcgagctccaaaacgaggccatctaagaattggtacaactggccaacgaaacttgttggagtgttgtcagtaaatcacctagccttgtgtctttaaatgggaaaagccatttgaaataagtaagtaccagcatgaagtgggttgaaatgaatagggtagacctgtcgtatgaatattttaagaggataaaaatgtatatatgaagagtgtgtttgtgggtttacttggatatgcgttgtattggtgtactggaaagggaactgatgagtttaggagctgagggattggatactattctcagttttttcatttgtgaccttgggcaagtacttaaactcaaagcttgtaaattcctcatgtaagaaatggagatgatactttcttcttcgcaatgttgatgtcaggctcaaagaagagcaagacgtggaagccctttggacattacaaagtcatatgtttttaaaatgaggtgttggtaatcagatggtagctggctttgaaatgatgcctaactacttggcagttagactagtgctgatatttccaaatatgctttcttgtctctgacctgctacaattaggtctataggcttatgtaacattatgaaaaacttactccaagctgtaacaaatacataggatgtatagagttccattttgttactttacacatgtatttaatgcctgttggtaacaagagactgtactagtagtatgaaagtgtataattacgactgaggggctcttaccctcatggaacttatgatctaatgaggggagtgacttggataatgactgtgcaatttgagacaagatgatacaaatggtaatttgggcccatctagctggctatagttagtggttgggctgccccttttccacctagtttgggaatggtagtgtgggttcagagctgctaggagacccagatctggttcattcttctccctgtaaaatgcccgctttggcatcttagtatattatgggcattaatgtctgaaaagtcactagaaatcttcagatgctagttgctgtagaaatgcaaggcaacgtataatatttctttcaaatcctaagacattgtctcctttgtggaaggctagatgattttttctttttttggcagttaaaaatgttcactacatcttcttacattatcagtcataagtgaggtggttggttcttttgtaaataacgcatctaagataaagtggatttagtatcagcataggctagttagcaaagcatggtttgtttcccagtcaagtctatgcctgaaagctcagctagccatctcgaaaatgtatgcctttggttaaaagagagcccaagaaagagccagcagttgtaactcttggattttgttgcccaccaccaaaagtacaattcagatatatatatatatgtatatatatctcagattaggaaattcaccttggaaatttctcttagtgaacagctcagtcctgtgtttgatcctctcatttgctatgaaaagggcgttaaacagccttggtgtgtgctcagatttgtgataatagccttgtgtggctggtggttttggagattttcttctgggtttgttagatcatgactgtacattgctaacctggggttttgtttttaaaaggatggcagtgttaatttagttttcattggaaaaatataaaaataaatagttatgtctaaatatgaaatagttatgtctaaatatgaaaataaatagttatgtctattttgaaagcagacagaataatacagacattattattctacagtttgcaggaccatctattaagccatgagcaattgaaataaatatttttatcagatatcataccatcagagaaatagggctttactgcaaagcattttagagaaaaaactattaccaagatgcatggcaactatagattaataaagctctgtgtcaaggcaagttaatgaaggtcactctgtatgtgttcttgtgtgcccctgtgtgtacatgccttcaaacttgtgtggggagtggggagaaagggagagagaaagacagggaaagagagaggtaatctctcctagtactctgaagaaaaggggtatttaggctctttgcctatcatgaaacaagaggcttatgtcttattgctgatgaattgcaagtgtaattacagagcattgctaaaccacattaagtcccaagggctgaataaaaaaatatacaccatctacaaaagccatttaaattatctctgaaaaacctagtagtcaagtatgaaatcagtctgtgagcagatataaaccattgctggttatccattaaaattagctccacaatgctaagggccagtctctaaaagaaaaatgaatggcctgtggctatatctaatgtgctactcacaagtttctgtactgttacagaaatgaacaacaacagttgaactttaaagataaacagttttttttatcggattcctagagaataatggtgcttatgtacaattcttgaaatagagcctacagccgcccaaaataaaatagtctctttcaagatcttggaaataatgacatcataggcagattgaaccagcaatccattaatagtatcctttatagaaagctgtctcaggggaacacatggctaagtagattggcattgtttataaacataacataataaaatccctttttaaatatgtttgtggaatagtaggagatacttcccacttgggaaacaaatactttaaccacaaggattccttgcaggtccctaccctttctccattggtcttctaaaagtgtgcttagaggcacttgatttgaaggtgagttaaaataccaaggacctcctgtactattctttcaacagcaaagcagaattatctggaatcattagcagaggatgattggttgtgccttgtaatgggtagtaaagaaccaaagtaatatcaagataattaaaacaaaaccatatctgaactgtctaggaaaatggtttggttcaagctttattaagttcctagtgtggacctggacataggttcttcagtttcacttgtgtctttgtaaaaggtgtattccagctcctcttatgatgccttgattagttgaatgacattgaaacacttccagtttggtgggcaataggaatgtatgtcacataagctgagtcctttgcagaatgtctgtgatactgaccatggcaaatgtgtgttattgaatttttggtcagggatttttagtgcaatatagaagagtttagtttgagttttagatcccaagtattcctttcttcccaacccatattatacttggtcaaataaagtcagggtaatcaggcagcctgaaaggaagcagggcatctacctgcctctctggtcagatggagtaattaggaacaaaaaaggccactctgttgttagccacacctatttatcaagaacaaaggagcatagcattttaaattcatttgagctgaaaccctggctggctcagactcttacttgtcttatcacgcaagatcagctttgtatatcattttaaagaggtcgtgtggcgtgttttcctgacttctgtcatctcaagttaaatatgtcatcagaaaatatatatcatccagaaaatggtggctctctcttcctgtgagacactctttttagaaatttgtcttctaggtatttctattttaaaatgttcagtttctctgcaataactttcaaatttcattatttttaccaagctagattttgtatatctgtatacatatttatgtaataatcacttcatatttgcacatagtttttgaacccagaaaagtaaaagagaaaactagtgacttgtctctggtggcaaattttctctgtgactaaattaaaaccatgaacctgtccagtacagaataatgccactggtgaagtcagtcttaaattcactttaattctagagaaactgtgaatttagaaggaccaaaagtcaaaatgcaaaagataatgcagacacattagcactggtctcatattccagttcaaatatttactctagtaccgatagtatctctgaatatactttatccttgacatcacaattactttttcattgtaccttgttctgtagtttgacctaaataggaaaatgtaaggtttatgaaattgttggtgatagtgacaaaccatttattacttagtattttcactatcattattactgaaaaaatatagaattggtcttaattcattaagataatgcaagacatgacacttagcaaaacaaaagcgatctcccgttcaaatcaaaatcaaaccaattgttagttgtcaatcacctgtgcagatggagaagctattaattgatagtaacctattcttgagtaattacagactgtatatgtttgagagaatttagaacaaaataaaatttttaaaattctctacctaacatgatgtaacttagagtgcattactgagagtaataaacatactataaccactaaagggccggaaagcattgatagataatttttcagcacaacagttaatgagtagacccctgtttttgtttttattgttcttaggtttgttcatagtaaatgttgtggaaacaaagtgataatgctaagtcatgtttggagagttgtaatgttcctaaattagtaccaggtaatacttgataagtttacagagatatagttttaaagggatttgattttccttgaattcaaactggggattcatttggaaggtactattagtacctgacttgtgctggggtcaggaccttatggaaggacttgaattagagtaggaaaatacctggagacagaaacattcccttggggagttcatgcttttccagtttactttatcctcccaggggaatgaaaaccaaatatactcagatgtagacacaagatactaaagaataatgaacttggccaggcgcagtggctcatgcctgtaatcccagcactttgggaggccgaggcaggtggatcatgaggtcaggagatcaagaccattctggctaacacagtgaaaccccgtctctactaaaaatacaaaaaaaattagctgggcgtggtggtgggtgcctgtagtcccagctactagggaggctgaggcaggagaatggcatgaacctgggaggtggagcttgcagtgagccgagattgcgccactgcactccagcctgggccacagggtgagactccatctgaaaaaaaaaaaaaaaaaaaaaaaaagaataatgaaattcagagcaaataagctcctaaaacccagactggatcttacagctagctacctctgtcacctccctttttccttcttccaagacgtaaaatgtggcagggagtaaggttatggtgtctcctcgggaactggccctccaacatttgcccacctttatcttctgcctgcttgggagaatatggaacattgtttaccctaacagcacactccaactctgttgaaactgccagatctatgggatggtttctcggttaattatcataaaaacaggagagtgcattttgtgactgaggtacacacatgtaagaaataaacaccaaggacatctcgatgttaaagcagctaacaagtcattgttatgggccattaaaaatcaacagccaaacctgtgtcaattccaaactctgaggaggctgatcacctgaccactacaatcatcaggatagaattttaaaataagattgtaaattgttcactaaaacactgttagtggggaggagaaaatagagtttcaatgtgggaaaagcaaagggacttacatatttttataatatttgaaaagccattaattactgccttcactttccttttttgaaaattgcatcagggtttttgggaggtaacttccttccctccagaagagaaacccctaaaaacgatcctcacacaaaacctgagaaaacatgagagcaatgcttttgtttctaagatgttagaatccacatatttattaggtttttagacctcttctccctcaactccttttttttccctccttttctttaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaagtaaagtatcagtggccgggcattgaaaatgggctagtttattctttcattttcactttctttcttaggtagttgtttcttgaggattgactgttcagggcctgccggccctttacatctacgtcttcagaggttgcattttgtcagagaataatgtttgattgatttactgtgggctgacagaaaatacatttacactatgtttgcttttcacataaaattaaattcatagtgttaagccaagggtaatcatagcaacagtactgtcttgaatatatcaacagtgactttctttctgataatgtagagtagaatttacaataatccctccctaactataagttgttctttttggaaatttgggtataggtaggtttacttctgtatacctttttgataactgaaaattttgaattcagtatatgagaatcagtccacgttgccacaatattgtctctctgactatattgtaagtgggaaggcatttctgagtcatttgtttccattatcattcttcaacctgttttcccctagacagccccatgtgtactgagtagcacaccaatatattataatttatccttctggtgtttgtaataccatttggtgcttaaatgtcatatgctaatgctttgtgacgtgcagggatatgaaatctctagtaagtaactttcaggttacattaattagcataaagctgaaacatggcttctacagatatgaagcaagtacaagggcactgacaccatagaaacttgtcagaagggcaagaagggtgatgtctttagaagagaaacaggacattctcaatctacttcttcaaggtaaaataaatagctttgtaggtcacttatatagtgttaatcaatctacaattcataccacaaagaaagctgaaactattagtatggccagtactgccacttgtacacctgcataacttaaaagatgctttgttcttcatgacccaaggatggaaaagatggaaatgaagttaaatctctggattgaagataaactgaagaataatgaaccacattccatgcaagagatttgtgactatgcaagaggaattttcagagacatgtctttagacactgaaatgaatccagaaaaaaatttgttgggagtaagggatggtttgaggaatttagggtgtaccataatgtggagaccaggtcttatttgacagttatgccaaagaacaaacagttcctgcagctctcatgttgtattcaccacaaattcaggaagtggctgaagaaggggattacatgcctgcacaaatctttagtgctatcgagagtgtcaagctttgaaaccctttgaatacttctgaagagcaagcgcccactgatgctgaggtcaacaaaatcagagaagctgacatttccattttttgccaatacttcaggtgacctcataatgaaacccttgctgctctacagaaaattgtgcccaaaccctctcaggggaaataaatgagccaagtttccagtgtactagcaagcaaacagaaaagcccagatgaatcttcctctccttaagggatggtttgaacagtactttcttgtggatgttcaagactacttaaaagaaaaaaaaataccttgaattcaaagtcctgctgattcttcagtctatttggtgcttcaggtacatttgccaatatgcatcctcatggtaaggttgtctttataactagccacatgtctgagattcttgagcctttcagtcagtgtttgatctggccattcaggaaggcttattataaactaatgtataactttgttcacaatctcgcaaagtttccactgtctgaaaatcctagtgcatgagactcctacatcgttattaatggcatatccttaataaaagtttggcttttgatttttaatgggttttcaggagataacttcccaaagaggcattagatagtttaacagagcctgtcattaatgtgacctgtgagaagacttggctagaggtggtgaaatatctttcctctatccctcccaaagacaagaaaaacctatggatgaggatgaaaatttggcacaagagcaatcattggcggaagttgaatctgaaactgttgacaccaattcaagttaatgctgctagaggctgatcctcaggaagctttcttgtctccagaggttattatcataagtgatgatgaagacaattaggaggctgtgggactggaaacaaatacagcaataagaaacaggagcaaaatttttagaacaagattaaaacctccctaagaaggtaattaaaattggcatctttacatgtgtcagatattacctgttcaaaatttgagtgacttagagttctataaagaggtgctatgatgccatcaaacataatcatattggacagaaacaatcttcaatagaacttaaatcatgtgccatttaatactgttgctggacagctgataaaactaccttctgacaaagtttgatttaattagactctaataaaaggtcctatgagactttctaaaagactatattgggaagaaagaaacctcagaaaagtctaaattatcaagtagtaccatttaaatactcttactggacagctaataagctaccttcagacaaagattgaatgattaaattgaactccatacagaactgctaaggtgtcttcaaaaaggacttgagaagatgaaagcatctttagaagggccacttaaattcacttgcttgatagaaataaagcctcaagcaagttgttataacttcaggattcgacttcactgactctaagagtatagacatccataatttgaactaatgaatagtccacttctgttcattgcttctctgtcacccccatttgccactaccataatgagtgatagatacatcttcatcacctctggaaatcatctcaggatctaaatggaaactgtataaagcctatcatttttactgatttaaactatgtaaactcattattctttttatgtaatgtgctgttgttattgtttacctgcataaaaatatttatgagggttttcaacagtttacttgagacctcatttttgcccatttttttccttcccgatatcatgatctcctcagctgaactttcttaccttgggggttgttcaggaactgactctcatggggaaagagggattactatttctgtgttcctatctcttggtaactgcttaaccacagtcagtcttgaactaatggaaggagcactggacttgggttcttgagacctgggttcatgttcagttctgccactgattattgtgacattgggccagtcacttgatttctctgagcctcagtttcatcacctgttaagtgaggatagtaatacctggcacaaatatcacaatattagtgataattgaatataattataagtacccaatggctattaaaagtaaaactaggaagtgctgaataaccataatatcattatatttgtagcattttggaccttatcaatgaacaactgagaaaactaggtttttgaattcttttactttttaaagtaacttcctcccatttttatgtcaattatagaaaattttaaaaagaaaattaaatgtgcctataattttataagccggaggtaactaagttggtatttttcttcttagtacctctttgtctcatcataaattgttcatcaatgtcaaaaacttggaaaataaagataagcatatagaaaaaaataaaaaccacccataatcacaaatcccagaagcaatgttaatattttggtggatttatttccagtctttttctatggctatatgtgcacatatataatttttacatagaaaaagtcataatgcatacagctttgttgcttttagcatttttatcatgaatattttcctacatttatgcaaagtatttgtaaatatcattttcaatggtgtataatatttcatcataggatgacatcatggtttagttaaccattttcttttgttggatatttgagggtctttccaaatttggccattgtaatttcacaatgtctttttcattacctaactgaaaatatttgctttggtgaaagcagaggattttttgttgtttgtttgtttgtttttgaagaagtccttttaatagctacatttcattgactaagtggaacttcaagagacaggtagaagaaaaaaaaaaagaaacagtagatgtaatttcaagattgaggatttattttgttagtgactgttccagaagctgaattttggtgttagagcaattcaggagggacagtttgccaccattttatgatactttactgtagaaaagttttcaggatttagaccaggaaagagacatcctaaccatatgggttgattttattttatggaccctgtgaagtctgggactgatcaggtttctcttttgttggctactagaaagcttggagtcaaatgtgtggtcaatgcatagcacttgtaatgggactctacggtatgtatgcactttgtattagctttctgccaggctccatttcgtgttcctatctttattgtttttgttttttccttttactttcttatctactttgaatttatgctatcatgttgtattttgtgtattcttgtaagccacctgacatccatcttggaacatggtggggaataaacacactaataaataaatacattaataaatacatgaataaataaaccaataaggaaaaaacaatgaggcaaatgaatgcagccaggactctgaaaattgcatagtgcctccaagaataatcaatgttaaggacttgaagcttggaagaacatattggaaagaagcaggtgaggctgcgaggctgcatttagaggtgacgtgttctgtgtgacgtctgtgtctactgaagcatgcttatatgtcttgtgtcttctgctgcacttgagcattaggtgtgtttcagaggatatgcagtgctgtgtaatggactgtgtctttagagggcacagttcatgtgcattttatttgtggggaatctagagagatttgggagttggtgagcctgggaatgatgtgatgatcctttttcatggaggcataggaaggaatcattgtatataaatcaaatcaagacaaataggaagtttcctaccatttactaactagttactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttcatatatgtgaaagagttcttaaagtactatatagttttgttattgtattgaatatatattgttctaattcctagagtatgtcatcttctatatactctatacagcaggaatccttgctgtacaacaattatattaaagaaaactctcagttatcctttatggtcttgtcaatcaaatgttttggtcaatgcatattactaactttcatctaattaatgcacaataaaatatacttagtgtgataacagtatgcagtctttctttggtgatactggagaccctttggatcttgcagtagctcaaagttattatcactgcaccaataatgtgtaagagtgtcaattaattcagggttctgttatcagaaagccaggtatcagagactgctacatcctgaatggtgcttacattcttggttctgcaaatgtagcccatccagcttagcaaagagtgttctttggaaatcactgccctgcccttttggaaacctgaaggacatggcatcttgcttgtcctctagggtcagtgctatgccccaatagaagagtctcttgtactactcctttactcctaggaaacccgtgttgaaatgggaagaaggtggaataaggacacactctccctatctaccagggtctgtgcttccactttaaggccaatgaatggggaaactgggcacaaatatggtagccccgtaaaaccaacagacagtcaaatgcaagagaagtatggaatgtagggttgggagatgtttacactaaggtaaagaagccacagggagaaataaactgagaggaagtaatgactgaaagggagattaggaggtggagaagatacagaggatggatggaataagaggggaagacagaagagtgctgtatcaaacacgcagtttgatatgctttaaaaaatggagtgttgcaagaagaggaaaattgacaaaggctaagggatatgaagttgctttccccattaaggcaaatgaggcctcctttttctcctcagacttttaccctatataattatccacatgatcagaagtgtctagttaggacattgcctcatctttgctttttgttttcaaatgtttcccatcaaagttgttgcatatgtcaattgaatgcaaatgaaagtggaaccagtatgtgttgcctagagggagatgagtaagaggtaacttcctaatgatttcccagaataatcactgttgctgaatgtttttgaagatgataccactgaaggtgctagctgtttgcatgtgtgagtgggggtgacttgaagggctcacatgtgactatcattttacttcccccatcccatcatcctcacggaacatctgacctgtgaattgggcttgtggtcactcttgcagaatcaggtaccacattgagttttatctgtacattaaagcctgctaatttgtggaggacatatgttgttttccatagccactgaagacctagcaggagaaactgggcttaatattccaccagagagaatggaactagacataaattccagataggctaattggatgctataggttactaagagtgacattttctagaatcttcattagatatctcatggctttagcaagttctacatgaaggcaggagaatggaccttccaccatgggccttcccaactatatgcttttgagatttgctaatataataaaagatattataataagagcagtgaatgtttaagatggcccagtttaatcctcttttctcagtagttatacttctaaggatatcactcataagatgaaagtgctaggtctaaacatagtcaccctgttacttagtatattgccataagatgatgtattttggaaagccgttataggtgtattacaatgttcaaaacctctcatatcagttaccttcttcaaacttcctatgatggaggtaaggcagggattattcccattttacagaggaaggcagaagttcagagaggttaaatgacttccacaaatttgctccactacttaataacaaagcaaggcagacctagaatttggatcccccaactcctagtccagtggtagttgaagactatactgcttacataaaatgagagtagcttgttttgtaaacaggtttcagccaatggaatatgcaaaaatggaatttttacagaagcaagtagaacccaggtgcctcagtggttacaacagtagtcatacctttatcctgacaagtttttcctcctgagggcctaatttgctaataggaagtaactagcttttgtaaaaaagaaaaatatggaatattaaaatagaacacaggagtggtgcacctatcatccctccccttagattcattcatgatccagaatgtaaaagatatttgggccgtcttactcatttaatgaacaccttccttttctgctcagaatcaatatgtattcgcccaagatgctaagtttatgccagaaatatgtatgttatgtggaatttcttttaaaattcttattcagcgtgtactgtcagttgctttaaatacttactgccaacaataaaatctatttttatgcctatctttctattgtagtcaccacatatactttcacatatttccaatgcaaaaaaaaaaataaatttgtaggcccacacaatgatagtctttataccaaaaaaaattttaggtgtaaacaaaagaactgatctctccctgtgtacagggaaatgtacttcttgtaaatccaggagttaagaaattcctgtgggttccctcttgtaatatgcccccaaacaggatgtttgtttacagagcagatgtctcagggattagaacatgctttgcagaaatcagtccctctggaactattgctctcacaaatgagtgcctgcctctttgaaacctgcagggctgctgttgtcataggaagaactattctgagacacttactgttacctaagtataaggaaggcttcagaaggcttccctaaggagggttatggcacagtgtgctctgtgacccacaaatcagaggatgaagcaaaatggcatttttttttaataaaaaaaggaaaaaccacagtacttaattcactttcctggtagctaagtagacagtaaggcatttcatttcttacaggccaaaggcaacattttgtaaatgacttgtttggggcactaactgacagccttttagtaacagataaatcaatggaccaccgaaagcatctatcatccagctaaagagtaacgaagtcactaaggatcatttgttagggaaatgaagaatgtcacccataggaggtggatggccctttaataagacttatatatcctttcaacatggatttcccaaatcaaggctcaggaatattgagatgaaaaataggcctttaaatatgacagatctctaacctagccatctccactgtttctgccagaagtggtccctgtgactacaaaagttgcttggctttaggaatatataacactgaatgaatacagattgcacctgggcagggtgagggggacaaagggtggaaagaaggacaagggcttctggtgtcaagctagggattatgagataagtgcacctcccaggagggcctcgaccccagcaactacactacaagcctcctaacggaatgttttattaggcttcctttatctcaaaggacttaatggaagaccacaggatagagacatatgggtatccagccaatgcacaaatctgggctgcattctgactttgagcacagatttaatttattagctatctcagtttaaaagttagatataacagaatctggagcatgtttttaactgcttatataccactcagaaaagagttgtgcctactttttatgtgcctagctctgtgctgattattgtgagggatactacatatgagacaaggttccctatcctcaggtaattttcaacatagttgcagaaatcatacacacacacacacgccgagtttgtgggaaatgtccagtaagtgatcttagagaaaacagatacagtggtggggaggtcctccccattccactcccaccattcattcttcttttccacctgagtgaaacagcaaccatctggaagcctgcccccaccatggcatgtgtacctttagcagcacacagctatctagcttgtcttctcacacctttttttgttgtgtcattcaactattcaaaaacctttctcagcatattttgtattactacctccgatttcatctttcttcccttcctgatttccaaggctacaccctacttatttattgtgtcttctcatttcctcatcaacatgcaatatgcatccctacttccaaccttttacctctactgttcttcctcgttgagatgacttacccttgcatctaggtatccagtctttaaggcccatttctcaaaacatacctcctccagtaagccctgactgtccaccacagatttctgtgatcttttcttttgacatgctactatcctatattctgcccaacttagcacctaattttctttggtagtttctgttgctatttcttgtttattaaggttatttccccagttagatttcaagttcagaatattactgaagtttctaatgaatcacccagaataacctgtcactacagtgatccacaattcaatatagttgctaactgactcactgattcaaaggaaaggaagctgggacagtagcaggaggaagttgtgttttagagccaaggttgtaaaatgcttgcctcatagaactagtcaaactatgtgtttatttttctttagaaaaattatttctgcagtaaaaatgctttatatgatattttgcttttagctttctgtattaacaaggcttcaaatgttgcttttaaaattatgacatgtaccataatattttgcatgcttttcattgcttttaaaaagatgattattgttttgtgcttttaggctaaatttatgtaggaaagcatttccctatgtctgtcttctgccatcctttttcttttcctgcatgctctgttttcaagaagctagaaagagttctaaaaaataaatctgaaaatgaccatatgacatccagtgaataggcccaacaaaacttccaggaattttaggggaagataacaaatggaactcctacaacaaggaagactcaggtgagagctttctaaattgctttcagaaggcagccatagcaccatccagggatttcatcttgggggagaattggttgctttgctcaaccttgaaccatgcccagctatgttaccatatatgcctttggccccaaagtggtacctggcaagaggtgtgcctgaatgaatagagtcatccccactgttgggggaaaaacagcaacaatgccaccaaaaacaacttcaactacaaaaacaactgtaaaatatactcctcacccttaggccttcttggcagacatcgatcatcttctcctcttctatgaacacataacagcaaataggcatgacctgtccccatatactgggccttatttcatataatgaaggtcattcattcatccattcattttttgttcatttgctttttcattaaacattgagtcagatgctgtgctagataggtgctggggtacaaaggtgaaaaagtcccagtccctggccttaaagaactgaagctctagtcagggacacagataagttattcaatgattagagtttagtgtgataagtgtaatatgtaggagtgagaactgaggagaggcaattattcaagactgaaggaaggggtggttagggaaggcttcctggaggagaggattattgaactgaggtgagtcttaaaggaggcatagaactagccattaaggagtgagtggcatgccaggtagaaagaccatcattttgaaggcagcaggcatgacacgctcttagttgagcttctatgaatacaactacaagtagttcagaaaaactggtgctctgagagtgggagaggggtagagaagaagctgtggatgtaagtggggaccagatcctggagggcttatctatgccatgctaagggctttaaatttgattctgaaggcaatgggggaatattgaagcagggcaatgatatcagatttgtgtttcaaaatatcactctagccacaggaggaatcgggaagagggggaaagagaccagtcaggttgttggagtcatacaggtgagaaatgagagtggcctggcttaagggccactaatagcaataaaagaggacaatgcagagggactatttagggaggagaattcatagaactaggcaactaatcagatggtgagaggaagagctggagaaggttgagttaggaaacaaaagaagagttgttatttcctgtttttgatagagaaaagcacttaattagttagataattaatgaaataattaggcttgattttgaaaatatttagtgtgggggtctgtgaggcacctaaatagaggtgttcaatagccagttaactacatggggttggggtgcaacagagatgtcatggccggaggtatatatggagaatcactagtgtcagtggggattgaaatcatgcatgtggatgagatgacccaagggagaagtgtgttgatgagaagggatgaagagccttctgcaaatgaggctgagaaagaaaactgagaaatgcagaaatagactctaagaaagagttgtatgaaagaaggtgggggaaatgttagcttcaagaagttcgtggtctcaaatgtcagttttgactgagaggtccacacttgtaaggacagaaaagtagccattggtcaaggaggaggctaatttgtgacttcaggggagtcattacactggtttgaggagtgagagctaaggaaatctagattaccttttcaagaagtttaacctaaagaaagaaaagctaagactataacagctagagaagtatgtgaagaagcagaagcattttaatttttaaggacaatagtgatctcagcatgttttttaagccaaaagagaagtgccagtagagagggagagattgaggatacaagaagaaatagagcataattggtggattcactttaggtagaaggtggcaggagtgagacaggagaagagaagaagatgctactgctggagataaattcataggggcgggagagaaagtgaaatcaaaggaataactgaaaaaaaaggagtccctccatttatctcagtgaagtagaaggaaggtcatatgctgaaagtaagggaggagggggtagagctgaagttagagtggagttctgaatttctggaatattgggtgtggtgattggaaaaggaagttggcaaggggtgacgaaactattgtcaagcaccattaatgacccagctatcataagcaccaaccaatctgcatggctgtgtgatttccctccagcaactcttggcagccttgacatagaagtggagagctttcatggttggattctattagggtagggtttcataggacaattataacaagaagtcaaagagtgaaattttccaggacagaagcataagagcaatttacatgctggacgatagagtctcagccagaaggaagctgagaaattggctaaaaatggcagtgactagaatgatattttgaaactcaaatctgctattattgccttgtttcaatattccccattaccttctagaaatggaggtcttgttgagatcaaagaacaagtaaaataggagtaagcacttgaaacaattagcaggttagccagatgggaagctgagctcagagaatgagataacaaggttgaatattgcagagaaagggttattctggataataaaaagatctggggcaactatggttcttcactctggctgtgcattatctctggagttttaaaaattcatttgcccaggtttcatccccagaaatcctgatatagtaggttattggtgggctctagatattggtattttatggaactctacaggttattctgatgtgcagccctgcttgagaaccaatggtttaaaagatggctgtgggaatgattgcagaagtggaagggaggtaaaattcattagagttgagagagatcaaggatccataaggaaagggtatgaaggaggtgtccattaataccctgtttcacacagtggtggcagcacagaatgtaggaaggaagactgggagccaaagtactcaatggagaacaacgcacttggccaggagaactaggtggtgataatctcaaaagagaggattttgtaggcaagtgtagaagtactgatctcaaatcatttggagtaaaaaaagagaaagtctgccttctccattctctcaggactacaggcttgggatgagaaagggtgagcagcctccaccagtcttatctaaggaagcggtaccctcactggatagtagagtctaaagtcattgttctcagtcccagctaagtaatataaatacctgaggagttttaaaaaataaagatgcctaaggctaccccagactaactgaatctgaatctctggagatggcatctctctttttttttaagttctcagatgaaaatgatgtacagtgaagtatgaaaacctaaggcaagaggtgaaggaagaggtagaaaatgtagaaaaaaaatgtttctgataggacaaactcttgcaggtaaaagaactgcagaacattggggtgggcatataaaaggtgatagatgactagagggacttctcattctttatgaagtagtagaatagagaaagatgtcaggatgagagattctggagagattagctagccccaggaattacaaccagaactcccaatagatctcaaggccaaatgctgtttgcagtttgtggtccaggcagcaatttgtagccttgttctgagttccaatagaatatgggaggtacacttagaaagtgatacttttttggacttctgctctctgcaaatatcaacccagatagctgaccaggttgagctttaagataaatgacaaatgctcacagaattttgcagggtgatacagacattttagtgtatctaaaaaacaaaacaaaagaaaaactggttttcatctagggtctagtttattgctaaacacttactgaaagctagagctcaaatcttttttttttttttaatgccactgagtaataaatagtttaactgttgaaaactttggttctggagacaaagtggggacgtagattcaaatcctggctctgatatttgccagctgtgtaaccctgggtatatgatttaaccccaatgagtcccacttatctataaaacaagaacaagacctgcctcatatgactgttgcggagattaaatgagatagccccagatacttggcacgtggtgagtgtcccattcgtgatagctattaagtctgcaggtacaagctagttgctggggaatgtgagaataaataaattacactctttactgtcaagtatctcaaattttagatagagaggtagatatgtaaaaaataccaatcctatgctgatggtaccaagctcaaagtagacactgagtagttctatgggagcatgaaaggacaggcatttaactttgtctgcagaggggagataggaaaagacttgccaaaagtgaaaaagcccaagagtgagtctttaagagtaaggactaataggagtgatccccataaatttgggggagagggtaagaagtaagactttccaggcataggtatagcatgtataaaagcttggaggtatgagaaagcctggcagtttagggagcattgaatgtgtataagtagtggggcacatggcaagaatagagaggttggagtggtaaacttaggaacatatcatgcaggcccttggatatcatgctaagaaacatgaacttttaacttatgggtaataggggacagcatttaagcatcttaaagtcaagaatgttattcaggaggctgaggcaggagaatcgcttgaacccgggaggcggagtttgtagtaagcagagatcacgccactgtactccagcctgggtgacagagcgagactccaccaaacaaacaaacaaacaaacaacaacacacacacacacacacacaaatgcaagaatgtgatctagccacagagtagagaaatgaatggaagtggataaaattggaggcagtgatgctaagtgagaagtgatgaagccttggactaagttagttatttgtggggatgaagagaagaggatggattcaagaccagtttaggagatagaatatacaaaacttgatgatgaattagcatagaaataaaggagtgaaagatgactcccagattcttggtttgggcagctgggccagtgctggattactcaggagccagaacaagcatttgtatatggcatctagtaaatctgaagtacccaaaatgtggaaacagtttaattttgaatatatagcttaaaaaaaagactcaatcaccataggaacatcagaaattttgcacttccttaattgtttatgccttagtattgtttttatttgaattgcatattggagaggaggatcataattttttttcattgcttagagccgcctaaaggaggaggagcctaaggccttgcttcttctctaatctgcgtggttagtggtatcatttcactgtgatagagaacaccagaagaggagcaaacttgggcttcctgcctttgttatgcttagccctgagtgaagaaaattgcatagttaggctgataaggcattggcagtctggtggccttctaggaaaacaccattaatccaattctgcatgtaactcagcccaagtggagtgttgagtcaatttgctacaaatattttgccaatactaatagaaaagttgggagagtttatttgctgacaagaggggccatgaattcaaattgatataagatttggaggtacagattaaggtaggggctcttaactcagagtccaggagaattatgaacctgtgaaagtatatgtatatagtacatttttatgggcagaagttccatagctttcttcagatttttcagaagattgaccccaaaaagcttaccaagagctaattactgtgaagtgaatgaaactgctccttcagagttactcacttgcctggaacccttccagggccctggaggggccccggtacatttgtatttgtaattttataatgtcttttacttaaagggaaccttcctctcaaattacatgaagtatttggtcccccaacatgtggatccacccctgccaaccacagattagggaattacctaacatgagttagtatttgggagtggaggcaatccaatagagaaagaaatgtagaaggccaaaaactgtactagcaaaggcaaaagcaatgacaatcaaagaaagaaaggtcactgagaaaggaggaatgccaggccacattgtcaaggaagtagaaagagaagtagctagccatggccagcatgggtgggacatcatgaaagagaaaaagtaagaaaatgattacaggagtggctaggacaccttcaatagagtgatgacaccagagtgcctttctgaacaagtaaaaaatggtagttgaacaagtataaatgttagctatagttcacaaacattcaggggaagtagaagtaccaacagaaaactctaaacttcactgttaggataatattcatgaataaagtaggctcactgtaaaaatggaatctgtaatgagggtaagttatatggcatatatgtattttttcaaaatgaatcctaaatgtgctccatggccagacaaaggccttgggtgactcttgttcccctgctcccaacctttctttcctgatcctgtatagttcctctcactacttcagttttcttatttctgccccatatctctgtcctgtggctggagataaggaacagtgagagagagtggaatgagacaagaagccataagaatagcctttgaacatgaaaagttttgaatttaaaatttatcatgggtaacccacaaaaccaataatccatatacggttgaatgttgtctgtaattcaggccaaggcaacatctatttgaaccagaatgttctaaattgaccgccctggcaattctgaagttgattggtcttaactgggtaaacctggttcatgctgacttgccctgtattaggagggtgagtactatttttttcagtgtgaaatgcagcctcaccagagatacatgctcagatctgctaataagtgtgttatggaagcgactagatgccattttagagtgtttccacagtgacttcctcctgggaactatttccagatagactatagttctcaacttagtttattcagtgattatatctttataggcttttaaattatgagctactgatacatttatttataattatgtaactatgaaaaatctgctacttgaaaaagacaatgatttttgaatggctgatatgacaaaatataatggaaacatggacaaataactacaaactagaaaaactaaaccaaagaatggctttaagttttctgaaaactaaataaaattaattcagtaaaaaaagcagcaatttgtagctttttactagcaaagtgctgggtaggaaatgattgaaatatttttaataataaaaaaggtttgtaacataattgatttgcagtggtattcttgttaatagaagagtctattaagatatggttaataatagaaacatgttaaattaaataagtaccaaccacttgattattagctatcgttaacatagaaacaattcacaatatctttattgaaagctgaagtgcttttctattctttctaatagtatgccttagcttgacttgtatatgatgaatttcttccttagtaagtgatatttgattcaacaaagccagttaaacacaatatccctagatatctcctggttacactggtaaaaggcataaatcagtttgaatgagagatttgtttcaaatgagttttggaaattttgaattatttggatatgacatttgtcatcaccctcttagctacttctgcaaataattggaatttctggagttaagtgttgttaaaattgtgttggaatcaattgtctttcaactttgtaattgttttgatgaacctaattgtacaacttgtggatgccaaaactataccccaaataaatacatgttaacattttgcctttagccaataagaagaaggagaaagagcgcccagagatctctcttccttcagactttgagcatacgattcatgtggggtttgatgcagtcaccggggaattcactgtaagtaagctccttgttttgttttgtaagccacgaaagaattcctttgtgaaaatagttttcaagcaagaattgccatgtcccaaaatgtcagacttaatatttttgatggttccaaataagatggacattgcctaggcaatcatagatggaaatagaggatggcaacagcattgaccaaattattttgtccatcttttaaaaaagtttgatcactgtatagtctcaacttggttgaaaatattaactaaccatggcacagaagatgtactcctggcagacagatactgcctgagctttttctttatcaagtgaatggaatcagagaatcatctactcaccttggccagtgaaaataattcatctgaataattcaggctttacattaaaacctagaatacccagatcagctaactacgctaaccaagaatctctatggaactgacctgtttttccctttgatttctagaacatagataagttttacaatttttagtaggtatattttgtagattttcaaaaaacaaaccttatatttcaagaagaaatattgatggatatatcatgtatgttctagttgttttgggcatctctctcctctctctctagatatctctctctagagatgtcatgcaatccatagtacataccaataagaattcgctggacagaccatagctatagatcaagccttttgctgaatatttgtagtgctcaaatagcacaagatctcagatctatggaattttatacttttcttttttaaaaaaaaagaactggtatcttttttattttattttattttagctcaaggagagaaaagatgtggctattgctagaaatatgtccccaggaaggtcaactaccttttcccatactattagtgaactccatcaaaatgtacattctgaaataaggagtaattttgagggcatttcaaaaaaaatctttgatagagccatcaccatcaattcttgggctgttaaaccagagagaaatttacatattaagtagttgagttttttgtttcataacatagtagtgaatagactgtgttatatgattaagcggaaaaaaagaaggaacaaattaatctatgtggagaagcaaacaatgttgctgaattgacagtcaaattatcttatttcttcaattctggaagtaagtgataggagaatggaaatggaaacagtaaacaccttggcctcataaagtggtgtaagctgattatttctgcgttctcagtagcaagcagaggagaacgttaagaaatattgacacataaagtggagataggtaagatttaaccaatttcatcattaaagtcagagacattactcaaatggctttgagtgtgaacccattctttactatatttgcagaatattctcttagccacacttagatactccaaccttgctattatgactaccaccaccatcatcaccaccagaaaaaaacgtaatttgtataacctgaaaaacgttctatttttaaaaaattacaaaaagattgtaactatttttgctgacacttgaaacaagaagatcccttaaactttataaaaattttgcctaataactcttcccttttttattaatttttccagctttgacattttaatgttctctgtgcttttcctcatttaaactactattgtgttttattgttgtcattcactatttttcttttcttttttcttcctttttgttttctgatgtgaaaattttctcatccagttatctcatgtgatattctagttgctctccaatattttattctttccacttttcaaacttacttgtcatcttatgatacagtatatctctagctctttcatttatcattctggattctgaatggaaatgaaagaaagtaaatcaccaccatcttgctgactgcagcaccagtcattttcaatttgctgtcaattagaacccaaagaacccaaagtgatggactatctttccaatgatgaaaaacagttggatacaaccaaaccatatgaaacaaatactcctctccctactaaaaatatccccaatttgaaataagatagctgttcggaagtattccattgttacgaatccattgaatatatagaaagacataggctaaatttggaaaatggaagtactttattgtcatcctgatgatcttttgtaactacttgttcatacattattcttaaagatgccaaattctgccctttttggtacttttttaacctgtgatttacatttactatattattatgtttattaaatgtaaacatgccaaattataaaaagcttttaagaaagtctttttattggtaggatttagaattgggtcctaattgtcatagcaccactaatttattgtgtgttgggaggggatcatattaagtttgattatcgtggttgttgaggttgaattttgtgcaatttgctgaactatctaatccagttgtcttacaagggcttgttattttgaatatttggacactgatttgctgtgttgcttggtgattactctttggctaattggcccatatgaccttgtatacctggtcatacacttggaccctgaagctaaaagtaggttgggaggtgagatttttggtattcaatgattataagtcctcatcctttatattgccatttttgtcccaaatacttcagaactcccctttccagacctctagacctgtgacggtcgcttcaagtcaatcagagggaaaaatggtatgagtgatataaattatcatttcttatgataagataaatgcttggcctgttatatcgtgctgccattctcctgggctacactggacaacccccagcttaatttacttctagttggtatcctatacacagtcagacattgatatgtgctcctgcttctgatgctcaaactcctaggtcttcattagctgtctaacttttgggattagttcctcaacgtggcataatgagatggctttatgactatgtgcctttgtggcatacattcaaatttgaatgtcgggttttagtgataattggatttgtctcaacttagaaaaaagaaatgtcagcagtgtagtcaaaattatgtcagcagtgtagtcatgtggtaagtatagttgtctggaggattttctgctattggcagcattttttcctgctgtctagtgatcataaaactatttatcacaaaagtttagaagtgccatgggaatgtataataactgccaatattctaatgattatggtaatgattatgccagtaatgtctgctctagtggttatgtgcaatgcatacctcaatttgtaacacttaataactcctttggccattacggtattaacaaatgctattaattgcacttagaatcataactgggatcatgcatgggctcctgagttcaaatttttggcttaaggctttagcatctagctgcgtgaaaaatgcatgtaaaagtgtcgtttcactgtgcttggagtaaccctaaataccaggaatcaaggacatatatacaaaatcaagccagttgggtcaagcatgtttctgtagcatttgagatatctttatttaggcaaagctgttaccttatatcttgtcttattttgtgggaagtgggattttagaactgcagcactaaaatggaaattatatatatatggtttgaaatggaattgttcccctttccctggtctaaatatctaagaaacttaacatatagagtctggctatgtgggaatgttctttatctagttttctctaagccagccatgactttagctacaaagtgcaaaagaatcacatcaatgagaataaaattcaatgtttccatacagccatcctttgaattttagccacatacacacttttgaaactaaaattggttaaccagaattgggaactgaaatttgtaagtttatcacatggccattggctacctgtgatcacccagttataaaaacaacttacaaattattgtcaaagcttttcatgatgccatccttcttgcctccaaattcatgtttctgccttttaataatttctccaatcatttaatggtaattcttattaatacatatttatggaggaagcatcttgccaaaagtggaattatacatccaaactttgaagcatcgtcgttctctctgttctcttaaatctgttgtcctgtagcctgtcctgtccctgatttagttaaaacctccctattttcataactgccccactttagaagggactccccccattcagacccattggtttcatctcctcccaccttctaagttgtcccacattctgttttaactttcttttctttctttatttacgtccattacagccagatctctatggctcacagatgtgcccagggaagctcccagaggtgcgtcacaggcccaaaagaagcttgcatcaaagtgcttctttgagatgtcatagcactgcagcagcaggttcatgtgtgtgcagtagagttgttgcttggcttatctcactttttttgttgtcattcccaaactctggaggcccacgtcacacattgttttgccgagacttcataggataaagccacataaattgtgtctggatgcacttcaggaatagtgtgtctgtttctctctccaagttgctcttggaggttggataattatgaaattgggacttctgtaggctggacatgtaggaaagaatgttgaatgctcaatgcaaagctaacctctaatttttgcaattctccttggttagatttccaaatattccctcctctctgctctaaatgcttcagattattataaattatcacaaggctttgtcgtggttttcatagtccccaggttctatgtggcctataaatgaagtaaggaggaagggagagagagaggagaggagaaggagggcatgccctggagaaagctgcaggggaaatgcccaaagcagcattaatgttactgtttagcatctcagtggttcttgcccctccacaattctatttttgtctcctaccaacctgcctttatagtaaagcgctagacccaaaaaattacattttgtaatcacaaagtataacctgaccaagggtgatcctttccttttattctaaaatatattctgattacaacatgaccagaaacagcttgttattccagtcataaaatccattgatctgcactttactatgctgtgcacaaatttagagaagtcttgctatgtctgccctgagtcgccagaaaaaaaataagctaagccgtaaacatcatttcatggatgagcagagtcaatatggaggtgattttcatgcgcttttttttttctatcacagtcatactcccacccaccctttttaagttggatcctagttttacctatgtgttttaattagagaagagaatgattgcattattaagttactaactttaaatctagaatgtaacttcagtttcccaagtgtaatcctacaggtagcatgggcttcttggtgaagaactttactggaacataaaaatgctgctgcagaatgttctgagctaccattctttccctttggttgtccacagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggaggtaagaggaagtctgtggtatcaaaggtgaaaaagtaatttcaatttcagagtgtcatgttgagaacaaaatgtctgtgggacatttgaaatcgattctagtaccttcttcaaatgacatcaacataaggaaaccaaaaaatgagttggaatttgaggttgatgttaagttatataactcaagtatgtttagaatcaaaataaggtaattatttagtgaaggagtagttgtgagcttgaactggtagtcacaattgttgtctctttactgtcataaagacactcagtcacttactgggctttgttatatgttcatgaagtaagagttgtatgtatgaaaccatgctctctggaaatttactttgtcccttagattcattgatttacaccatgatgacacagcacactgtttttttggtgtcaggttattttgctaagacccccaaatcagactgaaaagagaaaactatgtgtgactatttttagaaactgaaatatccatgttactgccaaatcttgaccttatttgctagtgtgtagatttagtcttttcttggagctttgatgttcaaatttgcactataagcaactgtattagtccattttcatgctgctggtaaagacatgtccaagactgggaagaaaaagaggtttaattggacttacggttccacatggctggtgagacctcagaatcatggtgggaagtgaaaagcacttcttacatgacagcagcaagataatatgtgaaggaaaaaagtggagaaccccgataaaaccatcagatctcatgagacttgttcattatcatgagaatagcatgggaaagaccagcccccatgattcaattacccacccccgggtccctcccacaacatgttggaattatgggatatacaattcaagttgatatttgggtggggacacagccaaaccatgtcattctgccccggcccctccaaatctcatgccctcacatttcagaaccaatcatgccttcccaacagtcccccaaagtcttaactcatttcagcagtaactcaaaagtccacagtccaaagtctcatcttagacaaagcaagtcccttttgcctacgagcctgtaaaatcaaaagtaagctagttacttcctagatacaatagaggtacaggcatttgttgaatacagccattccaaatgggagaaattggccaaaacaaagggattacagggcccatgcaagtccaaaatccagcagggcagtcaaatcttaaagctccaaaatgatctcctttgactccaggtctcacatctaggtcacgctgatgtaagaggtgggttcccatggtcttgggcagctctaccctgtgactttgcagggtccagcctccctcccggctgctttcacaggctgctgttgagtgtctgcggcttttccatgtgcaaagtgcaagctgtaagtggatctaccattctgggatctggaggacggtggccctcttctcacagctccactaggcagtgccctagtagggactctgtgtgtgggctctgagcccacatttcccttctgcactgccctagcagaggttctccatgagggccccacccctgcagcaagcttttgcctgagcatccaggcatttccatacatcttctgaaatctaggtgtatgttcccaaacctcaattcttgacttccgtgcacatgcaggctcaacaccacgtggaagctgccaaggcttggggattccaccctctgaagtcacagcccaagctgtatgttggcccctttcagataaagctggattagctgggacacagggcaccaagcccctaagctgcacacagcacggggaccctggagctggcccaaaaaaccagtttttcctcctgggcctatgggcctgtgatgggaggggctgctgtgaagttctctgacatggcctggagacatttcccccatggtcttggggattaatattaggctccttgccacttatgcaaatttctgcagccagcttgaatttctcccaagaaaatgagtttttattttctatcgcatagtcaggctgcacattttccaaacttttatgctctgtttcccttataaaactgaatgcctttaacagcactcaagttacttcttgaatgctttgctgcatagaaatttcttctaccagataccctaaaacatctctctcaagttcaaagttctacacatctttagggcaggggcaaaatgctgctagtgtctttgctaaaacataacaagagtcacctttgctccagttcccaaaagttcctcatcctccatctgagactacctcagcctgaattttattgtccatattgctatcagcattttggacaaagtcattcaacaagcctctatgaagttccaaacttccccacatttttctatcttcttctgtgtcctttcaaactgttccaattgcctgttgcccagttacaaagtctcttccacattattgggtatctttttagcaacaccccactctactggtaccaatttactgtattagtccgttttcatgctactgataatgacatacctaagactgggaataaaaagaggtttaattggacttatagttccacatggctggggaggcctcagaatcatggtgggaggcaaaaggcatttcttacatcgcagcagcaacagaaaatgagaaagaatcaaaagcaaaaacccatgataaacccatcagatcttgtgagacttatccactatcacgagaatagcatgggaaagaccggccactataattcaattacctcccactgggtccctcccacagcacgtgggaattctgggagatataattcaagttgagatttgggtggggacacaggcaaaccatatctgcaactgaaatatatataccaaataatactttcacattttgagatagatgatttgagttctctctctacaataatttattaacttattaacatctaaagaatgaagggagtattatcattagtactacagctataaagagcccttacctcttcgcactggatttagtataagcaggctttaagtttctttgagaatgatccaaggatacccttggaaagggaagagtgtctgatttggccatatcaaatatcaaagcccaaactgctaaattggactattgcttaactgctgttatccaatgttgaaaacctaaaaagaaagccatcaagggaaactttttactatatttaagcttccacatagaataaaatatctaagagatcctggtgatatatcaaaaaatgtttcatgtgagaaaatcaagagctgtgctccaagttagaaccataggcaaccagaactgaaaatgtattcaagaaatcatttcactgtaaccaagaatacactttagagtatcagagtttgttctttactccaaatagccattgctgtttaacacttagttttatatgccaaatttctctcaacttacaaagatgaaatcctgacaactatattaaaactcaactgtacagttgtactgtactgagctgagtgtacctcatcataggttttctgaatgctctggtattgggactgactaactgaataggaagagaagatgaagatagcacaggaaggtggaaagaaggaatggaaaggaggtagggagagaagaaagtgggaaaaatcctagatttagagtagttctccacttatccatgtggaatatattctaagatctccaatggatgcctggaaccatggatagtactgaaccttatgtatatcatgttttttttctatacctacttacctgtgataaagttataaattaggcacagtaagagataaacaacaataaccaataataaagtagaacaattataacaatatgccagcatcactacttttgctctttggggccattatgaagtaaaataaggggtacatgactacaagcactgtgatagctccgcagttgttctgataaccaaactggctattaagtgactaataggctggtagtgtaaacagagtaggtacactggacaaagggatgattcacatttcaggtggaatggagcaggaccgcgtgagattttatcatactcagaatggcatgcagtttgaaactcatgaattggttatttctgcaatttttgatgtaatatttttgaaccacagttgaccacaggtagctgaaaccacaaaaagtgaaacttcagataggggggactactatagatgtacagaatcatacctgttaagagtaggtaatcttgtcattcttccatataaatgagattcactggaggccttcattaatatctgcaaaatgacctggtgagaatatggtgaggatgtaatggtgtgagctattttaagaaaagctatgtcattagtcataatatctagttaatactaaattggagcatttccttctagttgaaatcatgcagttttttaatttttatttttctggtgtggtctctgaatgaaacattctttatgaaacaaaaatgacctctctattctcactttgcagataaaagtgcacatggatacatagcagcccatccttcggtaagtgaaaaattgaaaactgtttcacatgattggtgtttccaaagatttaagagaatataactgcacagatccagtttttagatataaagtcttttaaaaacaattttaaggtataattcagtttatataaaattcacctattttcaggtaaacagttcaatgagttttggtaaatgtatatacctatgctaccatcaccacaattgagttttagaacaagtccatcaccccagtaaaatccttcatacctacttacagttaactccacccaccccaccctagtcacaggcaagaactaatatggaatctgcctttatggatttggctttctggacatttcatgtaaatgaaataatacagcgtgtgacttttgaggattggcttttttaactcagtttatttattttaagattaatccaagttgttgtgtatatcaataatttgtgttcctttttatctctgagtattccatggtatgattgtaccactgtttgtttaaccattcaaacattgaaggctctctagaaaattttcagttgctagctattacaaattaagctactaggaacattcttgtacagggtttttatgtggacaatgtttctgtttctcttacatgtagaactttgagaataataatcatgttaatagaaatttctctgaacacctacagtgtacacttataatataaactgtaagataattttatttttataggtacttaatctttcctacagcccagttaagtaagtcttaccattgtccccattttacaggtgagaaaactgaggtttggagaaattaaataacttctctaaggttataacagtatacgttttgtatgtcacttgttccaacaaactgagatacagggagggaagtgcctttgtccaaagtcacatagataatttttatcagagaagtgactagaaaataagtaacctagttgttgaaagtgctatagtatctgaaagaatatttgtacacattagacagaaaatgatctcagataaggcttccctttctgtgattttcattttgatattctgatagaaattacttcctgcctcatttgtttttttaggggtgaaataatttgcattactgaaagtctcctaaccatttattcaaacagtcatggatggccaacctgattcttcttccttttatagcagaccaatgccttttatagtggacagatgtctgcttgacatcaccctgggtagccagtatgacaccagtagatcttctttagttgtaaagagtaaaggttctgaaatattatgtcagtttctcaaaaattaaaaatggtattaaccatatgatctagctattccacttctgggtatatacccataattgaatgcagggtctccaagagatatttatacacccacgttcattgcagcaatattcacagtaggcaaatggtggaagcaacccaagtgtccatcaacagatgaaggggtaaacaaaagatggtatgtataaacagtggaatattattaagccttaaaaagaagacaattctgacacgttacaacatggatgaaccaggagaacattatgctaagtgaaataagccagtctcaaaagggtatatactgtatgattccacgtatgtgaggtacctagaggagtcaaattcatagagacagaaagtagaatactagttgccaggagctgggagcagggggagtgggcagttgtttaatgggtacagagtttcagttttacaagatgaaaagagttatggagatgaatggctttgatgattatacaacaatatcctcaacagtactgaaatacatacctaaaaatggttaagatggtaaattttatgttatatatattttgctacaattaaaaataaaatgaaaaaagaaagaatgaaggctctggatgtaggtatttaatctgatttccccatttactaagtatgtgacattgggaaactagcttagcttctctgagcttctttcctcagctttaagagggaataaaaatagtacttacctcctacgtcttgtgtgaatattaaatgtgataatgtacataaagtacttagtatagtacttagcacataatatatatttattaaatgtaaactactattatttttacatgacaacaagaggaaaaactcactctcttcacacatgaagcttgtacttgcgctttgctcagattccccaaaacagaacagaatatggccctctcatctgactggccatttccttttcctccttctttgccatgacagcttcctgggccacactgaaaacaacatgtgaagggaggtaataggaaaatggaaaggacaaaaatgacagccttccatgatcaacacatactttacctcctttgacttcattaatatcatgcttgtgcaatcttgactgggtattctggcaaaaaaaaaatagttattatttttttaggttggtcagttatttgaaacaccaacttgctaggatagcctgtgtattggtttttgttttctcctaagatattaactgtttcttttgagattggttctattggttttgcttgtagaattaaaatgaagtctatgttatggctaaaatattccattaagttagaaaaaaaaatgatgatctcactgtctggagataaaacaaatagatatttacctatttaacatatatttaccaactgcctccttataagctctaggaagtttggatatcaggctggtaggggaaggtaaacatggacataaagaagtacaatacagtatggatagtggctgagtatagtggttcatgcctgtaatcccagcactgtgggaggtctaggtgggcagatcgcttgagcctaggagttcaagagcaaactgggtaacatggtgaaaccctgtctctacaaataatgcaaaaactagctgggcatggtggtgcacacctgcagtcccaactactttggaggctgaggtgggaggatcacttgagccctggaggtggaggctgcagtgaggcgtgattgtgtcactggactccagcctgggtgacagagcaaaaccctgtctcaaaaaaaaaaaaaaacccaacaatatggatagtattacatatcataaaatatgttgacatgctatgagatttcagagaaagtagattgcttttagctggggagggaaagggaagcaggcccttgtctccaagggctgaagctcagtgtctggtaccaaatagatacttggtatgtatttgttgaatgttaagttagaaaatgcttcatataaaagttggcatttgagctagatcttaaaggtcagatgagatttcgatctgtgaagatgggaagggcattttaagtaaaaagaaaagcataagaaagggtgtgttggtgagtagagcaaggaaacaaggaatatggggttgaatgaaaactgagatgcgagaaagggaatcaggaaataagtcttgaaggttaaggcggaaccaaatcatacaggcccctaaatggtactccaaggaatctggctttccagtattcagtgggaagcttttgaagtgttttggagcaggagagttaagtgattaacacttataccttgggaagagtaatctgacggcaaatgtccagaatgaattaagtacaaatggtgagactggatgaagggagactagtagggagaatattgcaagcatccaggtaatctgagccagaaatgaggtagtaacagtaggaatggggagattacattcaatttctagaggtatttagattattaattggatgttggaggaaagggtgaggtcaaagataaacgcaggcttaaactgataggtcgtgggtaaaaagataatgatgctgtctttcaggagaagccaatttctgtgggaagatgctgagttccttattggacagtttgagtttgaagggctggcaggactttcaggtgaaaataatggattgactgcttgatgaaggctaggtttctattgattgaatgaactgaattggaccccgacattctatttgaattacttcagtgggactcagttccttaggaatggataactgcaccttgtgttttccttatagttctagaggagagtatgcttcgcaatgtgtatgtctttttgcatcataaaaactcccagtagatctggctgtctacaaaatctgatttaatgggtctgacaaccccttgtagacatagcctgaattgattacaagttttgcatcctttagtagcctgggtgagaattaaaacagaagcaatgttgcattctctaagtgttttaaactcatgattctgtaattaatattgaactcagggatagatctcatagtcatataacacctgctttactgcttatttgtggtagcttctttgatattagtgtattcaatttcaaatactgttcaagtctctactctttaatttgaggctaattttaaaatttcatatttttatcgtactgttgaaaataaaatgacatatttagaatcctaagttagtattccaactggaaggtaacagcaataatatgtcattattgttttgtcatattgaacgtgccattatctatgcttagagcaactggatgtgcagttgacagattgctcttttgtgatttgcagtactggttaattttttttaaacatagtttaagtaattcttttacttcagtgtgcatcagaatttcatggggattctgttaaattgcagattccagggctccactcccagagtagatctggagtagaaacctaaaatctacattttaaacaatcaccaaaagtggcccccaaacagcattttatattatctaaagcctctaagttccttacttctaagttctttgacctttaaaaattaagctcagagaaaaggaaatttcctaaggtagctactctagctggtgtattctctagagcaacgttcagaacttggagttcatgggtgggcttcagatctatgaactgttgaagttatacataagagcatgtgtctacctgtacctttccggggagatagaccaaaccctaagagtccgggacccaactcaggttaagaacttcattcccgaccaggcgcggtggctcacatctgtaatcccggcactttgggaggctgaggcgggcggatcacctgaggtcaggagttcgagaccagcctgaccaacgtggagaaaccccatctctactaatacaaaattagctgggcgtggtggcacatgcctgtaatcccagctactcgggaggctgaggcaggagaatcgcttgaacccaggaggtggaggttgtggtgaacagagatcgtgccattgcactccagcctgggcaacaatggcgaaactccatctcaaaaaaaaaaaaagaaaagaaaaaaaagaactacattctctgccccaatgtctagcaaaattagagtgtcaaaaatatctaatttgataagacaaaaatattccttacttgttatccatctatctatatttctgtaagtttagaagttttagatacagtaattctcagcctggaatgaagagcatggaaacattgcaccattgactccaaaaatgatcaccaggaaaacctctaagtaaagctatgtttattaaacttagagtgacataaaagcattactttgataaagtctttgtgtcttaagaaggggatgtcaggagggaatatttatagggttttagggcttagactgtttgattttaaagcaggtcttgcaaggcgaggaatgggttaagattatgcagtgtttatgataacatagctttgtattggtgaatatagcaaaggaaggggcttgaagcaagttttagtgagcaagctgttagtctcaatgagcaaactagttggttcacggtatcttctagaaacaagtatttcctaaagtaagaagctatgttatttttgcttattctcactattgtttaatataagaacattaaagtatgtctgtcttgatattgactaacacagggaaaataaaatatgcccagtcccagtactatttacacagtgatagtaaagtacgcctaatcccagtattttttaactcagggacagaaattgttaatttcagttctcagtaccaaagattgctatccttggtggattgctggggatttaatgctctctggcccaaccataattcaaaacatactatccactcaatgccatacattcttccaagtcaaccaaccaatatggcaggatagtgtttggtccaaagtaaacagaaatatctgtctttttcttttcccacaaaccttcagaggacaaaaaccttcaggttttctaatagtcccttaagtctatccttggagatggggaatggtttccactggaagttagcagtgaagatagtaatgaatgttaacagtcagtgaaatcttgcaggtggatcttatctagtgaagtattaagacttgaaatgtgtaaggctgctccttgccccagtaggcagactgatctttgtaccagtttaaggtttgggccaagaagactagaccttgaatcattctttttgcctctagggccgtttttagagcctaatagactgtatatactctcacttgtagaggtcacatcatgcattgctttaaacatattaaagggcccccatacttcactttatatttttgctgtaaatttttgaaattatttttgacatattaattttgaaattatttacttacaagtaacttttaaaatgtatggttaggtataatttcttgttaaatcattgtaaatactcaagaatttttgctaaatatgaaaatcaaacctacaatttatatttaatataatgaaatttctttaaatgctaaacataagagactagttaagttggcatattgttatacttaacagacatttaattaaacattaattaattttgactttatagttttcttgtggctttttggagctgatgatttatttctgatggcaaacactttcacgggcccatgtaaaacttatcaaccctgggcaaggttcgtattgcctaatagataaaatagcaccatttgtcatataaaaaagtactcagcttccatccttctacaaagaaacagtgattaggtacattcttgaacccagctggtgtaagatagggcaaaactttctggaacataatatcaaagcaaatttcgataacccaaagcccatttctccctgtgccccctgaaatgccctgaagaattagtgttttgcaagaagaaagtgattttttaaaaatctggaaacttaatgtcattaacagatgttgctatccacatagctatacaatataatagcccagttgttatggctaaattaagaataaatataggtgcataaataagaaaaccaatattcagtaaacatacaaacttcaatctataaaccacttagcatttatatcagggcaataaaatattctttcaaatgcttgtttataaattctaggttggctttcttctcacaattggtaagtctttctggctcctatcagatgtgtgattacaccttattacttcaccataggtttatacatgattgtagaaaagccacattgaatttttaatcacaattgaggtcctttgatgtaatggtctattaataggctgcctataactgcctcaggagctttgtcctcaaagaatgaaaattcattgtcggattatgttaggacagtatacccagtggcataaacaaaaacaaaataaatacacaaaaacaaaacaaaacaaaacacctataatagcactgtccaacaaatatataaactatagtcataactttaaattttctagtaaccacatattaaaatgtaaaaaataggtgaaataaattttaataatatatttattaagccaatatattcaaattttcagcatttcaacatataatcaatataagaagtattaatctaacattttacaattttttgatattaagtatacaatatctggaatgtaatttacacttgaaacacatctcaattcaggctagccacattttattttattttattttattttattttttattattattatacttgaagttttagggtacatgtgcacaacgtgcaggtttgttacatatgtatacatgtgccatgttggtgtgctgcacccattaactcatcatttagcattaggtatatcacctaatgctatccctccccgctccccccaccccacaacagtccccggtgtgtgatgttccccttcctgtgtccatgtgttctcattgttcaattcccacctatgagtgagaacatgtggtgtttggttttttgtccttgtgatagtttgctgagaatgatggtttccagcttcatccacgtccctacaaaggacatgaactcatcattttttgtggcgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcaccacactgacttccacaatggttgaactagtttacaatccccccaactgtgtaaaagtgttcctatttctccacatcctctccagcacctgttgtttcctgactttttaatgatcgccattctaactgttgtgagatggtatctcactgtggttttgatttgtatttctctgatggccagtgatgatgagcattttttcatgtgttttttggcggcataaatatcttcttttgagaagtgtctattcatatcctttgcccactttttgatggggttgtttgtttttttcttgtaaatttgtttgagttcattgtagattctggatattagccctttgtcagatgagtaggttgcaaaaattttctcccattctgtaggttgcctgttcattctgatggtggtttcttttgctgtgcagaagctctttagtttaattagatcccatttgtcaattttggcttttgttgtcattgcttttggtgttttagacatgaagtccttgcccatgcctatgtcctgaatggtattgcctaggttttcttccagggtttttatggttttaggtctaacatgtaagtctttaatccatcttgaattaatttttgtataaggtgtaaggaagggatccagtttcagctttctacatatggctagccagttttcccagcaaaatttattaaatagggaatcctttccccattgcttgtttttgtcagtttgtcaaagatcagatggttgtagatatgtggcattatttctgagggctctgttctgttccattggtctgtatctctgttttggtaccagtaccatgctgttttggttactgtagccttgtagtatagtttgaagtcacaggctagccacattttaagtgttctgtagccttatgtggttagttactgccatgttaaacagtgcagacctaagccatagttgatggtttttaaacttgagcttgcatcaggatcacctggaaggcttgttataatacagatcgctgggctccacttccagagtttctgattcataggtctgaatggagcttgaaaatttgcatttctaacaagttccttaatgatgctaatgatgctgatctgggaaccacactttgagaaccatggccacagttctttcaaaatccaactttggaaccattttaccactgtattaacatgagtgatcaagaactgtccctaggtattgttgctattgtaccacaatactgtcgtattattgcagtttataaaatattgaaaatctccatttaactcatggttaatattgagtaattattcatgtggatgagtagttcttagatcttcatgtctattactctctgagtgcttctttccaggaggctggacagggaagagacatttattggcttgtttgttcttagtgagtatttacagagctatattaataccatatgtatatgcatgctctgatccttaggtagaaaatagttcttttcaagttgacaaactgtcaatcaataaattgataatctgcccagtatagattcaaggctctaagagcaattagtttgatttttaatgtatttcaaaaacattgaactttaaaatattaagtgaataatagtccactgtttttgagctcagtgagaagttttttaaaaaattacacttcatggttttttaagccatgacatgaatttatctctgaataagttcagagattgtattcaggtgagcaagtcctggccaccaaattgttgatgattctgatcatttgtgaaagatgtagtttcctcctatccctacatgcttaaatatttcatttcccttgttttatttctgaagaaaaacaatgaggagttaatacctgatctttaaactttgtttttgtcacaagagtacaaaaacagcatctgagcctccattggcccctcctgtgtctgaagaagaagatgaagaggaagaagaagaagaagatgaaaatgagccaccaccagttatcgcaccaagaccagagcatacaaaatcagtaagtcacaaaggactatttccaaatgattcaaaagatgccctttggaatagtcatagagttagaatatagttaatcagctagtacctattaagcatcttttatgttccaagagctaaagtataaaatatgaccaaggttttgaggatactgtttgaggatacaaggttagcacattaaacaattagagaataataccaaacaatacataaataactgctaagtaataaaaatgttggagaagttaaggtaaggaaggaaatccatgtaaaccaggtaggaagagttgcataaacagagatcctcagaccagaattagcaaggcatgtatagggacatccaaagactagctcccatgatctttcaacagtgttgtactttcagctactcaaagtcctttttttttttaagaaaataccacttgtctttaaaaattcattgatattacaatacattgactccacactctttccttggcctgctgttttaattgcagagctttttggtttttttagatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagtgagtacttcttgccatgattactttctacacgggagtgtttctcataagccatttaaaatgggaattgatcctttggaagttttaatctgcttatatgaactccagacttcccaaaatcatgagatgaaaaatttgagactcactgcatatgccagaacactttctcccttccactcctaatttgacaggaactaaatatttttacttgaaggaatcaattgaggtgaaaattgataagacaaattaagtagcaagttttaagattacatcttcaaaagagaatagtctgataaaatatgttatgatcataacccaagggctctcaactaatcagtgatgatagatatgtcaacctcaaagcccaacacagtcaatcaaaacttggaacaacaaataatatagctttttcccttaattcagaagcatttatatgtggcaggagagacagaactagcaaatgctagtagcttccttccacaatgtcattagtgtgtacatgctcgtgtgtacacacttgttgccccagttttataaaacacttaccttctagttacttttctgggtcaagaagataaaaaaaaatggattatctgctgaaaagtcaaaggtttgtaaagcatattcattaaactcatactataaaagcatctaacaaattgctagatatcagcaataagtgccccccccaaccccagtttgactaactcctacttatccttcaatactcagctcaaaagttgcctcctcagaagatgttgcttgtccctcccagtccatgttaagggcatctcttccttaccacttttactggagcaaatatcaaaccatattagtctgacttctttactagactgtgagattctcaagagcagggactgtgcccttttttccctatatgtccaacccctagttcatacccattacataaaggcatacagcaaatgcttgttgagtgagtgaatgaaaaaaataagtaaacaaatacatctttactgagttcctacttgtctgttctgtgcaagaaaccttggaggacacaatagaatgaaactttcctgtcatcaagaaattcaatcttttttggaaaatacgatttaatagtatgatacaattagagcataagataatctcgtttcatgcatatttttatttaaaagacctcagaaaaggaagacagtaattcccactataggccacagggaggctctgcagaggtggtggtaggatgattttgccctccaaaggacatttagcaatgtctggagaatatttttattgtcctgattcagagactgctagtagcatataatgggtagaggctaaggatgcttctaaaaccccaacagtgcacaggacggctgccctccatccactttacagtaaagtattattcagtccaaaatgtcaacagtactgagattgaggcatttgagttagatgcatttggaaaggcaaaggtcggagttgcagctgtcagttaaaactcagaactacaattgctagatttttgctgactttactattcatgattaaatatgccactagcactgatactaaccatttgctgtaataacagcagtaataattctcatttattgggcaccttctgggtgggccactttacatacattatcatagtttcacagtaattccttgcagctgattctaatatcctcattttacagaccagtgaatgaaagtaagctttaaaaggcttaactgaccaagtcaccaaaccaatgtgtggcacaaccaaagtttgaactgagaccagtttaccttcaaagcttacactttttccattacctacctactttgcttctgcatatccgaactgtctatttttgtaaaaaggaagaactaaatgaaagaattgcctcgataatttaagttcaattattcagacaattggcacgtttttctttattttgcatatgtagacatgacctatgtgattatatcagattttaaaaatctaacagccttgccttaataaaatgactcttatttggtatctgtttcaaatctcaatagatgtattacaacaaaaatgcttgtatagttttgttagctgacagagaaacaagcattattttcttggaccaaaatcttgttttgcttgtaaactctagtggtgctagagctgtgtccttattattttgtttattctgctctacactgagcaacatggtgaagaaggggaagctaactttgattacatttgaattaagaattcagtggggttttttttttctctactggacttcatgcttgggcatagagagagtcattttccctctagccagcaggccacttgtgactgccaaccttacattggatttgtagattttggcagggtgaacctgctgagaagtggagcagtgcttctcatgaagcagattcagtgaactatactccaaagtccacaaaggcagactttcctgctcctgctccaccattaccctctctgtgccttctctctgccattacgcctttgtctaaggaaaacttcagacaagtcacttaactcctctgagcctcaatttttaacctgtgaaatggagataagaatcataactacatttttgtgagagataacgtctggctctgttacccaggctggagtacactggcacaatcatggctcactgcaaccttgacctcgtgggctcaaatgatccacctcagcctcccaagtagctacaattttaggtgtgcgccaccatgcccagctaaattttttattttttgtacagatgggaacttgctgtgttgcccaggctggtcttgaactcctgagctcaagcagtcctcctgcctcaacttcccaatgtgctgggattacaggcaggagccaccaagcctggcccattactacatttcaggactctgtctataggatggattttaaggagctcatcctatggttaagggagtcagaaggatctacatttaaatcatagacccattgctattagctgtgtcacctagggccagttatttaaattttctgggcctccattttctcatctaaaaagtggggataatgataatataaaaacctcagcagcagtatcaggcacatcataggggctcaataagtggtaattgttattacatgggtataaagccttcataagataatacaatgggtcaagctttgaaataagtcatcactgggtctgagtcatagacttatactagctgtatgtccttagtcaagtcacttaacatctctgaacataattttcttcatctgaaagatggagataataattgtacccatataataggggttgtgtgaggactaaataagttaaagtatataagacatctagcacaataaacagtaatataaaattgttattatgctatttttacagagtgagagtgatcatatttttcagcataaaaatgggggtttggggtcttacagtgtgacagaatgattgaaaccaggaataatcccaggtgtatgattactgtacagaagccatcaagtatcttggactcaaaggccacattggagcttggggaaaaagtagagcagcctgtgctgagaggcaaaagagaggaaaaagggaaacaggcaggcagaaagatggccaatatcccataccagagtggacctcataagcatggtgaagagtagatggcagcctctactaaaccatccttaccttcagtgtcaggggtccagttactaagaggtgggcagcccagaccacagagctattcatcttccatgcagatgctgattgtggtggccagagcaagaggtcattattgggtgaaatgaacaggtcatctttcagttttacacagacaaatagcctgggtctggcttgttcattgtggtctgtctagatctgttgaaaaatacagaaacaagaacagaaaaccaaacactgcatgttctcactcgtaagtgggagttgaacaatgagaacacatggacacagggaggggaatatcacacaccggggcctgtcggggagtagggggctaggggagggatagcattaggagaaatacctaatgtagatgacgggttgataggtgcagcaaaccaccatggcacctgtatatctgtgtaacaaaactgcacgttctgcacatgtaccccataacttaaagtataataaaaaaggaaaccaccacattttagtgacaaatttcaaaagccattactgtcagtaaagttgtgtaatacaggaaatttgtcttcaacctccttcctctgggccccactatcacctactccttgcctctcacctccctcagcattccccactcaaaaccctttttcctaattcaccctcatatagaactgatatcaatttagagaatctttttactttttctcagaaatcaaaatcttcattatgctaaaaggataatcttttaatggtgggagttcaccttagcttaatatgtcagaaaatatattgatgggcttttctgtcactgaactcatatcatgaatgctattttcaaatacaagtatttagcattcttaaaacctgcactttaaaatgaatagtttatttcttctttaggaagttctggtaggaaattgttctggtattgcttttttttcttttgattttgatttgctgattttaaaaaactttctccctattgtgtcacagtgttttttctttatcgtaatttacaaaagcaaattataataactaatggaaaagatcactttaaaagcttgttttgtgattgagaatggtaaacaaggcctctagtatacttgcctaacatcagtagatggcagcacacactctcctgtgaagggcgatgagtgtggagacaccattttatttgaatagcagttaagttcagaagtggaatctcatcaaaatggtttcttttggtaatcttcatgaaaggatttatttccagttttttttccccctgcataacatggaaataaaggttgaataatttattaccataaagccacattaactgaaccccaccatttggaatgggtcataattcagaaagtggcttgggctgaagctttttctatatggaaaaaagttgcttagcaacttaatagttaaacttttttagaagactataaactgcttaataaaattatggcttcaagtgactttaaaatcgtcatttcattaaaataaaaaagtccaggcccttgcgcattaatagctaatttgaataaggatggctctcagttatatagaaatctgttagacaagttgaaaaataaaagaccaactcagaaattgctaaattggtggcattctatagatatagctcaagtaaaatatattctccaacccttgccttaaaccatggagcatttacaaagggaaataactaattgtattttattgtaattcagcaaatatatcaatatattctacacacggcattgtgtgaggaggcactgaagatacagagatgaataagacatggctcctgtacttaaagacatagtctaaaaggcaatatcaaataccatacacacacaaaggaacctatgcagatgactgtttagtacagagagtaactcagcacaagtgttacattgtgaccaagaccttaagtgaaccaggaagatctgtggaattcccgtcatgtatatcatgtacatttctagccatagatacaacattgaatggatgccagatgattatgaaacccttcagttctaattcttacaagtcaaagttccaaatagatagatatagacatctgatatattaagtacagagagagagagaacaagggcgagagagagagagagaagatacagtagtagcacagaaaagtgaagttgttaattattcaagggatcagagaaagcttcctagaagagggaacatctaagctaagtttggaagcatgaataggaacttgccacagagaaaatatgggaaggacatttcaggcagcgaatggcatgtaaagaagacttgaagcatatgtcctggaactctgacttattcagtgttactttaataaagaattggtggtatatggtgatactggcattgtagaagaggaaactgaacttttaagcaggagctgatcatgagctaccattagtttgttatgcttagagcataaagttctagtggggaagtggtaaatgatgagaagagaatgaagcaggagccagattaggaaccttgcattgccaaggagttttggctttcatctgtaggtgttagggagctatcaagtaatcctgaaccagagaatcacattatcaggtctgcacttagaggatcctgatagagatgtagagccttgactaaagagggcagcagctagactaggagtccagttaggaggctgttggaataacccaggaaaaagatgatgggagcccaactaaagcagtagtaatgaggaaggaacacattcaaaagatgtctaggaggtaacaagatataggcccttggtggacaactgcacgtggtaagtgaaagtaagagtcaatgatgacttgcagatttctgactcaggctactgagtagatggattggcagtactactgactgatagtggaaatacaaaagaaaaagtattataacaacccatatattagctaagtcttatttaacttaatttaaaagtgaactttcattaaaaaaaaaaccaacaacttgatgagtaatctatgagtgaaatgtttaactgattatttttctcaaggtatactatctactgctgttaggtctaaattatgttgtatactagcccagagaatagactgttgtgtaaattagcatgaagtattatctgtagcatataattgagcacttaaatacatattttcttgttctcattcatttaatcaacaaatatttgtttagtagcagccactgttctaggctccaaagttacagggatgaaaggacaaagttcctgccctcaagaagcagcatgtaagtctcagtgaaatgatcagagaagacttcataaaggtggataatttgagattttatttaaatgacaaataagaattcatgggttagataggaaaggaaaagggggagcacatgcaaagccctaagcactagatagtgatagcattactaggatataaagtagtaagggtggagaaaaagaataatataaagctagactggttagataggagccagatgatgctgaagggtgaaggaccttctctgtctaactacagaaataggatttgatcctgcagtgggcaggagcttttaaggaattatgaacagtggagcaaaatcactctgatatagggttattgtacatctcagtctgtccaggacagactcattttatgaatagtatggtcccccttttccaaaggcatggtgtaagaggaactagagaaagcagagtctatgagtaggttatgactggcacaattgtttgaataagaagtattgaaagcccgaacaatagcagtggccatgggcatagagagaagagtatgaatacgagtgacaactagaagatagaatttacagatcttctcttgattagttcatatgtgaaaatcttgccttaccaaccaactgtacacttctttgtaccatgtgttagtaagatataactcaaagataataatactgacatgtttgcttccagaaagaaaggtgggccagaggcctccaaataaatgatgcccttcaaagtatacccttgagaagctgcacccttattcccatgattgttctataaccccaagatttttctggacctatttgaacactgcattgaagagtcaatgccacttctgtggtatttattctgagtgatagcaagtattcatcctctgagtgatggactggatttttttgaaatagcaaaactattatttttaaagagccaaacatgataaattaatagttttcttatgtagcttataaacttactaaaaaaatgtttggagcaatctatagaaacagaaagtagattagtggttgcctagatatgttttgggaactaagggaagatggggagtaactgctaacaagtaagaggtaaaaggtttctttctggaataatgaaaacattctaaaattagatcatgatgacatttacacaactcattaaatatgttaaagacattcaattgcacactctaggtcactgaactttatggcatgtaaatcatatgtcagtaaatctgttcaaatctttggagcactagcagtgtcctaggtttggaaatatatgttttgaacatgcatgggtctcattactttatgatcaaactttgttcttcattagactcatttccatccccacacccttagcactgtactaggtacatagtaattactcaatagatatttgtccagcagaattggatatagcatagtgcttaacttcaattcagagaagacagtgattttactaaatagtgtggataagttcttagattgttttttagcgattataccaatttatgtacccaccatcagtgtacaagggttccaattgctctacatcattgatataacgtttggtattgacaacctttttaattttagccattctgatcggtctgtagtgttaactcattctggttttattgtatattttccagaatgtttatgagcctgagcacatttttgtattttataacttcaacttttgttatagattaaagggtacacatgcaggtttgttacatgggtaaattgtgtgatgctgaggcttgggactctaatgatgccttcacctaggcagtgagcatactacccaataggtagttcttcagcccttctccctctcctctcctgcctagtgatccccagtgtttattgttcctatctttatactcgtgtgtattcattgtttagctcccacttataagcgacaacatgcagtatttggttttcttttcttgcatttgtttgcttaggttcatgacctccagctccatccctttcttagattttttttatatcctaatatatagtattatgagaactttttatagatgttgggttgtgacaagttttttttgttttccaaatatcagtaattttgaatataagcaaaatgggttattattactactttaattactataaaactatttgttattttaataagtagaaagtatcatttttatgtaaattatagaaatcccatgggagtatttgtctaatgttttatttgtcactgactctggcatcttaattttcattattaaattaaaaaacagtcaatcaatttctatttctctctctctctctctctcttccacctcctcctcttttcttctctccccacccatctcttaggaagcattgtgagtgttggggacccaaagaaaaaatacacaagatttgaaaaaattggtcaagggtaagtgattgttatttgaaatataaaaagatgagtacaagcaacatacattaaaattaaaattcagtaagagcttgggtttctggtaaattatgcttctcatttcctagattatatttatgtcttgcattctcagtattggcctttcagggggagtgctgacaacagttacaacattaacctaggaacacatcctgctgaaatcttcattattgttgggctgacagtaaattctgtgtggacattttgatcctatgtagttagaagattcaaacagatttctctagaaaaagcagtagggttatggaaacttctagcttacgtaaaaaccccctttatcgcagttccccctacagccacatggatggtatgattaagatcctgttttattgtcaaaatgtggagtgacaaactgagggtggggaatgtccttatggaatgatccggaggtaggcagagttgactatctgagtatggaggaaacagacaataatccctaaatgagacctagtgcatcattttcacttaatatacttgttaaagataaagattcccaggccccactgccaaagatttgatttagagtctggagtggggttcagtgatctgaactttgcaaaagtccctcagataatcctgataatcagcaatacatgggtaccattgcattagattattcactaaagctgaaggcaggagtcaccagttctgcaagtcaactgtactaatgcatgtctctcaggcctcaaagtgaaactaggcaggtggatctgagcaggcaacagcatttgaaacagggaaaagttttatttaaaggaaaatggaatattcttaagggacatccttaaatgaggagtgagacacatattcagggacaccaactactgtatgtcagaaacaaagatggcacctcagacttttcctggctgaggcaaggggctgaagacaaagggttacagccaatatgcttgcaaaactgtgctagccgatcagccattagaatctaattattttagggtaagagaaggtagaatttcttcaagaaccacactgcttttcctggcatacttaggttcaaaaaagtatacatcatatataagcttgactatttttcatgattttatattttctttgtttttccccctagcttttgtactaaagtttcttttgaaattgccagtatatctcaggaaataagggaaagcattcattagacgtttgggctagagaaaaggagaggcactcatggaaactgtgcctggtgggaatcaagatgagaagaccctaagggggacagaaactcaggaagaaatgcatggccaagtttattcttccagtcaaaaccataatgacattgtatttgaactttccagggggctaaaatatattctcatttgctcacaaaaaagaagagttttatggtctctagaagcttcctgtcaccgaatgggtcaaattaatatttctactcattgttctaaaacagtgataaacaacagaacttactgtgatgatagagatgttctatatctgtgctgtctaatatggtagccactggctatgtgtggctatggggcacttggaatgtgggtagtgcacataagaaactgaatttatgtgaactcatttatttgtttagcagatatttcttgagcactaactatgttccaggcactatgctaagtgctagagagacagagatgggtaatgatggtgtgggccctcaaggaacttacagtttacactgataagtgcttgacagagggatacagggtaccagaagaacctagaggcaagcttactcaattcaaccaagtatagagcagggccagcttctagagccgttttctcccaccgggaattttccctgtctacttctggtggacttgttgttttgcttaagtaagaaacctataccttcccaagtctatatacagacctcagctctccttcttcatgcctaaagggtaaataccaccagacagattgcaaaaagacagtattatgtactaaagggacttagaaaacaaaagttggcttttagatttcattttcatctggatgagtctcaggtggagctaacaataggaagggaagggatattcaatccacttagaaatagcactccaaatcattgttgtccagtatggtggccagtaaccacatttggctactgagcacttgaaatgtggctagtccaaatggaaatgtacttaagtataaaaggcacacctgatttcaaaaccttagtatgaaaaaataatgtaaagtatctcattaatatattttttattgattacatgttgggaaattttgcatacattggattaaagaaaatatattatgaaaattaatttcaccttttaaaaactttatgtaactctaagaaattttaaatatggctcgtggctcatgttatatttctaataggcagtaatgctctagttgtagccttaactgggagttatttgtttattaattcgtaaagtgtttttccatggttgttttttggagagtgggagatgttataattttgtcttgattgttccaactaaaggccaactgagccaaaaatagcattgaattttaaaaggaaaaagtacaagatggtttcagatacctcccagatactaggtaatgaaacaagactaattttgccaagaacaaagatcaggccaccaagcaactttgtgtaacaaagagatttcctctcttggctattatttatgcctgtgacttttaaagatgaaaaggaaagttctctatctctgagtctctttgtacagtcttcacaacctaaaatgaaaaaatcgaagcataaatcctgcttgccactgcagaaaggtctattttaaattcccagcaagttcatcattttaaagaatgataaagtagcagatagttcactcataggcccaacacaactttttaatacatccttagagggtatggagtcaattgtattcctacttttgtcttctttagtgtttagcacagtgcttttgcacttagtaggccctctgaaataattttgtgcagttatgatcaacagctgggttcactttggccagattcaaagaactgcaaagctgtctgccaactccgtctctgtgggtctgtttttgcctcaataaatatttgttgagctaatgaaaatgtttgtctttccactgcatcttctcactcgtaagtgggagttgaacaatgagaacatatggacatggaggggaacaacacacactggggccagaaggggaatggggggcgaagggagtgagagcattaggacgaatagccaatgcatgcggggcttaaaacctagatgatgagttcataggtgcagcaaaccaccatggcacacatatacctaagtaataaacctgcacgtcctgcacttgtatcccagaacttaaagtaaaattaaaaaaataaaaaagaaaatgtttgtctttctagctatctctttcctctgtcctctgtatttacatgtgtatatacatgcctatcttgctcctcctgtgtctgtctttccctgtttttcctcagtgtgtcttcacatttttgtctttcacaatgacttgattggcctcaccacatctgattcctttattctctgggtatttgtgtgtgctgcatatctgtcttcttcaagcatgttggccttacattctactgcccattttcacacacaccccacaacccaaattgtcataatataaaatcaagatgtatttaagatataatctgccggcttaaatctatttactatgattttatcatttacttaatttactaattttatttttttgatcttagtagattgtttttcctcagttcttaattattaaagtaaagcaaaatattgacttttttctttctggaccaaaaaaaaaaaaaaaacccacctcccacttatattaactttctttttacttaaatggctttcaactgatttttttttcattaattactggcctaagttatataaactagtagtctctactctcaatatgtagagttttttaaaattaaatctgtgtttttaattgtttttgccttacctattattacagtgacattcaaaattgttgtcaataatcatttggtgttagggataatcagccccagtattttattctcagctccagagagcacaacagttcactcactctcaggagctggatttgagaagagcttctccattaatcaccttcatttacttggaaaactaaattttttctccagcatgggtttctgccatcccagcattcaggcctggggccagagaattgggctccatcttccataaatcaagttcagaatcacatgtctaatcgtttgaggccatatctgtgagttgaaggctaaaaatgacattgtttcactgggtttgctgtgaaaagtgttctataattggctaccaaatccagacattttgagcaaatttatgcaaagttaaaaaataaggaaagaaagaaaaaaagtcaggtaccccaaaattatcattaactcaacaacatgagtttgtcagaaatatatccggtgcgcacttgagaatcttcactttctagaatagttatataaaataacttgtttaataaatgaggtagagtgagacaacaaagtcaaatatttattttcagtcaacagctatcaatagcaaccctgtgtaattcctgaataagcaatagctatgtaacagagggctgaatttacaatgttggcagctgtcctcacagatttctcattaatgtatttgaattcatgttagggtctttccttaaatgagaatgcactgaaaaacaggcctttttttctctttcaggttcatattgtcttttctcttcaacattataatagaaaaatatttttgaggaagcagctcagaggatccagtttaacaagtatatttttaacatcaatgaacctttaatgagtgcctactatgtgtaatggagagtagcagttaagaatcaggttctcagagttcacagtgacctctatacttgtggtccccctgaatactggacatggagaagagttatatcaagaaataagatgaacacctacccccaataatgtacctttcctctatattttattcatacactcatcttcactgtcatctctcatatgaatcactctttggctggcctggtcctaattgaccttttctgtcttttgtttttctgaatcctacagattatatctgtgccggcatgtattcaccacttatatcttagcttgtctagacatgtaaaattgcttgaaactttgaggaatgtagaggaataaagggagaatttttgaaaaacttgaagaaaaagaaagagacaggattctgaactcagggctgtagaaaaattatttaatttctttaagcatcagttttctctttcatagtaagcagaatgcacgtatctcataaggttgtaaaaataaataagagaaggcatttaaagtccttagcacagtacatggcacatagttaattgctcagtaaatgctagttattattagggatgaaagacacactcatatgttgctattatatagaacagaatataataagtattgtgaagaaattacaaagatctctgtggacagagaggagggacaaattatttacagccaaggagtgggtatgatggattcttagaagagggtacacttgagagtgacattagagggtataggaatttaacaagtagggtttataagaagttttgtttgaatgcttacttcagactgtaggtttcattcactttggtatccctaaggtctgcaacactgccccagcatatatgctcaaatataaggtaacacaataagataattttaaaaagttttttgatgcacctgcatacataaactgttttatatatatatatatatatatagagagagagatatctgtatatctatatatctatatatatatatatatatatggttgaaagtctacttatgatgtttgttaatttactttcattttcatatttaaaaccacttatataaagtattattttgtagagatttttctactctcatatttcacgagtggtataattcaaaatcttcttatgtgtctttaacatcattctttttgtaatcactagagattatttttgagtcttccagcagttactcaaatatattacctgacttccatctaagatatttgagattttgaacccacatataattctgttcgtggatatttattcctagtcacaattacccattcatataacattaagactattgttttttgaatttgtcctgtaggtgtatatttaggtcttcatgacatatatctactatctactatatgactttttaaaatttctattacaaattgtcatacttacacaaaaatagggaaaataacacaggaactactgtattcttatcactcatattaaatatttatcaacaatttttaataaaatcacaatgccattacatctacaaacaattaacaattgcttcatatcatttaactcccagtctataatcagaattctccacttgcaacaaaacgctatttttataattgatttgttcaaatcaacatccaaaggagatctacatattgcatttgttgtatatcgtaagtctgtataccctgaagcagtctcctttctttttccactaccattatcttgttgaagaaactggttattgccttgtaaaatgtggcactttctgtatttgtctgttagtttcattagctgtcatttaacttgctcttctaacttccacctctgggattcaggggattctcttgcctcagcctctcgagtaactgggattacaggcgtgtgtcaccatgcccggctaattttgtatttttagtagatacggggtttcaccatgttggccaggctggtcttgaactcctgacctcaagtgatccacccacctcagcctcccaaagtgctgggattacatatgagagccaccatgcctggccagatgcttgcttttttaattgccagctttcattgtaaagagttagcatggagttacatacgaaagtgttcaatgaggggtattttgatatttttagtagggaaattttattaagtatctttataaagtcttacaattttacattgtcaatatgtttcactgagttgcatctattattgtttatggtggtcaaactattccatctttagctaatgggagaccctttcactgcattagttttgacagaggtcttttaatagcttgtttacgacatccaacacttgcagttatgtggtcataccctccaaaataacttattcacatcctttctttgtaattctgacaggtactctctatgagcatccaaaactagcattaattgagaagatatcaacctaatatgtcctttccaaactgtattttatagttaaaaataaatgaatatggataagtaccaatcacatgaaagatttttataagaacttgcatataaggcagctccatttttatgaggaaaaattgggaggagaaaacccttatcttgtatttgggtatatatggtgcatttctgtgcatgcatgtatgtttgttgtaggtatatttttagcacaagtggtaacatactatatatctccttttttattgtgtttctgtgttttagagatggttctatgcttgtacctcatactttttaaacagatgcagtgctttgttatttgaatagtaccataatttattgaactaggccctaaatggacatagacatttaatttgtttttgatgttttgctattataaacaaggcttctgtgaagatccttacaaataaaccattttatacaaagttatcattagaatagattcctaaaagtggaattgttatgtaaaaggatatgtgcatttttctttctgagttaccctccttagaggtttgtttatttaacacaccatcaataatgtatgagagtgccggtttgcctgcacctttgccaacacagctgtattcacttatttgggattatagtcgtataataaaaacactcccacactgacttttttaaaaaggaaaataaataagaaaggaactctaacaagaaagcatgtggcaaaacaaaaggctatcctgaagaattaattagccaatgtagtccatgtctttataatgccaaagtatctttgttacatgttatatctctccataggttagattagctatgcagctatgtttgacagaaagtgacaatgagagcatttcttgaaatcatttttctcttacacgtagatatatatctgggcaaaggaattttgtctaacatctggatctttgtcaatcatatcattatatagaatgatgatatgttcaattcatcaataattgctaacaaattttgctactagctcatgcgtaatcaagccctcagtcccccccgtctctctaaattagttttagttttaagactacagaaactaagtatataatgttaggtatttttcagacttatctctgctactcagtgagaagcccctttcttcttaatctaacatgaaagtctcatattgaagatgaatagctttgaaacttatttcttaaaagacttgttgaataacagtgtcgtttagagaacctgacaaagcagtgtatgccatggaactcagagtgctgagaataaaacctctgattttttttttttttttggttgttcaggaaactatgggcaagagtggtgtctagtgtgcttatagaagtgattctttgggtaggaccacccaccccaaaagtatttgcttcttcatcggatctattttgggccacacaaggtagaacgctgctatgaagcactaaatagatgtagtctgagttctataaaaggctttgtgatgtaggagattggaaatacattagcatttgtgaagaacaatgtttatggagcaatggaagatgctctttgttctacttaatgctcttaaatgcactgtgttgtgtgctgtcccttgtaaagaaagatgatgccactcaatcaaacaccattagcagagtttgcacgttaacttgttttttccagccacagtaatgagcttgttttaagccacctgcccccctttcctgtccaggcctcttgaatccaatggcacacactgtgaaacagctgcttagatttaatgttggagtgagtagccgagagttatctggcctttccagggattaagccttgtaattgtggcctcattatcactggactataacccaccgagctccctggccccacacccataatgtgttacagctctctttaaaattagatgaccgtgaatactctgagaaaagtcatgccctagctaaagaacagaaaattccgtgttctgatttataatcttagtaattaaagactataccatctggccccagctacattctgtgtacttagagcagtactgagataacatgatttttacataattttcttttttaaatttagggatgcattttttagaagtaaattacacaaaggaaaacgccagaactctgtctttggaaaagttattgcatgtgatggtaacatcattcctgagccccaaagaacacatctctcaacaaaacaagtaactatatggtagtatcaaactatatatatacagatatatatagatatataatctgtttttatgtcaggtgcgttagtatagtgagacaatatctagataggagcctacaagtagtaacttttttaatattcagcaaaagataaagtctatttctaaaaactaacagcagttcattttcagccacatgatcaatcttaattgagtcggcaaacagaacaacaacttgtgtgtggttataccaaaggaataaaacataccatgtcctggtacaaactaaatggcttgtggacaaagtgagtagaaaattaaaggcaagataaacattttggggaggcggcttagcataacaggtacaaacatgagctttgggaagtaccacacttgcacttagcactgaggtaaaaatgctaaagatctatagcaaaacatgaaatggtgattaagagcatgggctgtggagagaaagtaatgcatttttaagctcagctgctgattgtgcaaccttaggcaacctacttaacatttctttgtttcaatgtcctcatttgcaaagtgaggaaaatctaatttatctcatagagttgtacagggtgggcattaagtgagatcattacagagagctgcagagagtatggctcaataagtgaaatagcctttttatagcagcagcagcaataggaatacatgtaaaaaaaataaccattctatatggggtttaatccttgactatgacctcattagcaccagatttatatttgtaaaaccttaatgggaattttgcctatctttctggctccctcattcttattcctaccagattcttcttggacttcattgagcctttagacctcttgccctttttgttttctcccagtatatgagcttcttcctaggctcacttcttcacccttcttttcctctaatccatttccatgctgaaatcaaagtgacttatctaaattattagtcctaccatgttgctacttttacaactactcatgattatggcttgacattggcacttggtgggaaacatcaaaacctggtcaagattcctgataatgaaactgacctgctttatgaggaaaagggagaattgtgaattgtttctttctggacccttcaggctagatgccagtgtttccatttgagtagtaagcgcttggccatgtcagggagagactgttgacaaagcatctaatgtgatgccaagaacccagatgtacttatcgcattttaattgatgatgggtcccaatggttgagaaatctgttggtttagtattctttaatcatagtatagttaactgaaagatctctaacttcaagttaggagacctttgttacttacttgctatgttatcatgggcctatccttcctgctttctgggcttcagatttctcatttgtaatgaggaagttaaactggatgttctctattttcctttgagtcctgataatgcatgattactttgtactatctgagggattgagatttggaataaaaacaatacctatcataaaagcatgttcttcctacaggaatctggctttaatataactggaatggagtgataatagggatcaatgtaattaaatgtttagcataaaaatcaaattgacagtgttgcccattttagcacaccagacccaatacactggagaattaggaattttaacccctatctttgttagtttgagttttggcatctttacatcctatagtgctgcgtgacactgacttttttttttttaattatactttaagttctgggatacgtgtgcagaacgtgcaggtttgttacataggtatacacatgccatggtggtttgctgcacccatcaacccatcatctacgttaggtatttgtcctaatgctatccctcccctagccccccatcccccaacaggccccggtgtgtgatgttccccttcctgtgtccatgtgttctcattgttcaactcccacttatgagtgagaatatacgttgtttggttttctgttcctgtgttactttgctgagaacgatggtttccagcttcatccatgtccctgcaaaggacattaactcatcctttttatggctgcatagtactccatggtatatatgtgtcacattttcttaatccagtctatcattgatgggcatttgggttggttccaagactttgctattgtgaatagtgctgcaataaacgtacatgtacacgtgtctttatagtagaatgatttataaccctttgggtatatgcccagcaatgggattgctgggtcaaatgatatttctggttctagacccttgaggaatcaccacactgttttccacaatggttgaactaacttacactcccaccaatgatgtaaaagcattcctatttctccacatcccctccaacatctgttgtttcctggctttttaatgatcgccattctaactggcgtgagatggtatctcattgtgatttttgatttgcatttcttgaccagtgatgatgagctttttttagtatgtttgttgaccgcataaatgtcttcttttgagaagtgtctgttcatatcctttgctcactttttgatgggattgttttttttcttgtaaattttgtttaagttccttgtagattctggatattagccctttgtcacatggatcgattgcaaaaattttcttccattctgtaggttgcttgttgactctgatgatagtttattttgctgtgcagaagctctttagtttaattagattctatttgttaattttggcttttgcttccattgcttttggtgttttaatcatgaagtctttgcccgtgtctatctcctgaatggtattgcctaggttttcttctagggttttttatggttttaggttttatgtttaagtctttaatccatcttgagttaatttttatataaggtgtaaggaaggggttcagtttcagttttctgcatatggatagccagttttcccaacaccatttattaaatagggaatcctttccccattgctgttgtagatgtgtggcattacttctgaggcctctgttctattccattggtctatgtttctgttttggtaccagtaccatggtgttttggttactgtagccttgtagtatagtttgaagtcaggtaggatgatgcctccaggtttgttctttttgcttaggattgtcttggctatataaaatttcaggccaataccaatgatgaatattggtgcaaaaatccccaataaaatactggcaaactgaatccagcagcacagcaaaaagcttatccaccacaatcaagtcagcttcatccctgggatgcaaggctggttcaacatacaaaaatcaataaacgtaatccatcccttaaacagaaccaatgagaaaaacctgattatctcaatacatgcagaaaaggccttcagtaaaattcaacaccccttcatcctaaaaactctcaataaactaggtattgatggagcatatctcaaaatattaagagctatttatgacgaacccacagccaatatcatactgaatgggcaaaagctggaagcattccctttgaaaaccagcataagacaaggttgccctctctcaccactcctattcaacatagtgttggaagttctggccagggcaatcaggaaacagaaagaaataaagggtgttcaaataggaagagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcctatacaccaataatagagagccaaatcatgagtgaactcctatttacaattgctacaaaaagaataaaatacctaggaatgcaacttacaagggatgtgaatgacctcttcaaggagaactacaaaccactccttaagaaaacaagagaggacacaaacaaatggaaaaacattcaatgctcatgaataggaagaatcaatatcgtgaaaatgcccatactgcccaaagtaatttatagattcaatgctatccccatcaagctaccattgactttcttcacagaattagaaaaactactttatatttcatatggaaccaaaaaaagacaccaacttttaaaaattaaagtgaattaaggttttattttgtaaatatatgcatggagatattttgatataccccaggccgttgcaaagctcatctttgggaatcagcacaacatggttggcatgaagattgtttctttgggagtatacactactgtgcttcagttattacaaggagagtgcttcccaacttcaccaagatcccttcaattatttgtctttgtaaaccctgggttataaataattttgatgattgaactgtatttattaatagtttatttattgtactttattaagcaaaaaatacatataactgctaattaaagcttttaatcatcatgtgatatccaacataattacaagttgatataattctagctaaaaggaagtatatgtgatatttgaattagctgttctcaggtaattgtcaatttttttgttatgaattttgaaacatcaaatatcttgaaaactcccagatacttacagagcttccttatgattcacacactagaatttgagaatgtaatgaatatgttaggaaataatcaaccaaataataattatcattactgctaatatttattgggaaatcactgtatgccagaactatatacatttaatcctcctttaatcctaaatcacaaagaaactaaattacttacccagagtctgacaactaggaactagtagtacttgaaccaggggaggtttgaatgaatgggagtgaggactactgttctcaacccagcagtgagcaatgagagagctttaatagatgaatcttgaaggaagttgagatctcttgaaggagagattcatatttatacccgttgaattttaaattgttagaatatgtaaaagcatcagaactggggtgcagaaatatgttgggagtgctaagacagagctggggaaaaggtggtaaattttaatttgcaggttagtacctgaatttgtgcattcgagttgaaggttgtgcaaaggctagaagttgcacaaaccaataacttattggtcagagcagggagttccaaccacctaacaacatgtttggtttgaggggattggtaagtgtggtaggagaggatattaccattttatgacaagagaaccagggtacagggtagggaaatgcatatatatatatatatatatacacacattacacaattgcatatatggagtaagcggggaggggaggggaggagaaaggctcatttttagttagcagctggtgctctagagtttcaggatatttaaacctctgtggattagtaatttgtcgcaattttataccactggatgccataaatcccaggatattgagattccagggttagaactctagcaattttaatacaattaaatgctgagggtgctggaggacaaaaaaaaacaaaacccacgaatttgaaaggtaaagctctgaaaatgttaaacatgaatccccacttgcactccaagtcaatcacaattttagccctcaggacagtgggaatgggcttgggggttagggagacagaggtgttgaataacagaaagggcacctgggcaggtattttgggcccccctccctagctttaactggggcaactcccaatttatttgtttaatatattgagggtttcttcatacagtttcatttgataaaggcgttccaactttcaaagaaaagggtaaaaccacttccctagggggggagaaaggatgtggaacctctaaaacgtgttccaatagtttacctcagcctctgtccttttggaaataggggcagatgttagcaaggatgctttggctgggaggtttggatgggccaactaatagttcggtgtaccagtcatcccctactgtgaaaccaataacaacagcggcaacaacaaatgatgataatagcagctaccatatagacatcaactctgatctggcacagggctaaatgcttacatagattgtgccatgcacaatctctacatgtaattctctacagccctgtgaaataggaactattatctcattttgcagatactctcactcttttgcatctaaaggaattgtgcatgcggcctaaatacatgtgaataaaccagagtcacttttatttatttatttttaaattttattttagatttagggagtatatgtgcaggtatgttacctgggtatattgcataatgctgaggtttggggtacgaattatcccatcacccagaagtcagcatagtactcaacagttagtttttcaacccttaccctcctccctccttcctcactctagtagtccccagtgtctattgttgccagctttatgttcatgcgtacccaatgtttagctccagcttagaagtgagaacatgttgtatttggttttctattcctgcattagatcccttagaataatggcctccagctccatctatgttactgcaaaggacatgatctcattctttttatggttgcataatattccatggtgtacatgtaccacatttttctttatccaatccagcattcatgggcccataggttttttccatgtctttgctatcatgaatagtgctgcaatgaacatacaagtgcatgtgtctttttgataaagtgatttattttcttttggatacatacccagtaataggattgctgggtcaaatggtagttccgttttaagttctttgagaactctccaaactgctttccacagcggaagacctaatttacattccctccagcagggtataagtgttctcttttcttggcagccttgccaacatctgttgttttttgactctttaataattgccattctgactggtgagagatggtgtctctttgtggttttgatttgcatttctgtgatgattattgatgtggagcatttttttcatatgtttgctagctgtctgtatgtcaaaaggcatttttaaatcatattttgcaattagatttaagtagtttctcaggacttattgcggctgaaatatacaccaagtcgaggtgatctattcctttgaactcaaataagttcagaaggacaaatcacacaccgggctctgaagtcaggaatgtttgttcgcttattccaagagcaaagtgctttatttagatttaagtagaagaaatgttttcttcacagaaaggaaaagtcatattggcattgcatgtttgctttaaaagatttttattaatttgttcattcaacaaatatttattgggaactaactgtgagctctgagcccagaatctcacacttacagaagtgaggaaatgatttgtctgatataagcctcaagcctaagaaatttctagaattatcaaatcccggtttaggtggcacctattgattaagtgtgatttttcagcccagttccaatcgatatttagaaacacaagcagagtgaggagggtagtagagttgtagattataaatcatagaattaaagaaccttagaaataaagtagctcatttcctgtactttaaaagcaagagagtcagacagacacgggttgttaactgtgtaaccttgggcaggtaacctctctgaacctcagttcatcatatgtaacatgggaataatagcatctgccttataaaaatatggtaaggattacataagataaattatctaaagttcttagtgcagtgtctgacatatacaacatactcagtacatgtttactgttattgtgatacctgttttccatgtgaggggactgaaactcagtgaaaggaagtaactagcgcaaagtcacatagcttgatgatgttaggacaaatattagaactcagatctctactaatagtcaaatatgccttatactacacaccgagtttactccctgagagccaggtcatatacacttcctggacctgtgagaaatatttgggctaatacaaggagaagggaaaagaatgacaaggaagtgcctgacataagaaaataattcctggactcagaaaacaaaacagcaaggatgaaataaagaacaagagaaataattaccagaaagtttacaaagcaatgttggagtattataacatgtagtcaatcacaggactgatctctattctaactcctttattcactaaaagcgaaattgactttttttctttttcttgaaggtgttggtgggaggtggtttagaatgcatttgtgattcatagaaggttactgtgaatgcagcttactatacaatttctatttgcaaagcaagggaaccccataaatgaagttagaatggaagcaagagtactgctaagatataaagaatgatacattattaatttttttgagacatggactggctcattattaatttttttgagacaccaggctggagtgcagtggcacaatcacagctcactgcaacctcgacctcctgggctcaagtgatcctcccatctcagcctcctgaaaagcagggactacaggcatgtgccaccacacctggctaatttttaaatttttcatagagactggatctcaccgtggtgcccaggctggtctcaaacttctgggctcaagcaatcctcccgcctcagcctcccaaagttttggggttacaggtgtaagccactgcaccaggcccagaaatgacagattttaaaagaatattgggctggagtgacacctcaaagtagaagttgttgagaaatttagtaaaaataagaaaacaatggctcaataataaagtcatgttgctattgcttcatgtagctatagtacagtacagcactgagagagattggtctttagatgaagatagtcttaaaaattggaaatatatgaaaagaaccactcggtttctatactaaaagggaaggttaatttatacttgcctaagcaaaagatgatatattctttcctaaactattcttcagtttaatgaaaggcctgcaatgttggttattacaaaattcaagaaatatttaggggattccaggagtttcctaaaagaagcaaggccattttgctcaatttattactgcatagtgcatgacactcagactagtgccagaaaatctgactggagttcctagtccaccacaagggatacattgtgattgtttcaggtgcatatgctgtataaaaagattgttccaatactgtacacttaaaaatttgttaagagggtagatcgcctgtgtttttttttaatcacaataataatttttttaaaaggttgttccttttcttacctcataattttgagtttgctaattttcctcccctcaaaataattacattttatttcaagtaaaatatattggtaacagcttgattgcttattcttttgataattttcaccttcacagggcatcaggtactgtttatacagcactagacattgcaacaggacaagaggtaagtgctaacgttcaatcctgatttttattttcttttattcatatttaacagttatcttcttcgatggcaacttcgcctaaaaaaaaaatgggtagcactgggttgacataggtgtttacttccttggtgcccaaagcctctgaagtgagtagtttacccatgataaccaaaaaataaaaaaaaaagtggggggcatgtgtttgtggcacagggaaagagcttagtaaataaagaatgtgtatgtttcactctatgtcccccaaaatatgaatattcatgtttattataatgattgtaattcattcttgtattttaattgccattcaggtggccataaagcagatgaaccttcaacagcaacccaagaaggaattaattattaatgaaattctggtcatgagggaaaataagaaccctaatattgttaattatttagataggtaagtgttttgtcttattatgtacttatattctttgtgggatgtcattttttcttggcaaattactttatttgggattcgttcatttaacattctgcaaatatttctcaaatgctacagtgtagtagagtattagatctattgctaaacttgcactcacttagctttgtccacatatcagacacttgaagaaacattttatggtcttggttgtaaatttcattttgagaatcatagctccattttggcagaaaatagaccattgcatataggagggagtagtggtttaaacattacatcaagtgtttgtctggagccagtacaatttctgggagtctaagtgaagaaggctgactacaatggctttaatgggtgctttgtgattaactaacagtgaggtctagggaattcagactttaatctcaaacctttttcctaaacctggtaattaatgtctctttatcagtggtattaacagtgtgttataaataggtatttaaaggcagcactaactcttcacttgtggttaacatctgtctcattcaatttcaaaaagagtttgtttagtaccactgtgcggtgttctctggaggggatacaaagaaactaaatctaggtcttcaaactcaataagcttaagatactgttttctgctttttgggccaggtagaccaatgttacagaagaaggaaaaactgggaggaaaaaagagggttaaattttacagtccttttttttttttttttttttttacagagtcttgctctgtcgcccaggctagagtgcagtggcgtgatctcagctcactgcaacctctgcctcctacgttcaagcaattctcctgcctcagcctcccaaggagctgggattacaggcgtgtgtcaccatgcccagctaatttttcgtattttagtagagacggggtttcgccatgttggccaggctggtctcaaactcctggcctcaggtgattcacccaccttggcctcccaaagtgctgggattacaggcgtgagccactccacccggccgcaaattttacagtcttgatcagtgtctcctaaagtgtaacttaggaaccacctgcaacagagtaacctaaagtcattctgtgtttgtaattttgcaaaaacaaaaaacaaaaaacaaaaaacaaaaacaaaaaaaaacaaaaaaaacaatgcatttgcacttataaaaaattcagaattctaggctgctttccataaataataagatgaggactgtgaatttttgtttttaacaagctttccagatgaattttatggacaccacagtttgagcaccactggatagaaaatcttgcttcacattgatatgggtcttagggcagggtgggaacattgggttcattccatttcctataattcatctttcttgataagcaaggtttcagagagacctgattgtactgctaaagtgccgtcagatggtgtcaggtgatttgaataacctcatgctctctttgcctgaattatagggctctggtgacccttggctccatattatgatcacttggagtatgtccctcaataccttctcaaaggtaatgggcatagcacaactcagagttgacttctatcagaactgaggcctgggaatatcagagtccccaggttttttagcgtcataaggcaaagtcttttcttttcttgttatagctacttggtgggtgatgaactatgggtagtcatggaatacttggctggtggctctctgactgatgtggtcacagagacctgtatggatgaaggacagatagcagctgtctgcagagaggtaagcaaatagagcatttctagctgagaagaccaccgaaattggcagttcttcatttctgattattcagaatgtttgtatcatcaaagtaacaatagtagaacttttccactgaaaacaattggagaggccaacttcaatttaaattctgtcctaatagcactccccagcatcaccctcctgagcctcttgtttattttagctgccttttgtgaatcttttagttccattatgccatttgtgaggtgccgtatctaaacccacatgctgtagtttccgtgaacatgggaaacagtgatattggcatagcacttctttctaatttggggaagtttttacatgatacttattttatcctgcatgtgtaatatgagccatgtaaaataaattatattttcatcatttttagaaggcaatttaaacaaggtcctccctcaggccagaaagcagttgctttcacagtacaatctgaacttcccttacagcccccaagtgggcctgacggtctgtctcttttccagtaagtgtcatacccctaaggggtttcaaactaaattaaagagatgttattatatttattttgttgaatattaaaaaacacacacacttttttactggagtctcatcttaggcattataatctatcccatttattgtggtgaggttttctatcaacaaaagtaggaactctgactcactgaaacttgaaaaccaatgatagaaaaacaaaactaagtgatatcagctaatctctgctttttttttataagttgttcacttaaatttcctccttccttgctctcctctcattatcattttccccaccccacatatccaccaaacatatatgttttctattcattcaatacattaaacttactaccctgagcctgtggtttccttcttccagcattacactgcaaaggcatttccaaacaagtgcctatagttacttcatagcctaggagtggttcccaaacctggctacccattagaaatagtttggggcacttgttttaaatgcagattcctgggtttcatgccagaacttctgaatcaaatcatgccatctacaatgaagcttaccacagctatagaagaccaagctgaatcctccaaataactgggccaaagtatattaattggttaatttgactgtattattgattggtgctatttatcacattatcattcttaatgtcctagtctgatgtgtcagccatcatacttagcatgataatgctaagtggcatcattgatgtaaatggtaatgtgactttaaagtggtgttgttaaagcattcagtaatcgatttcacttgacaatataaagttatatccctgcccaaaatttatctagaaataaaacttagtattaaaaattatttgtgatataattagaacttttttttctgatttaatagtgcctgcaagctttggatttcctgcactcaaaccaggtgatccatagagatataaagagtgacaatattcttctcgggatggatggctctgttaaattgagtaggtattttggttcaggtggtattagagtatcagggaatttctgttctttcattgtatatcttaagaagataatggttactgaaagtgatttatttgaaagaagttacagcccagtttgaagtaaagaatttttctaacactgtgttcctgaatattgtgaccacattttttggatttaatatttcagaatttctagtgacttgtggaatgaataaatgacaaatacctaattaggaaactgaaaaattctgtaagtttgagaaaacagtgatgagagggaattagattgaagtctagtaaaaatgacatcacgttagtcaattatttcagaccttcttaaaatcaggaccagctgagacatcagttaacaaaaaggtatgagctaggcagttgtggaaactcagtgtgtagcaaaggaaggtacagccatatctgaaagtgatatattgtaaaaggaaaataatttgggcttattttaactggcttttcttctctgcagctgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggtaagtcagaagagaagtcaggtactttattcccaggaaagaggaaaggccaaatatcatttctggcttccaccaaaagtgaccagaatgggctcttttctgagaccagtaacatagaagcaccaagttataattttcaaatttactgtaagctttttaaagtttatcttacaatgtctcaacagttttccttgtctttttctttctttctttcttttttttttttttttttggagaaagaataactaccctttttttctctttttctcatttaattcttttttccttccaactttcattttaggtgcagggggtacatacgcaggtttattatataggtaaattccatgctgttggggttggtgtacagattatttcatctcccaggtaatgaatgtagtacccaacaggtagtttttaggtcctcagactcctcccaccctccactctcaagtaggccccagtgtcaattgtccccttctttgtgtctgtgtgtactcaatgtttagctcccacttacgagtgaacatgcaacatttggttttctgtttctacattaatttgcttagaataatggcctccagctgcatccatgttgctgtaaaggacatgatttcattcttttttatgtctacataatattctatggtgtatatgttccacatttttgttatccaatccactgttgatggacatctaaattaactccatgtctttgctactgtgaatagtgctgtgatgaacatacacgtgtgtatgtctttattgaaggacaatttatattcctttgattatatatccagtaatggtattgctgagttgaatgatttatattcctttgggtatatacccagtaatgggattgctgagttaaatgatttatattcctttgggtatatactcagtaatgggattgctgaattgaatgataactctaagttctttgagaaatctccaaactgctttttacagtggctgaactaatttacattccctccagcagtctataagcattcccttttctcctgaacctcgccagcatctgttattttttgactttttttttttgagacagagtcttgctctgttgcccaggctggagtgcaatggagtgatcatgatcttggctcactgcaacctctgcccactaggttcaagtgattagtgcctcagcctcccaagtagatgggattacaggcatgcaccaccatgcctggttaattttttatatttttggtaaagaagggcttcaccatgttggccaggctggcctcaaactcctggcctcaagtgattgacttgccttggcctcccaaagtgcttggattacaggcatgagccaccaaacctagcccctttttgactttttaataataaccattctgactggtgtaagatggtattcattgtggttttgatttgcattactctaatgattaatgatgtggagcattttttcatatgcttcttgggcacatgtatgtcttcttttcagaagtgtctgttcacgtcttttgtccattttttaatggggttgtttgatttttgcttattaattgagttccttatagaggctggatattagatcttcgtcagatgcatagtttgcaaatattttctccctttctgtaggttgtctgcttacactattgatagtttcttttgctgtgcagaagctcttcagttaaatgaagttccatgtgtcaatttttgtttttgttgaaattgcttttggagtcttcatcatgaaatctttgccagggcccatgcccagaatggtatttcctaggttttcttctagggtttttatagctttaggttttacatttaagtatgtaatccatcttgagttgatttttgcatatgatgaagggaaaggatccaatttcaatcttctgcatatggctagccagttatcccagcaccatttattgaataggtagtcctttccccactgtttattattgttgactttgtcaaaaatcaggtggttgtgggtgtgtgactttatttccgggttctctcacctgtcctattcatctatgtgtctattttttttttaccagtaccatgctgttttggttactgtaggcttgtagtacagtttaaagccaggtaatatgatgcctccatctttgttgtttttgcttggtattgctttgtctattggggcttttttggttcccagtgaattttagaatagtttattctaattctgtgaaaagtgtcattggtattttgatatgaacagtattgaatctgtacattactttgggcagtatggccatgttaaaaatattgattcttcctatccaagagcatggaaagtttttccatttgtttttgtcatctccagtttctttcatcagtgttttgtaattcttgttgtagagatctttcaccttcctggttagctgtattcctaggtattttattttttagggctgttgtgaatgggattgtgctattgatttggctcttaactggacatcgttggtgtatagaaatgctactaagttttttagcattgattttgtatcctgaaactttgctgaagttgtttgttagatttagaaggctttgggcagagactatgggttttctaggtatagaatcatatcatctgggaagagagatagtttgatttcttctcttcctatttggatgccttttatttctttctcttgcctgattactctggctagaacttctaacatttttctaacatgctttgattgtatttttaatgacaagggtctttaagattccttagtatagctttctaatgtaaaatacatgtagctttttttttaagtgagatgtggggagaaagtacttttattacatgacatggttaaatgatcaatctaaaaaacacttgctttataattactttaacaaagtaaataaatgcatttccagaacagctgtaatttttaaattggattttccttcattatcagtaatgatttattgattaacaacagcttggtgggtattgagtggaacacagagatagacatagtgccaacctggtgaaatcagaaacttaattagattgtcaagtagaaaatgattggaaacagtttccgtttggtaactcactttgctaccacaaaatcagagatttgatcttcatgtgatcttgttatccctgcaaagagaaaaacttcatttcacaacctaatcctatcatcttatttcggagatgtgctgttgatcatgaggaggaaaggaaagaggtatgaaagaaatgcttactcagtgcagaagtgagccataggtattttgttgtgtatagcccaacagtgagctattaatagaagctgtgttttgtgtctataacaggcatcacattgtttaaaaaagaaaatatgcacagattcaaattctactctcaaagttcaagcacagtgctagtatcataggcatcttgtatactgcctgcatcattaccactaggagtctaaaattgaattgtacccttggtatgccaaaaaaaaaaaccattgttcttagtaaatggttaagtgttttcatataaagcttgcaaaatccatgttcaaaccaaatatatgtggctttctatgcatgtaaagagacctataaactaactgtctagttgttttgcagttaaacattttgtatttgggaactgcattccctgtatatggagaggaggacagcttcctcctggctctctcctaactcctctctggtacttggcctcttgttttattccctgtgctgattagaaaacaacagatatgagggaatgccctaatgaatgctataggctatttctctgatctcatgcaacaatctggaaatgagatgtgcacattgattagctgccttcagggctgagtggaaaagaaggggcattttcccaccgtttgtgggttagccctccatggatttaatcaagtccacacctggcctatggtccagcgcatcaggataattacatgggcttttccttattgtttaaccaccttcacccattaagaaatagcagtgaaagaacacatcggacctcttgtttctatggatttcctcccctaagtctttggagtttggaggcactaaatggattatggctattttgctttctgccttctaatgagtaatttacagcctgcaaattttaaggattaaacaaatggctctgtaaaacaactagtctcagtaatggatttattaccttcttcaattccccaattacaattgatctctctttagctaggctgctaattattagaaaaaggaaacaagttttaatctttataggcatcttctagcctaggattagaactcacaattaacagcttgtatcttagatgccaccgcctgatatctaaacaagtacttgcagattaacaaaccacaaggttcaggaagcctacattaagtctgcaacaaaaagacctgtgagaaagaccaccctgttgaattccactgataaggatttactctaactttgctcattactctctgtatgtgtgatcaaccttcaattaatcaatcaacaagcccatacagagctagctttattctaattttgtctcttctaggcatcaggagtacttttttggtttcgatttcaaatatgttttcctaatgttctcttgaaggaaacacaatgtctcaggctatatgcccttatttggaatctttaaaatgtagtcgctgaaaccatggggagattggagagaaaaaggatctaacatgagcctatagggagcagcgatttcttggatcctggtgcccaggccatatgtggggaaatagaaaataatccagagctttaagaggagtataaaagagtgccagattagtcttctttaatatccttccaacactacaacacatccactattgtgtgctttgaggtggaaagaggtagaaggaaggaagtgaaataagtgtaagaaagacagagtagtagagtacagggtagcatgttgatgtgaaaaattttggtcctgtagtcaggcagatctgggtgtgtcctggctctacaacctgcaagctctgtgaccttctgcaagttacttaaaacctttctaagcctgcttcctatctgtaaaatgagaactatgtctatcttacagagttagcatgaaaactaaatgaataatatatgtaaatcacctagcacagtgtccagttcactgtaggaaaaaaatatatatgtatatatttatatatatgaaatgtatatatggatagtaaagtagtaagataggaaaaacagagaaaggatgtttagagggttttttttacccactcatgaagggaggttggattcagcactctcctaagaacatatccttcatgagagtggcacacccatctactcaaggaatggagggttttgcacagttcagtacaattaccatgaacaggtaacactgaacagaagaagttcaaggtgaagtctggggctatacatttcaaggtcatttatgtttcactgtgagtttttctgtgtctctgttgtatcagttccagctgagcagaccctttatgaatattgcctattaacatattgttaatgcaatgaattaactacttttccccttagttagaaagtggctgagattttttaatgtaaatgttgctatactaattgacctaatttgttcataaaatgccttttaaaggtcagagagttattaattgtactgatgttatgaggcttgtacccttccagagagagaggacacaagcttcttactgtcccccactgcctgaagtctttgtactcaacataattggccttggacatgttgttctgtgacctatagacagttttagtgcagcctccaataattaagtaccttgttccttctctttgccaaagtgactggggttaaaaatctaactttccctgtggatatacaaatcaaatgttactgttgctgatatcatcaacttttttgttaattgaagactttaaacaactgttattataataacttgatgctaagtaaggagacacaatcatttttgtcaaacaaaactttggtctattttctcagcacccagagagtgcccctttattaactttgcttttacacgtaatggggctattcttatcaacaggttttgatggaatttgttatttgtgaaatgtaaaaaaatgacatccacttgaagtccctactagactctttgaaacaccttttatggtaatgttccaaatctttatccaagttaaaatagattttaagtgttctctttctaccccttacttgaaacatctgtgaagctgtatcgaagattggatcgctggaagacagttattggtatcactgctaaaaacaatatgtagtatagtatgtgaaccacagatcctgtatcagtggatctccttggttgcacattggagtcatctgtggagctttaagaaccagcgattctaggcccccatcctcagggaaaaatggcaatcaggaaatgtcaaatatcaatgtggcaagccctttatagaacactgtccagcctggacaacaattcgtcatcacccctctttgaacatggtcgtccaaccaaaaaataacactatcattctactcacatttatccattttgtctaaaaacttatgagtaatactataaaagcctaattgaagtcctgatgtgctttatgtcattctctgatttaccagttgagtagcactatccaaaaagaaatgacattagttcagcatatgcctccatgatatgctattttcttttgcaattttgcttcttctgaaaatggagttcatcattaaaatgggctagctgctgaccgagtagctagcatatattggtgcataataaacccatcagtctgactactcatgattaggagtgcattacctatatggcaagggggaaaggaggacagaaatctaaaatcagacctcttatctacactagtaggcttcccacttcccttttcctgcacttaaagcactacagaaatgttagttgttcttatttcttcttgtgggaacagggaaattataattggcttatatggctagagaagagagttaagcagaataagagaatctctagtaactgaaaagcaactaaaggctaaactgtttctaaatccctccaagcactgggactttgctgtggattggaatgtctgggtttgatggcgtgtgctcatttggaattaaagtcagacataaacttcctgagtgccagagaagcaagcatactttgctagcactcagtcaatattgttttgaatgtatttcaggaagagctgggagcattcccttcattttccataagccatgatggaacagcaaggtttattgatggtttgttgacactcctcctattttgagggcaaacctatgcctaaaaggagggggaagttgggatcactacaactaaaataattacagaagaataacagggttcctttttaatcagaaaaaaatattgcctgtcaaaagatagacagctcttaagaatcattggttgttaggaattcagcataggaaaatgggacttagccataggaaagctgcaagtctcatttagaatgtaattcagaagcagacagctcaaactggtgaattatgacccagaaaacagccaaaggagaaattgattccatagcaaactaaaatccaccaagagaaaatgagagaaagaaagtttatgctactattatgttataatttctcagaatccttatagcatggcttgggagtaaaacaaggatgcatatgctgattgccctaataggtaccatacctataactaagtagttaagtccctccagatcaaagttaattctaaagagacaaatcatggagtgtgatgatcggcatttgcgcactgaaatgcccatgcacgtgttttatcctatggcttttgaaatctgtgtttttgccaatgaagaattattttaccaagaaagttggagttttcttaataattaagataatttctgacctttattgtcattttgattgataccttttccaaccgggttgcaacatcattgtagaaaaccctttgcattctaataaaacagtactctgaagtgtcttagataagacgctctgcagagaaagttaaatcaattaaggcagtgtaagaattgtagctgggagagtcagagttctaacattatcccaataatcaaactgacctttctgttgtagcttttttctttcttttcttttgctttatttttcttttcttctttcctttgctttgttttttttttttttttttgtaaagaattaccctcacgctcagatggcaaagttcatcagcacattttttttttttttttttttttaatctaggaggggccaatgactgtgagagatctagacaaggaactttctagtgtctctaccaactgttcgcattatgcgggttaaagagtgaattgtattccgatgtctgtcagtcaagaaatccataaccttgtgcaggtttcttcttgctgagcctacatttccttattgcttcaaaagagtggaatttcactagatttttgtttaccagtaggctccacaatgccctagaataccatagagttccttgagggtattgaaggagccaagagggaggtaaccaggatagggctcttggttccaccagaatagttcctttttaattccttttctgtcttgcgccatcacatgagattttcttaaataaggctaaaaactcgtgagtcccttactctgattctgtgtcctttagctgtacacagcctacagccttccccaactctgccaaaagggccatgttttgtgtgttgtctctatgagtctctatgagtactttcagaggagtggtattcagaaagcagcttggagacatttatctcatcatctctggagtaaatctgtatcccacagaatggaaaaatcctccttttcccaccaagcaaagacacttgatcatgatgtgaaatatactgtatatgagacttggtaacttcattctgataataatcttgggaagaagccagtgaagaacactgcagtaataaagctattgcagggacacaaggttcctcactctgtagtagtattaaaagaattgtatattattatgtacgggcctgttcagctgattaactgcatataaaaatagaagttgaaatcagtttatgtgactagtaatgcatgtttcacagatcatatcacagtcagcctgttttaatcctaatatggtaatttggaaaagcccaaaagaataagagtgctagtcccttcttgcactaatattctgaaatgaaacatgaacaaatgtataatattaaatattaccttaggactagaaatttgttgtgtgttaaagagaaaatgggaggtgaggaagttgataaaccaagtatacacagtattttgagaagttttgtgggaaaaggaccaggagcaatggagcagtcacagaatgggacctaggatccaggtccccttggtctcccagattgtctagcccttatctatcttcatttctctttgtcctcattccaccagcgatattctcctcccattgtcttttggcccctgtttttgccctaaagttttgttttgcttcctctgcttctcacagcttcttgcctctaccttttgcaccattttgctttccttcctttcctagctctgtacctacccacatccctacttccaaatgccctatagttccaaaccttgggtactgctttgagtgcccagggttgcttcataagcacaagcagccccctctgcaattcttagcaagcattattagttctgagaatgagcacacatattgttggagttatctgtaatttattttatggcattggtcagtcctttgtgcttgaaaggagcacatttaagctaggctaacagccagtgagtcagccctacctaattaccttttactatcaacctataaggggatagatctataataggttcattttaaatagccttttaaggattaaacaacaaaacaataacaattgtccctcataatttagtgaccagtgagaacttctatgtaagacaggtaggaagctaaattagaccacattgctcattcagctatcacactgaagttttgggttgagtaagcccaagtatggaatacagcgttcattataatgtgattatttctttttgtatatttggccctcattactctcttctaaaaaagacatggcagacactttcatgatatccataaacacatcagaggcagcaatatactctggcttttaaactgtgaaatcccaggtcacgagtaaactaagtcataaggtgttaagtcacttgttggcaaatatctctcataaaacactcaaagttagttggagattctaaaacaacaaaagaatcagattaggagtcagttgcaggcaacaaccagctgcatataaaccttcaatgtagatagatatatacgtgtgtgtgtgtgtgtgtgtgtgtgtatatatatatacatatatacatatacatatatgtatgtgtgtatatatacatatacatatttacatatatatgtgtgtatatatatacgtatatgtgtgtatatatatacacatatacatatacatatacacatacacacacatacatatatatacacacacacacagttgagcctctgatccacgggtgtgaaatccatggattcaaccaaccacaaatcaaaagcattttttaaaatgatggtttcattgtattaaacatgtacagactttttcttgtagttattcccaaaacaataaagtatgacaactacagtcatgtgctgcataacaatgttttggttaatgatggactgaatatacagtggtggtcccataagattataatggagctgaaaaatttctatcacctagtgatgtcataatatcctaattcaatgcattacttacatgtttgtagtgatgatggtataaacaaacctacttctcaagaagagcttcaggcaggtccttcaggaagtatttgcaagcaaggtattgttatcctaggaggtgacagcgccatacaagttattgcccctaaagtccttccagttggacaagatatagagaggggacaacagtggtattgatgatcctgacgctgtctaggcctaggctaatgtgtttgtttgtttcttagtttttggggaggttttgttttgttttgttttgagacagagtctcactttgttacccaggctggagtgcagttgtgctgtcttggctcactgcaacctccaacccccaggttcaagcaattctcatgtcccagcctccctagtagctgagattgcaggtgcctgccaccacactcagctaatttttgtatttgtagtagagacgaggtttcgccctgtggcccaggctggtctcgaactcctgacctcaggtgatccgcccgcctcggctcccaaagtgctggggttacaggcgtgagccaccacgcccagcctgtttgtgtcttagtttttaacaaaaaagtttgaaatgaaaaaaggaaaacatttttaagatagaaaatgtttatagtttataggataaggatatttaaaaaatatttttgtacagctgtacaatgtgttttaaactgttacaaaggagtcaaaaagttgaaaaaataagtttataaatttaaaaacttacagcaagctaatttattatcgaagaaagacaatttttaaataaatttagtgtagcctaagtgtacagtatttataaagcctatggcagtgtatagtaatgtcctaggctttcacattcactcactagtcactcagtgaccctgagcaacttctagtgctgcaagctccattcatagtgagtgccctacacaggtgtaccatgttttatcttttataccatatttttactgtactttttctatttttagatacacaaagacttaaacacactgcactagtcacctacagtattcaatacagtcacatgctgtacagatttatagcctaggagcaataggctgtaccatatagcctaggtgtgtagtaggctattcaatctaggtttgtgtaagtgcactctatgatgttcacaaaacgatgaaattgcctaatgatgcatttctcagaatgtattccccatcattaagcaatgcatggctgtatttacatggcatttacattgtattaggtaggtatcataaacaatccagagatgatttaaagtataggggaggctgtgcataggttttatatgaggaacttgagcatccatagatgttggtatctaaaggggttcctggaaccaatcccccatagataccgaggaatgacgtgtgtgtgtgtgtgtgtgtgtgtactagacagtgggcaatatacaatactgtatgaaacccctctacctctctgagtgggtacctgccctttgttccccatttccaaacaggtagagaatgattgacctcaagaggacccatttcttctgtacaggcagaggtggatcaattaaaccagtagcttatacacagtgtgcttcactccttgaaaagcccttgtctgccttttctaggagcactcccataacagagactgggaacagtgagacgtggtattgtgcagtggtcaagagcatgaactctggattcatactccctggattcaaatactagttgtgtgacattgggcaagttcttcttatctccacaagcctcagtttcttctcaattggagatcaaaatagaacttattataaacagtctaaaataaatttcaagggtttatatgtaaattgcacaagctaatagtatcattcagtaaaagttatctattaatactttccatggatataacatttatatagatatcaaggtatcaatgaatagccctcttatagttcagttgcattgtatgttaagtcgacttttagggctgggctggagccctgtcaccatgtatcatatgatttccatggtaaaatgtgttttgcatctcaaatattcagcctacaaagaaatgtttgtactgcaccctatcctctttgtaaagtgagtctttatattggtgctggggcccctcatggttgctaacacgtttccatgtaagtcctctggtttgttttctaatttcttaacttaaactttataaactgttgtaatgaactgaagtcacaaactaaagctttttaattaagtggttagtcctgttgcaaaactgccttaataacaatttattgagtacatatggattgtgtggggacttctttggagaaatgtggtaacttctatgatgactgctttgatcttttttaactgaggaaattgttaatatagtaaattgaattatcccttaaacttggtaacctagttttctcttagtacttaggtaaattcagttgcacatcagtgtcagtggaaactttgatgtttgtgtgttattaccaagatatttagagttattatgaagaattcgagaacatcagaaacttctaggtaatgcttatatcacaaggaagaaagccaccgtttttctggccaaaggttgtatttctaacattataaataaggtccgtaggttatggggcctatattgcctcacctcaggaagaaagcagatcttgttaaatgatctaatagattaatcaagagtaccttttctgttcaagaacagccagagagaataagtttctgaactatgtttcaagttccagagaacactttttttcttccctttctctatgggtctttctgcattggccatgttttagtcatctttttccagttttccctccctttggtgatgacatccccttacatacactattcatacagctctcttccttctcccacactgaacagtggggtcatcagaagttattacatgccaggcctgttcagctcagaaaaggtgctatttttcattttctgcatatcttcttagattttaataggtcacttttaggttctgagctttaatacttatgtatataagtctgttatagtctcagctcagttaaatttaaacattttggctattttgtccagcaacaaaaacatttattgatcacctattttgagcaagttgtcacaaaatccacagttggttataacacagctgctaccttccatgggctcacaatctaggaaggaagacagacctgtaaacaaataacaagtgttcatatataatacaatgtaaaaatagacatataaaccaagaactctcagagttcaaagaaggaaatggctaattccatctgcagggtgaccatagaactatcctggtttgcttgagattgagggacacaaaaccttcaatactaaaacccaggatagtccccagaaaaccagagtggttggtcaccatgtttacctatctaggagagatggagaagacttcaaagaggagatggcattttaaccagtgcttgaaaagcaagtttaccaggcacttaaggcaaatgaggatagcattttaggcagcaatgaaaggcatttcctattcagggaatgatgaacaaattggtgtgagtagtatgtgagcttcagccagtgtgtatgtgtgtggcggggcgggagaggagttgggagaagggccctagggtgagaagagaacagatggaaactggaactggaaaggtgggcagggggcaaatcatacaggactgcctaaggaatctttactatgtcctgtgaatcagtagttttcaaacaactataatgatcctctggttccagtgaaaccttgcttggaagcacaaataaatggagaaaaatgcacaaattttctgattgaaaaaggtatgtgggctggacgcggtggctcatgacctgcactttgggttgctgaggcaggtggatcatgaggtcaggagatcaagaccatcctggtcaacatggtgaaaccctgtctctactaaaaatgcaaaaattagctgggcatggtggtgggcgcctgtaatcccagctactcgggaggctgaggcaggagaattgcttgaacccaggaggtggagattgtagtgagccatgatcgcaccactacactccagtctggcaacagagcaagactttgtctcaaaaaaaaaaaaaaaaagaaagaaaatgtatgtgttggggagagtcttagagtatctcctcctctttctccctgttcttttccctcttaactgctcttaagaggaattttggggagcacagtttgaaaaccacctctgtggaccatggggagtgacaaaaaattttaaagcaggaagtgaatgacatgatgagacctgtgatgagataagattgttaaggaggatggactgaagaataaaaaagcttgaataatggaaaaacggttaggaggttattgtaactttggaaccatctgaaagaagcccgactttaagcaaagacaacagggatagagagaagtggatgggtatgaaagacatttctaaaggttgcattaatagaacctggtggactatttataataagggtgtggagcggggaagattgctgggtgaggaagaagggggaaaagatgattatatggtttcttacttaacattagaagcaaccaactagtatatgggaaatctgtagtctaatttctaatagccaccttattttctttgagttttcattagctcagataaaaccaacatgttatcactcacacccagaactattgtccttaatctttcttcatctaatacttgactttgctagtaaaaccctttttgttgtcattgttttattggctacaactgtatttgtctctcattagctgggtagtgggtagcaattttcttttttttactaagagagtccccagcttactcacaggatgtgttccaaaagtacatttttaagttaattatttggacctcagagtacattttcccatagaagtggcattatacatagtgattaggttcccaggccagtccacaaaagccagtttagcccatatataactgaaagtgtggatttttgcaatggaaattagttgtaaatgatactgttgcaattaaaatgaaaacaatagttgcaaaagaaatagtctgggtttttgtttccctcaaagagtagggcttgatgaaaagcaggtttaatcctaggaagacaaagagaaatagatggggatttttgtgtaaattggacactgcagctttttaactgtattttctaactaatgttttggaggttttaaaataataaaagcaactgtgtccattgtagaaaatttgagaaattaaagaatacatttcaaaaattaagtcaccaacaatcctaccatccagagagaaccagtattcacaaattggtgtgtttcagcctttttcttaccgcatgcattttttaatcagttcaccaatagtaattatggtgcatcgacatgatgaactattatgcagctcttaaaatgatatttatgaagaatttttaaaacatccaaaaatatttatgacatagtgttgagcaaaaggcaaccttgcatttgataccttgtttatggatgagggagtataagcagatcaacactaatcaaccagggcaggagtctgctgttaggccaccagtcagaacctcctactatcagacccaccccctaacaaaaactacagccagacctttttgttgaagttctgaggaggacataagggttctttgaagtactgtagaggttcgtagcactggctcttcattacttcagattttccttcaaattacagggctttcttctcccttgatgtactatttcactagcactactcaggcttaacaactgtgattaaggtcatttttttggattcataaatggaatggaaaaaaggccaagtatttccttaggtaattatgcatagattggagagagatgagaaggactcaggtagagaagatgtgtatgtactttcaaggaagaaaattatgtggaatagaatatattaagctaagaatggtgaaagtaaagtgagaaaatgagacattatagcatgaatacagatctacagagagcggaaacgagtctgggaaaggaagaaagaggtgtgcttgtttaggtctgggcttggctacagagcaggaaaaaaaggaagaacagtgactttggggaagttgtagccagctgaaatcaaagttttaggaggaggcagcgaatgcaatttgtagcaactgattttgttttaataaaggaataaagatgtttgggaggacaggtgcttcaagtactaatcatccaagaagaaaagcagtttgaacttaattgactatatctgctatgattgtgcactattcgattttagcccaatcagtgattttctaaaagcatcccatctccttttagtcaaaactggatttgtcactgacttgtatgttggcatggaggtcctaatagctgccacctgcatttcctgttcatcaatgaaggtattgaaaattacaaaggaatgagagttgggggaaaggaagatgttcatttcgtaggggtgagggatgtatttacatgtgggtttttaagtgtacagtactagaaggaaaagccaaaagtttccatgcattctagagaagcatatggcattgtaattctcacacattgctatgcaagacaatctcctatggaattctgtggctcttacctttggtgtacatacgacgcagagattctgagttattatgtgtgaattgggctccaggttctcagccagggattctcattgttggttgtaaattggaatcacctggagagcttaaaaatattggcacctaggttctgttcccagaggtttttacttaatttttctgggggtgagaactgagcatggggattttctaactctccccaagtgattctaatgttcagacaagtctgggactctctagtttagcccattgcttaattacttgggtggattaaactagttgttcttaaagtgttgtcctggaaccagcagcttcaacatcaacaggacacttattagaatgcaaattcttgggcccctgcccatatttactgaaactcttggggtggctcagaaacctgtgttttaacaaaccctctggatgattctgatgcatgctataaagttgacagccactagattaaacggttgttcctgaccctttctaaagtacatctgtgggagttgctaaaaacaagagatgtcttcaagagctgatgaaaactggcctgcaaaaggacttttacagaaatacctataataataataatagaagctagagtagagaaaggggaaaggggatgataatttgctgcaaaacctgggcaagttcagggggaacatgtcttcatgagttagggagtttgttgcatgggctagtaataccctggcagtacctgcaggcaaactcctacttattcttcaatacccttttaaaatgtcagcctcctctgtgaagctttctctgagctgtggtgtaaactacttcatccttgtgtttacttagtgctttctagtttcctcgattagctcttggcccactgtactgtagctctctatatatgtctgtctcccactaaactgcgtgatccttcaaagcaagaacactgtcttattcatccttagctctccagtgtctaataaactatctggtacatactaaatgctcttgaattgtttgcttagaggggggatcagtaatggccagctttcttgtatcaagaaccttcagctgggcgcagtggctcacacctgtaatcccagcactttgggagaccgaggtgggtggatcatttaagttcgggagttcaagaccagcctggccaacatgctgaaaccccatctctactaacatggtgacgcgtgcctgtaatcccagctactctggaggctgaggcgggagaatcacttgaacccaggaaggcggaggttgcagtgaactgagatcgtgccccgcactccagcctgggcaacagagcaagattccgtctcaaaaaaaaaaccttcaaaagatgggtttacctttgtgaattaatcgtagtcctgagttcaactctgactagaagactagagacattgattctctcaggccatcatgacttgatatctcttagtggtggccttataccacaaagctctcagagaaatatacaattattagcaacttattattttaccatgataattggcaggtgccaagactactattgtcattttttcctcatatttcctctcattgtagatgcaccttcatgggaaatctaattaaaatcaatagggatacagctgccacagggtaaaagtatttgagttcttgggccccacagcttgcctctctcatccaggcactggcatcttctggttcattgtacttccctaattctataatgtactctcttcattccacatctattcacaaacattcttcaaacaagataagcacttagcaaattacaattacctttccattgcactttcccaaggttatactcaggtcaaaatgaatggatgtatgtgtattccccaagtctttagagaaacagatttacaggcaatcctttggtttaattttctagatacttaatcacatattcgttatatgtgggtttttactggcttaactctcagaggacaaccatataaccttatttttaagtttttggaggtaggacgacacttcactgtcacctcagttactgccaatattaatcatttctaaatgttatagaaactttgaaatatatgtgtcattctctaaagtggaattattaagacccagaatgtaaaccagaagaaactggatttttgccgtctgtgccaagccatgattttaatatgtatgtgctgaatggatttttctatttttttctacaggcattgtatctgatagccactaatggaactccagagctccagaatcctgagagactgtcagctgtattccgtgactttttaaatcgctgtcttgagatggatgtggataggcgaggatctgccaaggagcttttgcaggtgaaaataaaataggacaattacaaagagaggcattatactcagcttttccatctcaatgtgtgacagagagctctgtcaagagatgtctagagttaggctattaccattttattttagaccacaggcacataactataggcacgcatctaatacatgattgattgacgtgttgcctttcttctgagaagttggcagtgtaatctgtaaatctcttttgttcttcctggagtcttattttgcaaggaaaaaaaaaaaagcaatgtgaccctctggtgttggtgttttgttctaaactttacttgtgcccctggatgttgtatgcaggtgctcttggccggaggtaattctctacataactatgcaattatttccatggcatttgctactctaatgctttgctggtcaaagcccctttgcttgtgatgccaattggcaggcacctgcttgcctgggtgagtaccatccagtggtgagtgcctctgtaaccatttgtccttttcacggctcccagggattagtatacatgatgagaaataatacttactatgtaccaaattctttcaataaattatttcatttttataacaactttatagggtaggcattattatcccattttatagatgtaaaagttgagactcacagctcttgaagggcagagctgggatatgagccctgaattgtctgactttccaccacacgtcacacacaaaccaatttagataaaaatatgtctgtatttgataaagcagtacgtgcccaggattatacacatagcttcactgctggggagtgtttctcagggacatgtatgaagacatttaacatctaagaacaatgactgctatttttctttgtgattttgaacacataagccaattaaacagaaggtgcaacacttggttatacagcgcattaaccacagattgtctgttctagcctactccctgaaagaaaaacctgttcctgttgcttctgaactccttccagagacagagctgcacccaggcaaaaactatcccaccctaactcagatcatacctggaataaacctatttggagaaactgaagagactacatcttttcttttctgctacctgcaagcatttcacaggttatcatagggccctaaaatgtcaaatctggaatggccctttgttaatcctctaattaatccagcctcaaattacagatgaaaagacaacttttgagtacatcacttttatattttttcacccctcccaccactccacatacacattctgatacacattcctcttatatcttcttgtaaggataattgaaggtgtaggttatcttcaattggctatccagataaatgtggctatccagctaaatagatcattaaatcaattatctagttaattcattccccaacaatacttttatatgaaccagtcagataactgatacaaaattgtattttgagtctaaattgaatagtttattgcgtcttttcattttatatatgtaagcaatagcctgtgtttctctttgagtccatgcaactccattctctgactctagcctattattgccattttcaagattagaaaggggagagatgcatgacattcaccccactggaaggctggagaaaagacacaggtcttcaatatttgtgtgtctttctgtatgacctaagacagttctgtccatcaattgatatttattgagcaacttccatttgtaaagcataagtgcagtgggtgatacaaacctattaaaaggcatgattcctccatttaagaagttcacaaccttcttaggtacatgaaaatataatgcaaagctgtttacagactcattcaacccaaagagctgttcaaatagtaaatgatatggttgattagagaaatacttctgttagctaggggtgatcagaaaatgtcttcaaacaggaaagaggtcttctgggccttaaagaagtgatcaggtttagttaagttgaagaaaataagggaagggatttcaaatggaaggaagtgttagggtataaccaaagacatatgggcaaggtctacaggaacagaacctagaaagtgtagctgaaataaagagttcaagtaaagaagctgcaggggataatcctatggtgggccttgaacaccaggcttaagagttggggctgtaggcagtggggaaacactgaagatgtctgagggacaagcatgatgacaactttgtttatgaagattaatctggtagtatgtggtaagaattagcaacaggaaaaaatggagacagggagaccaagggggagttattataatttgggattaagatgattaggattgaattagaaaaagcaagagatggccagacgtgattgctatgattgctatgcctgtaatcccaacactttgtgaggccgaggcaggcggatcacctgaggtcaggtgtttgagaccagcctggccaacatggtgaaatgctgcctctactaaaaatacaaaaattagccaggcatggtggcatgcgcctgtgatcctagctactcaggagactgaggcaagagaatcacttgaacctgggaggcggaagttgcagtgagctgagattgtgccactgcactccagcctgggcaacagagcaagagtccatctcaaataataataataataataataataataataataataataataataagcaagagataaatgtaagagacgttgagaagagagtacccggtagcttattgcatttagaacataaagaagaggaagacaaaagtgacttcaggctatcaagtcaatggtagcattcagcaagaggacaagtgatggaagacaatataatagctaacatttcttgaccctatgtaacttacaagggattgccacttacctcatttaaccattttaataaacagagatgaggatttaacctaagtgctctgactccaaagcccctgtagcttacattacacaagattgccctgcttgtgagactgtaacataactttttaaatgttgaatttaaggtgacagaagaaaatcccgtaggaaatatccagcaggaaaactaggaccagagttcaggaaagagatcaggtcatacactatggatttaggagtcatctccataaagctgatggtgggttgaaaccatgaaagagaatgacatctgtaagaaattaaattaaaaaaagaagatgatgacagccaagttcttatgagtgggaggtaggaggaggaagtgaaaccagggaagaaaatggagctggaatattcagtgcacatgcgcatggaagagacccaatatggtagaatgtcacaggcttctgaggcaaaaaaaataaattaaaaaaattcaaagaaggaagggatattcacttttattaagtactgcagaggggccaaaagagaaatggtagaggcacagccgttgggtttagcagttagtaagccattggtttcaggacagagttctctagtggttaactaaatatactttttccaagcatgacagcttctctagataaatatatcagtttaggaaaatcagagagtcagactgttgcaaacacagtgaggttttacaagatccctcagagtttctcactctgctagtcagcttccagaggatttcatgacaatgaagtacaaaaacatctgaaggacaaaagctggcaccgtttttaattaaatgatatttaattgggtgttcaaaatatatcttaattcaaaagggctgcttgaaaatgtaaagtaatatacttgttggaggaaagaattccaataattcctctttttccttccttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 3638 - DNA, 276633 bp, human; identical to SEQ ID NO: 3637

SEQ ID NO: 3639 - DNA, 123450 bp, human
attgtcgggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcaggtgacaggacggggggaggggaagctggctgtgaaggaggaggtgcggggagtgggtggctgcgtggctgcgttgttggactctgcgggtctgggcgggtgcgcggggaccgccagactaacaaagtcggggcagcccgttctcctgaacgtgaggggcgaatcaagcaataggggaggggaggaatgctgcctgaaggatgtatagaaactggtaggatgttaggggtgaaagagcatcattgttaaagcaagtttccccagtttgggtgggagggagtcattgacaccttccttaatgcacttctttcaactctcctggatcttcccgtctttcccggaaaaccaaacccaaccaaactaaacgaaacacaaaaatcataatctctacatattccttaaaggcatacgtgcctgaaagaatggcatatcctttttcagagtacagcagcaggattgccatggtttttctgtgtggtttaatcatcctacgatattcttggcttctttcttgtcacgtatgcctttaaagactgagatttttcattttcctggtgttgagaaggtagtggtggttaaattagtatttgctgcagtggtaaattaaatcatcaatcacttacatgtctgcttactagaagaaagctaatccttgttttgagttatcttagagtcttaatttttatagtagaaagccaacaattttaagggtatttttgagaaaaaattatctccattctttatggagttgtggattaaaggtttatcactttgggtgagaaattggctattgtaatgttcttcatatactctctggtagtctttgttgtggctggcattttttgttagggacacactctcttataaaccaatgctggattattttagatatgtcttgatttgatgaaaggtttttttttactttttataatctttaaatttgttatttatttctgttttcatctgctttgctgaaataaatctggacaaaattattttaatagatgtcgtcattttgaaacaatatagtaagtaaattcacccataatgaggagtagtaaaataccacttattttcaaaacaagacaatttcagatgtattcagtttttagatcttaaatcaaggtatttgtgttggaacaaagtggggagaggaggaaaacctaaaattgaagctttccacccagtgattcttttagcaatgatcctaagaactatgaatgtgtaatcgaccactgattttatattttgtaaagcatgttggagtatttactccttcactcagaacagatttcctaaataatatgttcacatattcatgactgttagcaagatattatgcaacttggtgtgttcttcaaaggcttcaagtaaaacagtttcagactgcatcattatagtgatttttttcttttcttcttcttcctcttttttttttttttcttattgttctttctaacctataaaggatccttctacctgcaggacaaagtttaagcatcctagcttggcattcaggactttcattgttgggctccactttattgttgcaaccttattccccaaaatgctcccacatagaatcctctcttccaactaggtcaactctctgtctctcaaatacattttgtgcatttctgcctcatctttgtacaagatcatctgtatgcttgggatttccctcttttctccgtctatttaattttattgaagccccagctcttccaagaaattgtctccaactcccttagtccacaagaatctcctgtttctttgaattcccatggtacttattgtctttaccacttacttggcagtgctggttttattttctttttatgtttctgtcttgctatccctgagaagaaatagagccccttaaaaggcagggtgtaagccatatacttgttcagtcttcttattatatatcccctttattgtatttgataatatttctcataaatatgaatatcatctgatgcagttacagcctttggcttttaagccttcagttggttttctgaggcaagcttcaacacaaagcagaaccatatctgttcatggtaaacattcattcatcataagtttcattttactttttctcttcagttgaatgagcatttcttgtgggaacatttcaaaaatcagagtaaacaagatcttgtgctgctcttttttttcatttaaattagatatctttgggtgactcatttgccatttgtttttgataaaatttagccacgaaatttttaggggcagtattttttaatgtagagagaccactattcattatgtgtaaatgacggcaggtacattggaactgaagaaaaatagagtgtgtttgagattatacatacatatgtacatacatacacacacatacatacaggaacacacatacagtatattctctatttgatgaaaatgatctgtttggtgatcttgttatacttaaaatgactcagtggaatactgtttcagaaccaaaccgattagttagacaagcattccttattgcattaggaagagacaagaggaagggaaaatagctaagaagcggttaatgttaatctaggtgagaggtggtgagaatctgggtgaaacaatattgaataaggagaaattaatacatttcaaaataaatgggggaaggtttttttacattaagatgaaatagacccctggttctccaccctggctgcacattacaattgcaagggagattttttgtttgttttttcaaccctgcctggatcccaccctagaccaattaaatcagaatctcaggggccaaggaacttaaggaaaaaaaatcttcccaggtaattctaatatgcactcagggctgagaaaccctaaaattgtttattttttaagcactcaagaaatatttgttctttgagtgaataagaacattgataaaagtttagttattaaccttaaagccacttgtcaagaaagtcaaaaccaaaactaggaactaaatactcaaaaattgtttcaaattgtttgataaatttacgtgaagaaaatgatgccccctaaacatgtagcagcaaaatcttttctctgctaacaggcttcctatgagggaaaatgtattttaggcagctgtttgcagagtttatctttggtgtctttttacctctctctgcatttctagtgtctgttcttcacttgcctcctccctttgtccccatcacacttttctcctttctctttctctcttcaacctcactcctcttactttattgggatagagctcaggtaaatgattatggcagcctctctaggagattaacatttaaaagggggagtttgctaatttacttgaatctccaattggtgattggagattcatgacctttttgagtagatctcccttccagatactccttgattaaaattttcacccacataaggacataaaacagtgatcagaaagttggtaacccatttcagtaaagtagctgactcttgctgtaatgtcttctccgagatggtctgtagatagatttgacaagatgaagggaaattgcatagaactttttggtccatctggatactatgataatttgttgacttgaaagtgaatttaattgttacccaaacaaatcctgaaaccttgcatagttgactctgtcaccagtgctacaaataagtggatatgtttcagcgtacttgctgctgctccctctgcttctttatacctgtttatgtacatgagcagtaggtctgtgaaacagatttaggaattcttacatcagattctgccgtgtcctggataatcacgtgttttcctgtaaaccaggagtcaactctagtatttcctacatgtgctggttcaccttttcaactgtagggcatggtgcattgtatcaggttgtaaaatggagccagataaacacagcatttgattttgtgaggtgaaggtcctctcagtgcatttagtggaatgagctcatgattgtgattttgtggccttattcaaatatctgccttgcttcatttaataaatgtcttcctgaaaaatcgaatgtgaagcacatttttgacagttgactcatattttaattgctatagattgaatctgaattactgaaccttgtactgatttattcagtgataagttctacagcatacttatcccttaatttctttcatttaaaataaaatgttatctttaattgaagggtacattcatcattaagataataccatttatacagctctttatacatttttaagtactttcatatatattatcctattgtatcctaataataaccctgtgagcttggcagagtacatagtaattgctcgttgtggttgagagacaggttaagtgatttgtccaaagttaaatggtgagtctggcagagtgtgtgggtcagagcctaggtttttcaactccagtgctatcctaatgttatttccagtgtaacacattctctctttataaaaaagcagttattaaacaccatgccaataaataggttatttattctgaaaattcaatgcttatttaacttcgtaggttatatactttttgtttgtggtatggtgtgttttgttttgtgtgtatttgcatagctatcatgcctctcttatggttttagaatagattcattaagcaagcatttattgaactcctactttggaaacatgattatggctaataaaaagagacatggtttttgtacttaaaggatttatacaatagtcaaatgtatacagtaatataacgattagaaaagaatttcactataatatataatagtattcaaaataatatattttaatatactgtacacataagagatctggaactgtggcataaggcttaattttagaggggattaatttagtttgagaaagcttcctgaaaagttaggttaggtatttgttgcatgacaggtataagaacagaagtggttgattgggatgttttaaaattggggttagtggaatacttttgcttaaggtttaaatttaatatttcaatttagattatttgtgatataaattctgaagcatttatttggcatgaaggtagacaagatccagaacctcactgagaacataagaagtaatgctagggacacttactacaaataaagataattgaagacttacaaaattgatttgctgggaggtgccatttgtttaagttcctaggcacacagtgaaactttgcaaaagaggcatcttgttctcccagcccagcctagcagcccactctgtgagatgccttaactgcatgatacacacctccccattctgcagaggctagtgatcatcatgacctagaaagggaaatattttagttttctttttttctctacactttgagtgtatttgggtgcttcttaaaacattgtaatactcttataatcagttatctggaaagtttcagaaagggttgtctgcttctcatttacagaaaaaaaaataccttacacgccagggaaccatttaatgtaattaaagaaaactgtataagccaatttaataacaatgtaagtttatgtttactctcactttcagctagtgcactcaatctgctaaaggtcaaactgtaatgtttaatctttacatttctcttgtttcatgtaaatagatagcattccattaacagaatacctgtcaatggactgtaatggataattcaacagtagatattttctaatgtattttttatatcaaattctttgaggaaaagttttttccaaataggaaagtaagttctttccttttcaggaacacttgattctgtgtagtcttttctaatttgtgacagagaatgttgtcactttatttttagattaattacttgtctcagtagaatattagagattcaaggtgacaagagacaggtataagataactgtgacataaacttttctttgaaccatatggagatgaactgattctagaacatttgtgaatttggatttcactcagaaatggctttttgttaatgattatgttcctaagagaatctagtatgtatagtctagagtttttcacttcttaaaaaaataattgcaatacgtaaatccttagtattttgagctacttggttggggatgtctatgtcaatgggaaataattacatttaaaggtttttgtgaattagaaatagtaaattaaacatagatgactgtgtccttaaactaccttaatgagtatgtaagaatggatttgtcatatagatattttgtaaaggttgtaaagttgctgctttcagtgagttaatgatttcataatggtttaaaataagaactcatatacctattatatcctagatcagtagttctcattgtggggaagggtagggttggagaggttgcctccagaggatatttgacagtatctggagacttttttttttttttttaagagacaaggccttgctatgttgccctggctatgttgcctgggctggaatatagtggctgttcacaggctctaactcgggggctcaagtgatcctcctgtctcagcctgctgagtagcttggactatagtcctgcagcaccacacctggctgaagacatttttgattatcacaatttgggggttgctactgacatctagtgggtagaggcaagggatgctgccaagcatcctacattgaaaaggacagccccatacaacaaagacttaacttgtctaaaatgtccatggtgccaaggttgagaaaccctgggttagagtaagataaatggaaagtgcagcataggttcaaagagggagggataacatttgatttggtcgtttgaacagcagaggggggctttataaagaagttggaggattggcctttagagaggaggcatcagattttatagttattcttagatggaggaaactacatgaatgctgatatctcagagtctcctcaaactcaatatgtcaaataatgaactctcgttattcaccctaggcccccttgtcacccagatctaaaacttgggagttattctccactcttccctttccctcagcctctatatctagtgagggactaaggcctgttggtcataactctttgaatagctttcagatcagtttcattcctttctattctcaatgtcattgttcagattctcctctattccttacctttaactggacctgtcagtagttttctaaatgatctctctgtctcaagttttcttcaacttaaattagttagtcctccacactgtagctaaaccattctttctaatatgcaaatctgattgtcatgtgttactaaaacaatgttactaaaacaccttcaagccagtagccagttttcaagccgtacgtttcaaaatcttatttccttattccttgttttgaacattaaaaaaagtaatacatacactatgttttatttaactgtggtaatttttatattttattagttaaaattaaattgctaagattcatccaaattgttatgtaaaactgtggttcattcttttggatggctgtgttatcttgcatcatgtgaatataccatctttattcactttctcactgatagccattttcattcccccctcctcctttttctcttgggaatagcactactatcattattatacatgtctcttgtacttgtgcaaggatttctcttgtgtatatacttgaaaatggaattgctgggttgtatagtatgtcagtgttcaaaccgatttatcatttctgtttccattgacatgtataggagatcctatgaatctatgtgccctccaaaacagtactgtcaaatttaaaaattttgaccaagtgtgtttaaaaaggtatttcgatgaagtctttcttgatttacattcccctgatcacgaatgatgttaacctttcttcagatgtctgttggtcatatgtctttcctgtactgtgaaatagcttttcatttattttgcccattttctgttggttggttgtccttttttaaaaaatagaattctatgggtttaaaaaaatactccttatactaatcatttgttttgtatattttgaatatcttgtttataacttgcctttttgctctttgaggggtgttttgatggacaaatttgtaaattttaatacagccaaatgtatcaatcttgaattttgtagtcaatgatttctgtgtcctgtttaagaatatgtaaaatatattcatctacattttttactaagagttttagttttgtttttggtattaaagttcttaattcatatggaatcgatttttatgtatagcacgaggtggagttccatgttcctgtttttacatatggattatcttttttcagatccatccttacctatgttggggctcagaaaacaatacccccaaatgaaggcctcagcagcagcctcagaagcagaagttttgcactgactttgtcctgccctcctgtctctctgtcccattctcctccaaggctagccgtagaaactagaatccctcttccccaaggaggatcacagaagccagaaccccttttcctgaaagccagccataagacctaaaaatattactctaatttcccctctgcctttctgtgtaaaaactggacacaaagaaatgatctaacctaccttgtttgactgtaggtcttaagacccccattccagagagggccctgccccacagtcagaaggaaggaatacaggctcagagaggcctagaagaatctatttaataggcagacaggccttgctaggtttccccactcagtctgtcagctttagaatatattctttttggccaatcatatttctgcacagctgggctgtccatactttgttgaacctaagcataaaataggcaattcctcctttgggtcttaattctgaaggctcccatatatatactttaagtaaacttgtatgccttttctgcttttaatcaatctgcctcatttcagtgatttttcagtgaaattgtgaaactttagggaccaagggccttggcttctgtatctacttcttttctccctttcttttttctttttttttttttttgacagagtctcgctgtattgccaaggctggagtacagtggcacaatcacggctcactgcagcctcaacctcccaggctcaagtgatcctcctacctcagcctcccgagtagctgggaccacaggggtgtgctaccatgcacagctaatttttgtatttttttgtagagacagggtttcatcatgttgcccaggctggtcttgaacttctggactcaggtgacccacctgccttggcctcccaaagtgctgggattacaggggtgagccactgcacctggcctacttcttttctttttaacattttattgagagttcacagaccaaaagtggaccaatttaaagtatattgttgattggttgttagctgtgcacccatcactataatttagttttggaatattttcatctccccctgaaagaaatcctgtacaaataaatccctttccattctccctgcctcctccccaaccaatcaaaccctaggcaaccattcatctattttctgtctctatagatttaccccatctgtacattttatgtaaatgacttaattcaggatgtgaccttttatgattggcttctttaacttactatgttttcaaagttcatttatgttgtagcatgtaccagtattatgagaattccaattttttttgcattctcagcagcagttgtttttatctttttgtttatagccatcctagtgggtatgaggcagtatttctttccttcttcttcttcttttttttttttcgagaccgagtttcgttcttgtcgcccaggctggagtgcagtgatgcaatctcggctcactgcaacctccgcctcctgggctcaagcgattctcctgcctcagcctcctgagtagctatgattacaggcgtgtgccaccatgcctggctaatttttgtatttttttttttttccagtagagacggggtttcaccatgttggccaggctggtcttgaactcctgatctcaggtgatccacctgcctcagcttcccagagtgttgggattacaagcgtgagccaccgtgcccagcgtgagtcaggatttcattgtggatttgatttgacttttcctcatgactaatgatgttgaacatcttttcatgtgcttattgactatttgtatattttcataagcaaaatgtctattaggaccctttgtccatttactaattggggtgtcttttcattactgagttgtaagaggtttttttaaaaaaaaaattctatattcaagttttttatcagatatatcacttgcaaatatttctttcctattctgttggttcatctactctgaaacacaaaattaaaacatactgatatcacctattttatctattttcttatgttgcttgtgctttttgtgtcatgtctaaggaagcattgcctaacccagggtcagaacgatttatccttatgtattctgagtttatagttttagctctttcatttttttacatttagctttactgcttatttaagttgatttttgtgtgtcatgtaagatcagggtccaacttcattcttttacatgtgggtatctagttgtcctagcaccattttttgaaaaggtcatttttttcttcatctgattgtcttgtgacccttgtttaaaatcagttgaccataaatgtcaagatttatttctgaactctcaattgtatttcattgatctatatttctgttcttaacccaataccacactgtattgattattgtagctgtgcagtaagtttggtaattgggaagtgtgaattttccgacatttttttcaagatttttggggctattctgggacccttgcatgaatttcaggataagctacacaatttctttggaaaatgcagaatgcaagttgggattttgaaaaggagtgtgttgaatcatcaatttgggggaattttgccatcttatcaatattaagttgtccaatccatgaataggggatgtcttttcatttatttatatctttaatgtcttttaacaattattttgtagtttcctatttttagtttttgatgttgttgtaattggaattttaaaaatttagtttttggattgttcattgctagtgtgtagaaatacaattgatttttataagtgatcatttatccttcaaccttgctgaacttgtttcttctagtagtcttttaaatggattcattagggtgttctatgtcatgtcatctgcaaatagagatagttttacttcttttcaaatctggagccttttatttctgtttcttgcctaattgtccccgttagaacttctagtttcaataatgttaagcagatgctgtgaaagtggacattcttgttttgttcttgaatttagggggaatatattcagtctttaaccattaaatataatgttagctctgtttttttcggtaaatggtctttatcaggtggaagaaattcccttctatacctggcttttcaaatgtttttatcatgaaagggtgttgaattttgtcaaaggctttttctgttctatcgagttaatcatatggtttttgtcctttgttgtattaacatggtatataatattgtttggtttttgaatataagatgaccccactttgcattcctgacctacctgcacttcagtttagtctcatactgcctcggacctctacattccagcctatcaaactataatatgtgctgctcgttgaaagtatcatgctgttcgatgcctcagggtttttctttttttttttttttcctgttaatatccttctttggctttccaccttgtgaactcctattgattctttgtatcccagatcaggcctttatcttttccctttcccctcatcttctacataacagtgattactctatacctctattatagccgctgtgattttgtattgcagtgaatatatttccttcaccctagtatgcaccatcaatttaataacttttctgacaaataaacaccacttcagtaaatgcatacatagatttcaaaaatgttagcattagaagaaaatatgcattgttgaattaaagaaatatgggttatttgtttgcatttccctttttattggttttagagttatttgagtatagtgactttgttgccactccagtagctagtagtacagtgtgtggtacatagtagttgtttagcatattttgttcaattaagcctgcttcttcccatgggtgcctttttgagtccctgcacaatttgtccctttggttttcctctgtgttttccactacttcataaatatataccctgttcttcagggtgtatatctgaacccctcattgttttcctgatttttgtttttattgttttgttatttttaaaaatgaaaaaaattagaaaaaagacatatcttgttattgcttcataagcagatatatgagtattaaactttaacagtttggaaatttgctgtagtttatatatatatatatatatatatatatatatatattttttttttttttttttttttttttttttttgttaagatggagtcttgctctgttgcccagactggagtgcagtggcgtgatctcggcttactgcaagctctgcctcccaggttcacgccattctcctgcctcagcctcccgagtagctgggactacaggtgcccgccaccacgcccagctaattttttttgtatttttagtagagacagggtttcaccatggtctcgatctcctgacctcgtgatccacccgcctcggcctcccaaagtgctgggattacaggcgtgagccactgcgcctggccggtttttatatattcttatactatgccgctagatatgtttttattttagagtagctggccgtttaaaaatatttaggttagcgcttcattaaaattgatttgaaagtactgtttatgatgttaaataagattgacattgaaaatactacattacaaaatgttttgaggattaatatgttcttttaacaaattctattttgaaaatcacgtttgtagatgaagtccaggaaaaatttagagataaatggacatttcatgattaggtttaggagttttctcggtagtatagctctgaattgtttaaaattgtgttttagcatgtcttggtcttactttgtcctcttactgtctgctctcctccattagccatgtgcaaagttaagatcccaggatctgctacctttcagttacgaagtttatcatccttagtaggatcagagcttaaaggcactcacaacagctctctgtattcactgcttcttctcttgcaaaaagcctcatcacttaatgaatgactaaactttctcacatttatcaatataatattgttgccttaaacatctttccattgtagtctattgtatactcttcttctacattgttctttcagaaagttttccttatgccaccattccactgaagaaaaatgtatggatgcaccataacttatttaaccattcctctatcattagatgtttaagttactgtttaatattaataaacaaccaggtgtaattgtgctcctggctttacattgctttctccccagagaaatttaaacttctttaggacagataatgcattctctatataaattctcgacagtgtttggttcaatgctatgactctctgaaatagtttataatagatgcttctcaaatttttaaactttatgggaaagagtgtgacaattttatatactgacttcctatactatttgtgtgtaggacaatgcctctgccatggtgccttggtgatcttgcatgtacccacataggccacataggcaaggctcaaccacaatctgtctcaagtcttgggggaatactctgtgatcctccttgatacatggtaagatagacttgtgaggagctgtcacaaggccatttcctatccacctctgtatcttacaggaggcggcctcaaggcagcttattatctcctattttcattttggtaaggcatgggagtttccttcaggcacagttgtgactataaaatgacatagctgcagtctagaattgactcctcaacaacagagcaacccactgtgtgtgttgtctttcatttagtccctccagtttgggtttctcttgtaggactagggacatggggagctgataccatactgatcatgccttctctgcctgtgttagtaataaaccatctgaatccatttggtcttgtcttactggcagctgccgccgtgctgatgtgtaggggctgcttgaccacttaatgtaaacaaatgggattttttttttttccagtttgtggaatttgtcattactttttaattggtcaatttattgtaaattgcttttaatttcaggattcagtggttagtgctttgctatcaaatagctcaggtaaggatggtccttgctctgtaaatacagtattattttagggggtacagcatgcagctataaaattagtcttaatctgaataaatcaaagataaagcaattagttttgtttagtacagtggcctgcacttggttttcttttttcttcctctcttctcaaggactacttttgttttgcaatctgaagcctgcttaagttgtcctggagagtcagttggatgcagacctttctcgtattatattagactttcctttctcatgcagtagaaaggtactaaggtatcttaacatgcaaataaaatgtatattgtatacacagatctacctgattttcagtggctggttgaccttgacctaggcagaaagatcaaagtcaaactgttgccagtggagggtgtccaggttcttggtgttttgaacaaagaattggacaaaatgcacaaagcaaggaaagaatgaagcagcaaaagctgagatttatcgaaagggaaagtacactctacagggtggcagcaggccgagcagcctctcacagccccgatacagaatgttcttgggtccaaataccctgctagaggattcccattggccactttgtgtttacctcatataaatgaagtgatggcctgcaatcaatctgattggttgcagaaagcgatgaaacagagcctaaagtgaagttacaaagctgcactgctatgttaacgaagacttggcgtgcaatcagtctgattggttgcaaaaaacaaacaatcagaggctgaagttacaaagttatacgcctatgcaaaagtctgattggttacagaaagcaaccaatcagaggtactttctatttcccatctgccatgcagaaatagtgggggtttgccaaggggctagtctctggtccttttgttacttaggtgtggaaagttagggttttcctttcagtttagttctaggaagtcagcgtgaaacggccctgcctccagatcctatactcctgcctcaaaactaattgaacatcatcaattctgatgtactagacatggttaagatacatgttttgccattggttacttcattaatcagaataatcataacaattcagatattaggggttttttttggtttaaaaaatgttacatgaaagcatgattttgttgaattaattaattaattaacttttttattctttgagacgggggctccctctgttgcccaggctggagtgcagtggtccaatcttggctcactgcaaccccatcaaaaactgagcgaaggatatgaacagacacttctcaaaagaagacatttatgcagccaacaaacataagaaaaaaagttcatcatcacaggtcattagagaaatgcaaatcaaaaccacaatgagataccatttcatgccagttagaatggtgatcattaaaaagtcaggaaacagcagatgctggagaggatgtggagaaataggaacacttttacactgttggtgggagtgtaaattagttcaaccattgtggaagacagtgtggcaattcctcaaggatctagaaccagaaataccatttgacccagcaatcccattactgggtatataaccgaagcattataaatcattctactataaagagacatgcacacgtacgtttattgcagcactgttcacaatagcaaagacttggaaccaatccaaatgtccatcagtgatagattggataaagaaaatgtggcacatatataccatggaatactatatagccataaaaaaggatgagttcatgtcctttgcaggaacatggatgaagctggaaaccatcattctcagcaaagtaacacaggaacagaaaaccaaacactgcacgttcccactcataagtgggagttgaacaatgagaacacatggacacagggaggggaacatcacacactggggcctgttgtggggtgggaggccaggggagggatagcattaggagaaatacctaatgtagatgatgggttgatgggtgctgcaaaccaccatggcacttgtatacctatgtaacaaacctgcacgttctgcccatgtatcccagaacttaaagtataataaaaaaattgttatgagtttgggggtacaagtgtagttttgttacatggatatattacatagtgatgaagtctagactattagtgtaaccatcactcgaatagcgtacattatacccattaggtagtttctcacccctcaacccgctcctaccttcctacatttctgagtctcagggttctgcaggtacatagaagttgccaggttttcttgccatcctcgccattcgaaattcagttctgtacatctgcctatattcgttgtgatagtgcttcgctttttcatagataaccttcctccttgccttttgaagtatgttttgggcaaacttctttctcaggcacttgatcttcagttctgtaaaattcctttactttttcttaagggtttctggcacagcaggaaccttcttcatcttctcttctacaccctccatggttccagctggaaaaagaggatgatttcttttcttttgggtagatacctaatagtgggattgccagatggaatggtagttctatttttagttctttgacaaatcgtcatactgttttccccaggggttgtactaatttacattctcactaacaatatataagcgttctcctttctccatatcctcaccaactgttattttttgactttttagtaatagccattctgactggtgtagggtggtacattggctgtctcaaaattttgtctgttttaatttgcatttctctgatgcttagtgatgttgagtatttcttcatttcatatttttcattttttcatatgcttcttggccatttgtatgcatacaacaaaagcggtgcttgcttattgtagaacatttggaaaatagaagcatagggaaaaaaatacaaattgcttctcattccagcaaccttgaataaacattaatattttggtatatttcctttatattcccaacactcatcatcttgcacatacctgtaggtctttataaatttatgtatggtctttaaagaaaactattgctgcacttggtgtatatagttttacattttaaatactctagttattatactgtgagcatatttccatactaaggaatcgagtctataatatgatttttaaaggctacaggatattccatgttaaagatataaaaatttgtttagcctttatcttattgttggacatttaagttgtttctaatttttactattttaaataatcctgaaatatgcatattttttacatatctctattaggtttcaatcaaaaattgctattaattgaattattggatcaattattatgaacagttttaaggaccttgattcactttgccaaattgcacttcagagaagttacctcattttgtattcccaccaatgatgtatggaagtgcctaattcaaaatagccttgccaacaccaagtgatagttttaaaacctttaaatttgattaatgaattatgttttttttttttttttttttttgagatggagtcttgctctgtcacccatgtcacccaggctagagttttgtggtgcgatcttggctcactacaacctctgtctcctgggttcaagtgattctcctgccttagcctcctgggtagctgggactacaggcacacggcacctcacttggctaattttttatttttattttttgtatttttagtagagacggggtttcatcacgttggctagtgtggtcttgaactcctgacctcaagtgatcctccggcattgacctcccaaagtgctgagaatacagacgtgagccactgcacctggccaaattatgttatcataatttttacgtttattttgattacagtgaggttgaagatattttcatatgcgtcttggtcgttgatagttttcattttgaaactgtttatgtccttggcccaggttttatctatgagttgttggtatctttttgctttttgatagactgaagtttttccttctttttatgtaacttaacctagaaatctttcatgtgtgaattctttctttatattaacactttgaaactccttccccattctaatattaggtgactagtcactataatgtttttcttaaagcttcattttcatgtttatctttttcttccatctggattttattttagtaaaagttatgtgataaagcaatagtatttgtcttgaaaatatagttattcaatagccatttaataagtaatactacattgatttgaaatgacaaatttataatacattttataatggttgaagtatagtgccattcttaaatatctctttgatgtttgaatgctgttacagtgattcattagtcattatttcttggtgaaactgaaaaacttactagaatttcctacagataactgcatagagctgcccctccctcttcttttaaataaggtcttgtctttccatgtggcttaattgttgcgagactcacagtcctttccttactgagcatgcacgtatctgccctctggttagcagctgtggtttccccttgcaatatctgtttttgtttgcacctttgcttctcaaggttcctgtgctgaaaatgagcctttcattactggttgcttcaggtcggtgagatctccttgttattgtttatcataattgttaactttgaagcatttttttccttcattttttccaatgtctacaagttgtttttttctctctgctgcacttatggttaaaattttaattcatcatggagtagcttagaaattctgtaatccatacatcttacttgttcaacaaggtctcagtgttatagactgttcattattttgtcctgcacaacacccttctagggaatactgaatcaagaaatcacctgtctttgcagagggcatctgttgaggcagatgccagagccatggggttgtcatttcccatcaggctccatccagtatcagtctctaatacttcaaagacactttccatccttgcatccgacagacagctgtggtgccttctgttttcttgctgcttttgtttctagtcttaacagttcttttagatagaaaaatagatgaggaattgctaacatttgagaacatattaatcagattttacatactgtaattgtgctcaaatttgagtaataatagttaccaaagaacagagaacatttaattttttcattttcatgttaggaaataagtatctgagttggctgattttatgcactctcctgaagacatatttctgctatatattttttatgttacaagaaatgaatataatggtctaatttccatcattttattttctatctttatgaacattacctatcattatgtacaagttgacaattttcccttcatttctattgattatttcttctagggattttaggttgttgcagaatatttagtcattaccaatagctctgaaataggaattaagtgattttggcactatttaataggtagtagtagattcagaaatgcagttcagatcaagtctagtgttcatctcccctcttttttagtcagtaagacttctgtgaactttgagacataccccaaggatgatgctgtattggtctagccccaagagctttatattatagaaactacaattttagtagaactaaatggaggtgattctttttgcattctttcactgaagtgttactatctaagcaggtattatttggtgttggagtggaataagaattgatattacctagagttggtgtctggttgagcttttgatttaccctaacatctcatgcttagtttatagttaatgtttaatggaattttgtcaaatggatgataaaggctgtgagtcaagtcaggatgctacctggcaaatatggagaatgaggcttggaaggtgaggatcagaatttgcttgcctctatcacagactctggaaatgcaggacgacagataatttgatattaagatatttgaatattttaccttgtatgttttccgtggttaggctgcaacttctaagccctgctggaaaaggaatggtactgttcaaagacagttcaccatggcttcatgtttctgcgcatcttacaagtgagacactaactgccctgtgttctgaactttattttcaatgatgttggtacagtgaacagctttgcaagataaacctactgtttgccttcaaaacaaagtgcagactggacgcagtggctcacacctgtaatcccaacactctaggaggccaaggcaggaggattgcttgagcccaggagtttgagaccagcctgggcaacatagcaagaccctgtcctttttttttttatgagacaaggtcttgctctgtctcccaggctggagtgcagtggcacaatcggctcaccacagcctcaacctccccaggctcaggtgatcctcctgcctcagcctccgaagtagctgggactataggtccatgccactacactcggctatttttttgtattttttgtagaaatggggttttgccatgttgcccaggctggtctcaagctcctagactcaagcaatccaccctcctcggcctcccaaagtgttgggattgtagatatgagccactgcccccacccaagaccctgtctcttaaaaaaaatagccaagcttggtggtgcatgcttgtagtcccagctacttaggaggctgaggcaatagcactgctttagcctgggaggtcaaggctgccgtgagctgtgatcacaccactgcactccagcctgggcgacaaagcaagatactgtcttaaaaagcaaacaaagaaaacagaaacaaaccaaagcaaagggcagatttgcttgcatccttggacaaattagatagtatttctctccaaagcaaaagataatcatgcttaatgttgaataaaataaagataatgtctcccttagaataaaaggcaggcatgcttactatgataaaagatttgggttccctcagctcaggttcctttcctataatgtgataatactgcatgtgcatgcatccatctgggcccatcagtgttgcccccatgagattttggggagtacggggaactgacccaaatatactgttcatgccatttgctgtgctgtgagcaataaaggcctctgtctctcacacgggagtctcatgtcttctgctagcatctatacaacagtgttaggctaacatactggcttacaagtagggcaaaatccgacccttcagagttcttgacaggtactcagcacaatgcttttggctataagatgttatcctcctttagacaaaatttgtttgactaattttctttaatccttgtttattgaattggttaaaaatattgaaaagtaataagagcccatctctttaaggggccaagaaagctgtgtgtcatctcagatgaaacaattttgaattggtaaattgggaaaagctgagggctttataatggtgttcattattctctaaaacaaaaattgaacctagaagtaagatttacattctgcctcctattgcaagaagcaatcttgggggggtgtgtggatgttgttagatttagaattcttctgaccctggtgtgtggttgcagtgggacagaatatttgagatgtgggacagaaggccacagtagtgtgttaaaggagtggaaaatcacacatagaacataggctttgaagacacatgagtttggaaccccagtgctgtcagttattactagcttttcattttttttacctttgggaaggcatgtcattcagtctatctttgcttcatatgtgtattagtctgttttcacgctgctgataaagacatacccgagactgggcaatttacaaaagaaagaaatttgttggacttacagttccacgtggctggggaggcttcacaatcatggcagaaggtgaaaggcacttgtcacatggtggcagacaagagaagagagcttgtgcagggaacctcccctttttaaaaccagcagatctaatgagacttactcactatcatgagaacagcacgggaaatacctgcccctatgattcaattatttcccaccagttccctcccacaacacatgggaattcaagatgagatttgagtgagaacacggccaaaccatataattctgcccttgactcctcccaaatctcatgtcctcacatttcaaaaccaatcataccttcccaacagtcacacaaagtcttaactcatttcagcattaactcaaaagtccacagtccaaagtctcacctgagacaaggcaagaccctttcggctatgagcctgtaaaatgaaaagcaagttagttacttcctagatacaatggggatacaggcatcgggtaaatacagccattccaaatgggagaatttggccaaaactaaggggttacaggccttgtgcaagtttgaaatccagtgggggagtcaaatcttaaagctccagaatgatctcctttgactccatgtctcacatccaggtcacgctgatgcaagaggtaggttcctatggtcttgagcagctccgcctttgtggcttagcagggtacagcctccctcctggctgctttcataagctggcactgagtgtctgtggcctttccaggtgcatggtgcaagctgtcggtggatctaccattgtggggtctggaggatggtggccctcttctcacatctccactaggccgtgccccagtggggactttgtgtggggcctctgaccccacatttcctttctgcactgccctagcacaggttgtccatgaggtccctgcccctgcagcaaagttctgcctggacatacaggcatttccatacattctctaaaatctagccagaggttcccaaacctcaattcttgacttctgtgcacctgcaggctcagcaccacatggaagctgccaaggcttggggcttgcaccctctgaagccacggcccaagctgtaccttggccccttatagtcatgcctggagtggctgggacacagggcaacaagtccctagcctgcacaccacacaggggccctgggactggcccacgaaaccattttttcatcctaggccttcagtcctgtgatgggaggggctgctgtgaagacctctgacatgccctggagacattttccccattttcttggggattaacattcgggtcctggatacttatgcaaatttctgtagccagcttgtatttctcctcagaaaatgggattttcttttctatcacattgtcagggtgcaaattttccaaacttttatgctgtttcccttttaaaactgagtgcttttaacggcacctaagtcacctcttgaatgctttgctgcctagaaatttcttccaccagatactctaaatcatctctctcaagttcaaagttccacagatctctagggcaggggcaaaatgccaccagtctctttgctaaaacaaaacaagagtgtcacctttgctccagttcccaacaagttcctcatctccatctgagatcacctcagcctgggtttcattgtccatatcattattagcattttggtcaaaaccattcaacaggtttctagggagttccaaactttcccacattttcctgccttcttctgagccctctgaactgttccaacttctgcctattacccagttccaaagtcacttccacatttttgggtatcttttcagcagtgccccactctactggtaccaatttactgtattagttcattttcatgctacagataaagacatacccaagactgggcaatttacaaaagaaagaggtttattggacttacagttccatgtggctggggaaacctcacagtcatggtggaaggtaaaaggcacatctcacatagtggcagacaagagaatagagcttgtgcagggaacctcccctttttaaaaccatcagatcttgtgagacttattcactatcatgagaaaagcatgggaaagacttgcccctgtgattcaattaactcccaccaggtccctcccacaacacgtgggaattcaagatgagattttggtgaggacacagccagaccatatcagtatgttaaatgagaaacagtaactagcttacaaaattgttaaaaggattagaaataatctatgcaaagtgcacagtactgtgatctagcatatagggtgtatgtgtataatatttgcctcaattccacttaggttattcttgatgtgaatttagagttctgatttcaagttatttctccattaactcccatgttccttcaagcagacaattctatggtgattactctaatgatgaagatgtgttcaaacagcacacttcattattaggaattttatcagaggtaaaaatcacatggccctctccttaatgtgtctgtttaatttccctctgctttcctcttataaggatacacgtgatggcatttttagggccagagataaaagtgtgtcaggctttcaaatattacctaggatttttttaaaaggagagactatggtaatctatattattaaacagcacttaaacttaagtttaacaatttgtgcaaaaaactctctctacccgtttatacactgaataagataagactaagactataattagtatagtataatagtataatttctgaaagtcattttgtatatttggcagaaatggtagccagtgggccaggaatttcaatgggccgcagatagaccaatctgtggctctgtgggtgcagcttgggagacagcagatttccattccatctgactcctctccttcttctctagcttccttgacctctgaagctcaagagtgatacagaacataatttagattgggttacttaagattattgaccaagatctctaatagactgccagcagttttacaaggaatgtcttgaaggaaggcaggaaacaggacacagcaatctgtctactgttgatttactgccaatactggattttatgattaaaaatgagacaagaaaaacagcttagtggttataaaggtgcttatccctttggatgctaattaactgagatatcgatactgcacaagaaaaaaatacacagctatgtaattaaaaaatatttacaatcattctcttattaattccaataaactatcattatggtatatattagtttcttgtgcctgccataacaaattatcacaaacttaatagtttaaaaaaaagaaaattagtctctcacaggtttggagactgaaagttagaaacaaatttaattgagctaaaatcaaggttttggcagggccgcactccctatggggaggctctaggggagaatccattccttgcttcttccagcttctgatggctactggcattgtgtggcacaattattccagtggctgcctccttctccacatggccccctcttcagtctgtctggtttaccctctgctttcctcttataaggatacctgtgatggcatttagggtccacatggatgatgcaggctaatctcatcacaagactcttaattacatctgtaaaacctttagcatataagataacactcacagattccagaattagggtctgatatctttgagggccaccattcagcctacaacaggaagataaatacacattttaatgtccttttttatgtggaaaaggtgaaccatttttataattgtcttttcccaagtgctgtttgttgcctaagaaggtaggctttgaaattgttgtgaagtgaatctcccacggaggaataagtgagcagttttccgatttttatttatttttattttttgaaaaagacagggtctcactgtcacccaggcatgagtgcagtggcatgatcatggctcactgcagcctcaacctcctgggctcaaaccatcctcccacctcttagcctcccgagtagctggaactacaggcatgcaccatgcccagctactttttgtatttttttgtagagatagggtttcgccatattgcccaggctggtctggaacacctgggctcaaatgatcctcccacctgggcctcccaaagtgttgggattacaggcatgagccaccgactgcacccagctgtttttttttcccccgatttttaggtggaatttttatttatttaattttttgctggaactcagttaaaataccagttttgcatgtatttctcaattatttgttcattattagtcatattttatttttctagttgccctagtatacatgttaattgatttttaatgtttaaaaagctcctttattgtatatcacaagataaacattttaaatcagtttaaattttattaattatagctatataaaagttaatcttcacttttttgatggaaaatatgagatgctgttagtgtgagatagttcaagaaattaagatacaaatagttttatgttatttcccatttttctttccaaggttgagtttttttttttttttggcactgttattgtatttacccaatgcttaggatgtttatactgattttaaatctgaaacacctaagaattagattttgctgagaccagctcagttgtggagaccctaacccagcggcgctagaggaattaaagacacacacacagaaatatagagtgtggagtgggaaatcaggggtctcacagccttcagagctgagagtcttgaacagagatttacctgcatatttactgacagcaagccagtgataagcattgtttctatagattatagattaactaaaagtattccttatgggaaacaaagggatgggctgaaataaaggggtgggtctggctagttacctgcgataggagcatctccttcaggcacagatcgctcatgctattgtttgtggttcaggaacacctttaagcggttgtctgccctgggtgggccaggtgttccttgccctcattccggtaaacccacaaccttccagtgtgggcgtcaatgccatcacaaacatgtcacagtgctgcagagattttgtttatggccagttttggggccagttcatggccagatttgggggcctgttcccagcaagatttattattctttatttaactccattaaattagaataataattataattttaagtggtgtttactaaataaatacatgaaatcatccagaaaatagtttatgaatgcacatttaattaaattccctgagggagcttctaatattactttgtaatttaactaaataatcttttatttggaggggaacgaacataaagaagcatgaaaaatgtgtagattagtaatgtcttgatattatttaaatcattaaattattcttgttattaatactgatgttttagtatatttttctgtccctttttggtagtttatttgcctttttatttcatttttttttgcatttttttttgtgagacagagttttgctctttttgcccaggctgaagtgcaatggcgtgatctcggctcactgcaacctccgcctcccaggttcaagtgattttcctgcctcagcctcccaagtagctgggattataggtgcttgccactatgcctggctaattttttgtatttttaatagagacagggtttcaccatgttggccaggatggtctcgatttcttgaccttgtgattcacctgcctcggcctcccaaagtgctgggattacaggcgtgagccaccatgcccagctgactttttatttcatatgttatttttcagaagttttaggtttacaaaaaaattgagcagatagtacaggtaccccatactccttttctccagctcatagttttcctatttttagcatcttacatttttgtaatgtattttttacaattaatgaaccaatatatggtacacttgatgatgatgaaaattgatgaagctatactttattattaaagtctgtacattaggattcagtctttgtgttgtatagttgtatgtgttttgacaaatgcatgtgtcatgtatgcatcatcacagtatcacatagaagagtgtaactgccctgaaaattctgtgatccatgtattaatcactctttgatatggtttagctctgggtccccacccaaatctcatattgaattgtaaccactatgtgtcaggggagggacctggtaggaggtgattggatcatgagggtggtttccccgatgttgttcccatgatagtgagttcttatgagatctgatggtttataagtgtgtagcattctcctcctgccctctgccttgtgaagaaggtgcttgcttcttcttcaccttccaccatgattggtttcctaaggcctccccagccatgtagaattgtgtgtcaattaaacctcttttctttataaattacccagtctcaggtggttttatatagcagtgtgagaatggactaatacagaaaattggtactaaagaagtggggcattgctataaggaaacttgaaaatatggaagcaactttggaactgggtaatgggcagaggttggaacggtttggagggctcagaagaagacaggaatatatgggaaagtttggaactctctagaaacttgttgaatagttatgaccaaaatgtgatagtgatatgaacaacgaaatccaggctgaggtggtctcagatggagatgaggaacttactgggaactgaagtaaaggtcactcttgctatgctttagcaaggagactgatggcattttgctcctgccctagagatctgtggaactttgaacttaagagacatgatttagggtatctggcagaagaaatttctaagtagcaaagcattcaagatgtgacctggctgtttctgaaagtgttcagtcatatgcattcacaaagagatggtctgacattggaacttatgtttaaaaaggaagaaaagcataaaagtttggaaaatctgcagcctatatggtggaaaagaaaaacccatttactgggaagtaattcaagcccgctgcagaaatttgcataagtaaaaaggagccaaatgttaattgccaaaagaatggggaaaatgtcttcagggcatttcagagatcttcatgacagcccttcccatcacaggcctggaggcctaggagggaaaaatggtttcatgggctgggcccagggccctactgctctgtgcagcctcatgacatggttccctgtgtcccagccactccagcttcagctgtggctaaaaggggccaaggcacagctcataatgttgcctcagagggtgcaagcctcaagctttggtggcctccacatggtgttgggcctgtgggtgcttagaagacaagagtggaggtttgggaacctctgcctggatttcagaagctgtatggtaatgcctgaacgtccaggcagaagtctgctgcagggccagagccctcatgggtaacctctactagggcagtgtagaggggaaatgtggggttggagactcacacagagtccccattggggcagtgcctagtgaagctgtgagaagatggccactatcctccatacctctagactgacagtttgtaccgagcacctggaaaagctgcaggctctcaatgccatcccctgaaaccagcgacgggggctataccctgaagagccacaagggtagagctacgcaaggccttgggaacccaccccttccatcagtgtgctctggatgtgaggcatggattgaaagaagattattttggaactttaagctttaatgacttccccattgtattttggacttgcatggggcctgaggccctttgattttggccaatttcccccatttggaacgtgtgtatttacacaatgcctgtacccccattgtatataggaagtaactaacttgattttacaggctcataggcaaaatgggacttgccttgtctcagatgagactttggagttggacttttgacttaatgctggaattagttaagacatttggggactgttgagatggaattttgcaaatgtgttgcagtgtgataaggaaatgagatttgggaagggctgtggcagaatgatatggtttagctctgtgtccccactcaagtctcatattgaattataattgccatgtgtcaggggagggacctggtgagaagtgattggatcatgagagtggtttccctcatgctgctctcatgatagtgagtgagttcttacaagatctgatggtttataagtgtgtggcagttcccctgccctgcctgccatcttgtgaagaaggtgcttgctcttcctttgccttctgccatgattgtaagtttcctgaggcctcccagctatgtggactgtgagtcaattaaacctcttttctttataaattactcagtttctggtagttctttacagcagtgtgaaaatggaccaatactctcttcctcttcccttattccctcttttcctcccaaattatggcaaccattgatctttctactaccaccatagttttacccttcccagaatgatatttactaggaatcctagcatatgtagacatttcagactggcttctttcaagaagcaatatatgttaaggtctctccatttcttttcatggcttgaaagcttgtttcctggaagctattccattgtatggatattccacagtttatccattaacctattgaaagatgcatcttgtttgcttctaaattttgacaattatgaataaggctgctataaatgttagtgtgaagactttgtgtagacattagttttgaacttatttgagtaaatacccaggcttgcaattgctgaattaagaccatatttatctttgtaaaagcataccagactgtcttccagtgtggctgttcttgttttttcactaaaaatttatttatataatttatggcatacaagtgcaaatttattacatgcatagtagtcaagttaggggattcagagaatctgtcacccaaataacatacattgtacccattaagtaatttcttattatatacccctctcccactctctcacccttctgagtctccattgtctatcactctgctctctatatctatgtatacaccattttttagcattcactaaaaaatgagtgagtgacaacatgtgatatttttctttctgtgtctggtttgtttcacttaagataatgaccttcagttctatccatgttgctgcaaaagaccaatgctttggctatttggactcttttttggttctatatgaattttatgattgttttttctaattctgtgaaaaatgatgttggtattttggtagggattgcattgaacctgtagattgctttgggcagtatggtcattttaacaatattaattcttctgatccatgagcatgagatatctttccatttgtttttgtcatcttcaatttctttcatctgtgttttatagttttccttgtagagatctttaacctctttggttaaatttattcctaggtattttattttctggtaggtgtggtaaataggattgacttcttgatttcattctcagtgagatcattattggtatttagaaatgctactgtgttttatatgttaatttttgtatcctgaaactttatcaaatctaagagttttttggtggagtctttaggtttttctagatataagatgatatcgtcagcaatctgcgatactttcacttcctcttttttgatttggatgtgttttatttctttctcttgcccgattgctctggctaggacttccagtactatattcaataacaatggtgaaagtgagcatctttgtcttgttttagatcttagttggaaggccttcagcttttccccattcagtatgatacatgggtttgttgtatatggcctttatttttttcaggtatgttccttctatgcctagtttgttgagggtttttttaccatgaagggaagcttaaccttatcaaatgcattttctgcatctattgagatgatcatatgttttttgtcctaattttgtttatgtgatgtatcacatttattaatttgcatatattcaaccatctttgcatccttggtataaaacccacttgatcatggtgtatgatatggtttggctctgtgtccccacccagatctcatcttatagctcccataattcctatgtgttgtgtaagggatctggtgggagatggttgaatcatgggggtgggtctttcttgtgctgttcttgtgacagtgaatgagtctcatgacatctgatggtttcaaaaacgggaatttccctacacaggctctttgcctgccaccattcatgtaagatgtgacttgctcctgcttgccttccacaatgattgtgaggcctccccagccatttggaactgtaagtccaataaacctctttgttttgtaaattgcctagtcccaggtatgtctttatcagcagcatgaaaatgaactgatacagtgcattatctttttgatgtcctgtattcaatttactagtattttgttgaggattcttgcatgtatgttcatcagggatattggtctgctgttttccttttttggttgttgtgtcctcgtccagttttggtattagggtgatagtggcctcatggaaagaattagggagaatactctcctcttcaattttttggaacagtttcaggaggagcggtattccttctttttatatttgatagaatttggctgtgaatccctcagccaagctccctcaacaatccctgagcttgtctttattgggattttttttttttttactactgattcagttttgctcttcattattggcctgtttagattttctatttcttccttgttcaatcttggtaggttgtatgtttccaggaatttatctctttcctctaggttttcttgtttgttgagtatatagttgttcataatagtttctgatgatctattgtgtttctgtggtatcagttgaaatatttccttttttatttctcattgtgtttatttggttcatctctcttctaggttagtctagctactggtttatcagatttatttatctttttgaagaatcaactctttgtttttttaatactttgtatttctttggtccctatttcatttagttctactgtgatctttgttatttcttctgctagttttgagtgtggtttgttcttgattttctagttttttgagatgcattgttaggttgataatttgtaatctttcttttttttgataataggcatttaatgctacaaatttccctcttaccactgcttttgctatatcccacaggttttggtttgttgtgtttccattttcatttgtttcaaaaaatttttaatcttttgtattaatttcttctttgatccaatgattgttcaggagcttgtgtaatatccatgtgtttgtatcgtttctgaagttcctttttgtattgatttctatttattccactgtgttatgagaaaataattgataggatttcatttttaaacatttgttgatacttgttttatggcctaacgtggtttatcttggagaatgttccatgtgctcatcgaaagagtgtatattctgcagttgttgggcagaatgttctgtaaatttgttaggtccatttggtgtaaagtccaatttatatctaatgtttctttgttggtttcctacctggatgatctgtctaatgccgtgagtggtgcgttgaagtctcccaccattattgtatctgtctatctctctctttaggcctagtgatatttgttttatggatctgggtgctccagtgttgggtgcatatacatttaaaattgttatagcctcttgccagattgatccctttattacagaatgaagttctttgtcttttttaaccgtcttttatttaatatctgatttaattgatgcaagtacagctagtgctgctcacttttggattttgtttgtgtggactgtctttctattcctttacttttggtctatatgtgtctttacaagtaatgtgagtttcttgtaagcatcatatagttggattatgtttttaaaatctattttgccaatctatatcttttaaatggggcatttaattcatttattttcaaggtttatattgatatatgtgagggtttgttcttgtcgtattgttaattgttttctagttttataaattctctgtttctttttcttggaatgtttgcctttggtttggtggaattctgtagtggtgccatttgattcctttttcttcctcctttgtgtgattactttaccagtgagttttatacttttgtgtgtttttatgatgatgaatatcgcttttacttccacgtttaggacttctttgagcatttcttgtagggccagtttagtggcgatgaattcctcagcatttgcttgtctctgaaagacttcatttcttcttatttatgaagcttattgctggatattgagttcttggctggcagtcttggttttttttatttcagcatttttaatatgtcattcccttctcttctggcttttaaggtttctggtgagaagtctcatgttagtctaatggagtttccttatgtaggtgacagggtgcttttctcttgctgattttattttattttattttttctgtgaagctgttctttatttcagggagaggacaggacagggagctcagtctttcatagcagcaactttcctcgtgatggccaggacattgctcagctcctcccgcttcctcttggtgtggatgtgtgtccccacccttttcttgatgaacttgagggcttgtttgtccttggagaccttcagtaactccatggtgcaccgctcgtatggggtgaagccacatacctcttggatcatgccccgcacacacttggtgtgtttggtcgggcgcccaaggctacgactgtgtctgggcttgctcaaattcttggtcaacttgtggcccttgttgaggcccacgaccatagtgtagcacagaaccattgctgctgctctgcaatggtggctgtggtggaatgctgtcttgctgattttagaattctttttactttagacagtctgattataatatgctgtggcaaactcctttttgcattgtgttttcctgggaatcactgagtctcctgtgtctggatgtctaaatcttgctatacttggaaaagtttcgtttcttattttgttaaataggctttctaagccttttaatctctcatatccctcaggaataccaataatttgtaagtttggtcattttatgcagtctcaattggcacatgtatacctatgtaacaaacctgcatgttctgcatgtggatcccagaacttaaagtataataaaaaaataaaataaagcaataagcaagttcaaaaaaaaaaaaaaagaaaaagctttgttcattctttttctttatttttgtctgactggattatttcaaaagacctgtcttcaagttctgaaattctttcttctgcttgatctagtatttcaaatgtattttgtattttcttcaatgaatcctttagtttcggaatgtgtgtgtgtgtgtgtgtgtgtgtgtgtgtgtgtgagagagagagagagagagagagagagagacttgttctgttgcccaggctggagtgtagtagagagcgagagtgagagagagagagagagagaaagagagagagagactttttcttttgcccaggctggagtgtagtggtgtgatcatagctcagtatgacctcaaacttttggactcaagtgatcctcctgcctcagcttcctgagtagttgggattacaagcatgtgccaccacgcctagctaatatttgtatttttagtagagacaggttctctctatgttgcccaagctggtcctaaacacctgggctcaagcagtcctcttacctcggcctcccaaagtgctgagattgtaggtgttagccaccacactcgggctttttatcttttaaagatatttatctccatgttataagtttttatttgtattctgaattgattttctgagttctttgtattggtttttagatttctctggcatctcattgagcttctttaaaatcaatgttttgaattctttatctgggattttgaggatttttttttcttttttggttaggatctactgctggagaattattacattcatttgaggccataatattacttagctttttcatgttttctgtatctttatgttggtttctgctcatctggcttcatagttacatctttttaaaaaaataactttcacgtggatgggggacttttttcttgaagatatgacaatgatgttcgttgggtaaggccttctggctttgcttccaggtgcatgcagtagtgaagactctgtataatttgtatggctatccttattctgttaatgtgttgttcttggtggggcctgtggtgaagttgtgcttgtgactggaatgcctgatgggcccatcatcaggttgtaatggtagcagaggtgtgctaagtatgtctatccttgtgacctgggacagcatatgctggctcctgtgttggcagtttccaggcaggctcatgtttgggcatctgggtggcttcctcagatgccagttttagtagcagtataccaggcagataagcaggctctcaagctcctgagcagttggagtagtgtgggtgatagaggtagcagtggtggtgagatagtctccttgttcccatgcactgtgctcttgtgttggaagtggttgcaacaggctgtgcaaactggcttctaggccagaaggtggtgctttcaggtaagagccagctgagactgtagaagcagggtgtttatgctcagtctctgtccccttggtgctcatgtgcccctggtggtagattgggttgtggaacacccagaacctggcccccacagttcatgttggcatagggttaggagggtgaagctgggtggatccagactgggcaagcttgtactcaacacctcccaatggcaagtgcgtgcatgagccatgatgtgggggtggggcaggcagtgtagtcgtcatgcccctggtgaaatgcttgggtgagaggtgactgctgctgtgctgaggtcctgccatgggtgccagggaggatgagaccactgctgtccctccctcatcccatctgtggcagccaacctggctgttctgttagtatggcagtttgcacccagcccataattcagccatgagccatagaagccagcacccagctcaagaccaagcctctgcagtaactcatcctgctcaggattggagcattgggagcctggttccagtgccagaggctggagcccatgccatgtccgtttcttagttttgattgtgggattccccattgatccccattcctgctcaagcccctgctccacaagatgcaacctgatcttccccaatggccaagactggtgctgcagattcccaggaccactcatagtttgctaagagctaggattaagaatcgcatcttactgtggctacttagttctcaggaattgtgtgggacccagggcatgttgcctccttgaagcagttccttctcacagtctcttggatgctccctaaatcagattcaggatttgggtgggtcagggtgctctgctgtggcctggactgtatgattccccagtgggaaagtggactgcagaaagatactcactcactctctcttagggattcattgccagttcccagccggtcttgaccacgacaggctgtctgcttttcttctcattcccagattttggagtttcctttcactttttctgttgaaccctgtgttccctgttgggtaatgtattcaaagtgtgattgtctacataccactttggtttttctaagtggatgaggtgtgctggaaatgtttttagtcagctatcttggaaaacaaaggtcatcctcctgtcactttttgaacttctttggttactgtgttttctcatgactattattttcagccttctctgcttgctgttttttctctactcactaagtgttggccttcctgatagcccattcttgatctctctaattcaatactctgatattaggtgatgccttccatttctgtgatttaatagaactaaccatattcctacaactttcaatttttttttttttgagatggagtctcactctgtcactcaggctggagtgcagtggcacgatctcggctcactgcaatctctgcctcccgggttcaagcaattctcctgccttggcctcctgagtagctggaattacaggcgtgcgccaccacgtctggctaatttttgtatttttagtaagagacggggtttcaccatattcttcaggctggtcttgaactcctgaccttgtgatccgcccacctcggcctcccaaagtgctgggattataggcatgagccactgtgcctggccacaactttcaattttatatatccatcccagacttcacttaggagatcaagattcatctgtctaatgcccatttaacagcccctctttgagtctctctcagatgtctcggtttatacagatataaacttgaacccttcattgcacctctgtttcaaaaaagcaaaaacctcaccagtagaagaagctacaaaaatcctgttacactcccactgtttattagatattattattttagctgtccaggccagaatcctgggtgccattcttgattctttcctctcatttcttccacatacctagctctttgccatcccctatgagtactaatttcaaaatatatttcaaattttatccattttctcttaaccctattcttgcaatcttaatacaagttactatcgtctaatctctgagaccactatattatttatgagtacttaatactaggtattatacagaataacaaactgggcatgattttgtttttaggatttcaaattacttgtaaacagtaattttgaactcccagaattctgaagttacaagaataagaggtaaaaccctaaatataaagaaacatatcctaaactaaaaacagtgacttcactttcttccccaatagaactgtgtgatgcttgggtatccagaggaggtaagccagaatattgggaaacatttatttctagtttagattttggtttctagtaattctattgtttttttagttattcagaattttatggtgggaggaggaagaatagaaattttcatattatataaacatagctattttttgccagttatacaattttacataaggttaagaatgagaatatatatctctctccttctctatatgtatctctatatattacatatatagtaatgcatatgttaatgttctgaataaggaatttactatattgctaagtgaataggcctcatcccttggaatgaggaagttgagcattactgagaggaggttgtttttatgagggcagaccagatgctaaatgaggtacattgagctaggctggatgctcttcctgacagaggcacaaaattttcttacatttttaactaaataagtatgagctagtgtgagcaaagtaaatttctatgataaggtaactaacttgatagttactcaggtagtttttgggggtttgcacctttggggacattatttgtctgccatgaatagaggttgttgctggcatctagtgggtagatgccagagatgctgctaaatatcctacagtgcccaggatagccccctacaatggttatccagaccaaaaaggtccacagtggtggggttgagcaactctcttctagagtatttatttttcaacccactgctataatgtcctaagtatttttcaaaatttcatttaacaaataaacccttaataggagtaatggttataacgattccatgattttatttttgtgaaaatttaaatgaatggaagtatatttgtgtgtacttgcaataatttaggagaggaatgaatcaaggatgaataccaggtttctggcttgagcaactcaccaggaggatgttgttgacattgagatgagaaaaaaaaaattgtgggaaaagatcttcatttcagatgttatatttgtagaatttgaggtgcctgagagatatcaaggtgaagtcctgaagatcagaacataggcttttagacatatccttaatttgcaattcatcggtatgtaaatataatttggatctaggttggatgaaatcacccagtagagtatcttttttttttccatttacttttcagatttactgagtgaacataatttttcataaacatttgatctaaatcatttttgttgttgttgttgctggttgtttggtttttaatactgggaacacagagattcagtttgaaagataccctaaaatcttaagagtagtatacaccaatccctcccactctccacccacaatctagttggtttaagtgagcagaatgatccatttttccattttaggtgagcagatgtttatgaaagatcttagaactgtttgcctcatttatcaggaacatttacaagggaagaagccattaatcgtatttcaacttgtaaatagaagaagactaagactcaggttcatatcttatacttttaacaagaacttgttgaaagaaacattaacaatttcaaactaattttaagtttttcctcacaaaagcataaaaatggagatcttaacaggaaattcttaaaaggtaaaaacaactcctacttatactagtccttgggtagttaacatagaacaggttcttctttttgtttctttgaaaaggaatttttgggcccaagtctgttcctgcttagtatctgctccggccttcccccctctcgaagcggcctccttgacggcctccgcccctgggcaccctgcagcctgaccggctgtaagaatcatgcaggggagggctgcccgtttccatgggcagagggagcccacgatccggtctgcctacccggtctcgacccctcgagtagcggtcgctccggccgtaactgttgctggatctgtcgtggtcgccgctgtaggcgtcaggcaagctgccctggtactcctcgtagtggcctcctcctccgtagcggtcgctcaggccgtaactcttgatggaactgtcgcggcccccactgtgggcgtcaggcgaggggcctcggtactcctcgtagcggcctcctcctccgtagcggtggctccggccatgactgttgttggaactgttgaggccgcggcccccgccgtaggcattgggcgagcggccttggtattcctcgtagcagcctcctcttccgtaatggtcactccggccatagctgttgctgaaactgtcgcggcccctgctgtaggcttcggtgtagtggtccccgctgtgggcatcgggcgatcggcccctgctgtgggtgtcgtgcgagcggcctcggtactcttcgtagtggcctcctcctccatagcggtggctccggtcgtaactgttgctggaactgtcacggcccccactgtaggcgttgggtgagtggcctccgctgttggcatcgagagagtgacctcggttctcctcgtagcggcctcctcctctgcaggggtcgttccggctggaactgttgtggcccccgctgtaggcattgggtgagcggcctccgctgttggcatcgagcgagcggcctcggtactcctcgtagcggcctcctcctccgtagcggtggctccggctggaactgtcatggcccccactgtaggcgtcaggcaagcggccactgctgttggcatcgagtgagcgacctcctcctccatagtggtcgctctggctggaactgtcgtggccccggctgtaggtgtcaggcgagcggcctccgctgttggcatcaagcgagtggcctcggtactcctcgtagcggccgcctcctccatagcggttgctctggctggaactgtcgtggcccccactgtaggcatcaggcgagcggcctccactgttggcatcgagcaagcggcctcggtactcctcgtagcggcctcctcctccgtagcagttgctctggccagaactgtcgtggcccccactgtaggcatcaggcgagcggcctccactgttggcatcaagggagcggcctcggtactcctcgtagcggcctcctcctccgtagcggtggctccagctggaactgtcgtggcccccgctgtaggcattgggcgagcggcctccactgttggcatcgagggagcggcctcggtactcctcgtagcagcctcctcctccgtagcggttgctctggctggaactgtcgtggcccccactgtaggcgtcggcagagcagcccccactgtgggcgtcatgcgagcggcctcggtactcatagcggccttctcctccatagcggtggctctggccgtaactgttgctggaactgctgtggcccccactgtgggtgtcgggtgaacggcctccgctgttggcatccagagagtggcctcggttctcctcatagtggcctcctactccgtagcggtcgctccagctggaattgtcgtggcccccactgtaggcctcgggcgagcagcctccactgttggcatccagcgagcggccttggtactcctcataacggcctcctcctccgcagcagtcgctccagctggaactgtcatggcccccactgtaggcgtcgtcggaccggcccctgctgtgggcatcagtggagcggcccccgctgcgggcctcgtgtgagcggcctcggtactcctcatagcggccttctcctccatagtggtggctctggccgtaactgttgctggaactgttgcggcccccgctgtgggcgtcgggcgagcggcctctgtactcctcgtagcagccttcttctccgtagcggtcactccggctgtaaccgttactggaactgctgcggcccccactataggctttgggcgagtggtccctgctgtaggcgtctggcaagacgactggcaaggcctcggacgagcggccttcactgcaggcatcgggcgagttgccctggtactcctcgtagcggcatcctcctccataagatggcggtgtcccccacacaggggcagcgccgcatgggcctccgtagctcttgaggggctctcggtaggagcctttgctgggatgatctgtgtactcatggtcgcgacccctgtagccattttggttgccgtcgcctctcaagggacggtagtccgggacactggagtggccataatagcggcggctgtagtctctgagcgcagggacaaaatccccagggtcgcggcacgggggcagtggctcccggacccgcgggcctgagtagccatcttgcccccacacggccggggccttcccaggcattccactgccgccaatgcgagccaggcttgaccggggcacagccctcttgtggggtgggccggcccagcgccgtggctgcaagcctgagtagccatcttgccccgacacagtcggtgccttcccgcgcattccacagccaacgctgtgagccaggctcgacggcgtggccctcttgtggggtgggctggcccagtgccgcggtggcggcccgcgcttcctgggcatcggggccctgtagggccacaggtcgaaataccccgcgtagccgcggccgtcatcaggcctgccctgagaggggggtcgctgtgggctgctgccacccccacgggttctgtgtgagaaccttgagcgactgccgctgccgggggttggcgggacccatcggctgctcttgaatgccggtttgatggtctgggccaccatgatggccttaccatccaggtacttgccgttcatatctctggcggcagccttggcgtctgcagggctttcgaaggtgacgaacgcgaagcccctcgacttgttggtttttcggtctttcatcaggaacaccttgatgatgtggccatacttgccaaactcggctttgagggctttctcgtcggttttgaggttgaggcccccaatgaaaagcttctctgggcgatccgcttccatcatgtctccctgccgaatggtgggtcagaggaagtgggaagtgatgacgcggcagttcagtcgcggccttcgagcgctctcgtggagggcggctcctaccggttgggggggtggatgtctcaagaaggaaaagagtaccttacgtcatagttcttgggaacaccaacgtctatgatacaggtagaggaaatcctaggaatagaaaataagaagtagccagagaggtaggaagagatcccagaagtgtagtcttctaagccagaggaaaataatctttccagacatatggaatggttattgatatggtggttgttggttacattggtggatgtgagagtggatagaaaccaaattgcagtgggttaagaagtccatggtaagtaagaaatttagttgtgttgtgggtttatgtgagtttggctgtaaaagaagaggcagatggagggggttgtgggatcgtgggaggtatttttgtgtttgcttttaaagatcagagataattcttcgttggtattttaaaagacaaatagcatatttggaatttaggtatactgaagcatatcaaatacatctggttaataaacatgcgttctatgaggtttttttctttttttgagacagagtctcgctctgtcactcaggctggagtgcagtggcgtgatctcagctccctgcaacctccgcctcctgggttcaagcgattctcctgcctcagcctcctgagaagctgggattacaggggcccaccatcacatccggctaatttttgtgtttttagtagacacaggatttcgccatgttggccaggctggtctccaactcctgagctcaaaagatctgcctgctttggcctcccaaagtgctggtattacagatgtgagccaccgcgcccagccgtatgagtgtatttctaaatgatgttttttgccttcaaggtattgatggataatattgtatattttaaagtattttaagtagttgcttagattctaagtgattcagcaagtgtgaaaatagttcttttaattaccatagatataggtatatgtttaatactcactattttcttttcagatctttccagaaatcgttttacagaaattccttctgatgtctggttatttgcaccccttgaaacattaaatttatatcataattgcatcaaaaccattcctgaagccattaaaaatctgcagatgttaacataccttaacattaggtaaggaaacaatttaaaaataaattttggtttttattgttgttctaatccttttttagtcgcaaaggaatatgtttgatttggctgtgtagcttaaatttatctcaacagtatcttatttgtgttttttatatgttcacattattttgtaggcttttgtcttgttcttgagagcagagcttagcaaactttaacacacaggaattacccggggatctgttagaatgcagattctaatttcttaggtctgttatggggcctgcatttctaacaggccccttggcaatgctcatgcctacctgctggtccttagacctcagtttgagtagcaaggctttagaccataaatatttcctgaaattatagcaccacgatacagattttatatgcatccttagatatgtgaaacaaacagtgcttgagttattttttctcacttttgtgacttcttgcttctacttcaaggatggttagagtggggtgagaatgttgaaaggtttggaagtggatgacagttcatgtttatacttagtaagtgcttaccatgtgccaggcagtcagtgttccaaacgctttacccatattaccttatctagttttcatgacagcattttgagataggtaccattgttatccctgcattacagatgaggaaattgggttaagctatttgtccaaattcatagatatattcagcaagtggtagagccaagattaaaatcaaagcagtctggctatagagctctcattcatacatagcttttaccctatatatgtaaaagaatgaacactcagtaagtataagaaaaaaactttccctgccaaatcagtaacattgaatgaaaattgatatattgtgacttaattttagaatttttttctttttttattcagttggaagggataatctcctcattaaccaagttacttgtctaaattcccatatagagaagtagtaaatataattaatatacataaatgataatgttcccttctcactgtgatatatcagttcttttgtatgactcccccagtggtgttacctgacagtacaagctattttaactgaaaccactttacaccttaaaatgtgtgagagaagtttcctggctgggtgcggtggctcacgcctgtaatcccagcactttgggaggccaaggcgggtggatcacgaggttaggagatcgagaccatcctggctaacatggtgaaaccctgtctctactaaaattacaaaaaattagccaggcgtggtggtgggcgcctgtagtcccagctactggggaggctgaggcaggagaatgatgtgaacctgggaggcggagcttgcagtgagccgagatcgcgccactgcactccagcctgggtgacagagtaagactctgtctcaaaaaaaaaaaaaaaaaaaaaaagtgtgagggaagtttccttccaaagatatcaatcatttgggttgctcctttctctaagtaggtataaatctccttggcctggcttaggagaggtttgaggaaagtgaggtatttttaagttttgtctttgtttctgtttcattttgttcttttgcggaaaaagtgattcgccaaaaactgaattacacttctctattaacacatatggtaatcttagttttactaaaactttctctgattctatcctgtcacgatctgtaaaagtcaactttgatctttttttacagtcacaaaaatttttgagcaaactatattgaaataacatttgttctagtgactgaattcttctctaaggcatgtagtaaaatagtgacaattaataatttatttgccggtattaagaaaccagattctggtgaaagatgattgtgttaactcaatgaatatgcatttttttttttttttttagacggagtcttgctctgtctcccagggtggagtggcaccatcttggctcactgcaacctccgcctcccaaattcaaatgtttcacctgcctcagcctcccaagtagttggaagtataggcgcctgtcaccaggcccgactaatttttagtagagacagtgtttcaccacgttggccaggctggtctcaaactcctgacctcaaatgatttgcccgcctcggcctctcaaaagtgctgggattacaggcgtgagccattgtgaccggcctgaatatgctttttaagggaagaaaataaattgatttttaagctatttttggcctgaagatgtattagaatgagtttgccattatttcttccatgtatttatttattttggtgaaaatctcttaataaacttgtaaaataatttttcaactcttctctcttcctatatactacccccctttttcagtagaatcctgtagaaagatccttgtgtgccctggtatgaagggacccagactgaccatttttccaaggagcctgcttcatcctgaaagtatgaaggattatgacaggaccctagcacatttgacattccagcagtctggccattattgcttgttgaggggcattgccatttttttgtttgtttgtttgtgccgtgttattaaagccagtctagtatttctggatgtcctttgccagagaaaagatggggaggagggtctttcaagtcccccttgagtaacactggacttttgttgctgtgtatgttacacgaaatgctaggtataggtctataaatgacactttgaaaaacaggaaaaataatagcttatcgcttaccagtgcttgttagtatgtaaatggaatggaaaaatatacattttgttagtggttcctttgggtcagtcagtctgttttggcatataaatttgaccatagtactttgagggcaaagaccccagagccagattgcctgagtttgaatcctgcctctcccatttaacagctgtgtgactttgagcagtttacttaaactctttgtgactatttcttcatctgcaaaatggggatcactgtgagagttaattcacatgacctgctgcaaaatgaggatcactgtgagagttaattcacatgagctgccctgaacatggcctggcaatagtaggcactcagtaaatgttagttattatatttaaatgtatctacagagataagaatgttttatcaactttgagctgagataaaggtgctaataggctgttaaaccttaaaagggaatgggttagggttactacatgtttttgaagatatagtcctattcactcttttataaacttaaacatagtgcatgcacatttatccctggagactttccctagcatggaagtattgaatataccagaattatatcaaggagcaaagttctgacattattgagctcggaggaatcattctgggtttttgagaactgatggtgtgtggagtagtatcataggtctgcctgcatagggtttgctatgctatggatctctgctgtagttgggcaaatcacttaaccagttttaactttcattttctgatttgtataatggagataataactacttaatcttgtatcattaacatgaggattaaatgagacagtgcatataagaaatttaacactgtgcctgatacaaagtgagcactcagcaagtacttattaagttattacttagtgatagaatattatttacttacaaagtgatttcttcgtttttaatatgtcacattacatacatattctcgtaatgaaactttctcattcttttcagccgaaatcttttatcaacattgccaaaatacctatttgatcttccccttaaagttttggtcgtcagtaataataaactggtatccattccagaagaaattgggaagttaaaagatttaatggaattggtgagtaacttagttgtattaattaatgcaatatgcgtaatatatctacattttggaagattacctatttttaatggaatttaattgtaatttttaaaaaaagtactaacttggtatatgtctaaattcagtaagatttagtaaaatcttgagatactatatgtctgagtttttccagtcacaaaatagcatggttcttccttagtccttgtgacgtcagaaggcttgcttacaaactttaagaaatacttttcaaatgaataagcatttgtttactcattttgtggacagtaaaggtcttagaggaaagctaagggaatttttaaaataaaacttttataggactatgatatatccttaaacaaaggagataaaagaagagagtgtctgcaaacagaattagcaacataactcttcctcactgtttgcttatgtgacgttatgacactttttagactgaaataaatggtaaaaggccattatatgcaattgattgtagaaatacagaataatttaaattaattaccttggacataacattttaggtattaaaggacattgaattctgagagaaacatattcagagcctcgaagctttcagctatttttcatatcttctggttacctccactttacgcagtataccatgcttcatgtttttcttttattttgaatgatgctttcctaataaacaggtatttttaaagttttttttttgtgatagagtctcgctctgttgcccagactggtgtgtagtgacatgatcttggttcactgcaacctccgcctcccaggttcaggctattctcgtgctcagcctcccaagtcgttgggattacagccatgcgccaccacacccaacttatttttgcatttttcgtagagatggggtttcactgtgttgcccaggctggtcttgaactcctggcctcaagtgatccacttgcttcggcctcccaaagtgctggcattacaggtgtcagccactgtgcatggactaaagtcctaaaatattcttatgtatgactttattatgtccggggaggtcaaaagttttcttgaggaacttacctacaatttcataatgagaaattaatattaacagaatgtaatgagcagaaatttcaggaataccttttattcattaaggaatacctgcatgtccaattataatacaaggaaacttccttgaatttcaccttatgttttagaaccatataattttgaagttataaaagatcttagaagtgatcagatacaaccactttctaatgtaggaatccctgatacatctactgtatattttcaatggtggacaactctgtgtgtgtgtgtgtgtgcgtgtgcgtgcgtgtgcatgcgtgactgtcctaattcttctttgcaaaactctatttgttattaatctttcttattttgaaccaaaatacatgcttctatcatttttttccattgggcctgggactaccatgtgaagaaatatagataatgacaacttctctccccttcagatatttgtaatctgttgtgtgtttacactccattttaccaaactctttttttttttttttttttttttgagacgaagttcactctgtcgcccagggtggagtgcagtggtgcgatcttggctcactgcaacctccaccctctgagttcaagcaattctcctgcctcagcctcccgagtagctgggattacaggcacctgccaccgcgcccggctaattttttgtatttttagtagagatggggcttcaccatcttggccaggctgatcttgaactcctgacctcgtgatccacctgcctcggtctcccaaagtgctgggattacaggcgtcagccaccgcgcccagcgtaccaaactcttaagatgtgtttttctatagcttaaacatccttattacctttattcctttttatgactttttacttttagctaattcgatttagaaaatgttccttttagttaaagtctcacttaatgttgtactaaaaaatgaacagagattccagatatgatctaacaagttcataataaaaggtaccattattttgtttgacttgaacactattaatgtttttccagattttataaaggttataatttaagattttatgtctccgtaatttatttgtttttaatttagtttttggccctacgtttttaattacattacatgatgtaatttttagataaatgaaatgtaaaaaataattaggagttttatattaattctagtacagttgtccctctatgggggattggttccaggattcaccccataccaaaatccacgaatgctcaagtctcttatatacaatagtaatatttacatataacctaaatacattctcccatatactttaaatcatttctagattacttataatacctaatacagtgtaaatgctgtgtgagtagttgttacgttgtattatttaaggagtaatgacaagaaaaaaaagttaatatatgttcagtacaggcacaaccatgctttttttttcctgaatatttttgatttgtatttggttgaattcatggatgcagaacccatggatacagaggaccaactgttttttaatttatgtagaaaattctaaaatgtttaacactattattttactaggtactgtaaaattattatgctttaaactcttgaaatcagtaacagtagatgggtagatagcattaggagggctaattgacagttgtaaatcacatattgaattggtggatattccctgtcattggaatattttctcttgatacttttccacatcatgtgataatcaactgcaatgaaattctgtcattagaaacctaggaaatactctctggcttccaatcctttgcagactattttgtagagcacccactggagtgggttcatttcctatgcctgggtttatttctcttgggaaatgacagctatctctcaaatttctatggattttccatatggaaatcataagtatcaaatacctttagaaagaagcaataatgtttaaataacattttcacaaacttctattatccatcgtttgaatagtagtctattctgaacatagcagctaaggtgatcctgtcaaaatataagtcagatcatgtcaatcccatgttcaaaagtttctggatcctgcccacatctctcagaataaaagctaaagtcatatccctccctctattctactctctcccttgcccatttccctctagttacactggattccttgctgttctttgtacctgtcaggtgcgctctgcctgagcgccttcacttttattgttccttctgtctggaatattcctttcttatatattagtatggttcaccttttagctctgacagtactgctcaatatcaccttctctatgagataaagtagtatccctccccactattgcgagcatagccattttcctaccctgttatcttttttaaatagcacttatcaccttctagcatattatataatttactccccttgctagcatgtaaactccatgaggagctatgacagcaggaaattttgttttgccccttgataaatccccagtccctggaacagtacctagcaaatgttaatagtattcaacaaatatttattgttgaatgaagatgccttagatattgtttgaaagaggtatgtaggatatattttcctaatcatctatagcattattatattcttccctacatggttttaatattattttgaaaactgaatgtatgtactattctcctccctccaagctattatcattttcactaaaagttggaaattgggggcagttgcattagaatatgaatttcatttgaagtgtgtctggaatgattactgtctgagaccatgttgtagatttctcttttttttgttgttgatgttattataagaaagaggggagagagcacagttaacttaaactgttcttttttctgttttttttaattatgataataaataaaaacctcaatttgttattatggaaacttgatatcgtttgcctttaaattggggcttggattttaaccacagagatttcctgagagacaccttagataacctgagagatttccaactcagatctcttagaatgtctttgagctatgagatgagtcacaagtgttggggcttgtaacttctcattttgtatccctttggagaaagagatttagttaaatcaatctttatcatagtctgtttcgccagtgcacatttataaatccttgactttcttagcttctgcccagccaagtatctcgagacaactactgtaattgacagattacacaatgtttgagagttgttagtcttttactttacctccacgtgaagagtgctggatcattcttacttctggttttggctggtatgagttggcctttagttgagattttcgagaggttgtagttactaagatataacctcaaatttttgtatgggaagtttctatttactgtactaggtcggcttcatgatgtcgtataaatagaaatctgccagataatccatctttagagcaatgacattagaggataacttttgctagctattaaccatgtgctttaatttaaaaattagaatatatatatataatatatgtatttctcagttagcttgttataattctgttttattgttctccttaggatattagctgcaatgagattcaagtccttccccaacaaatgggaaaattacattcacttagagagctaaatataagaagaaataatcttcatgttttgccagatggtaagatgttcactgtttttactcacatgaataagagagtaactatgtaaaatttaattaattatttttcatttctgaccagaattaggagaccttcccttagtcaagctggatttctcttgtaataaagtgaccgaaattccagtttgttacagaaagctgcatcatttacaagtaataattttggataacaatccattgcaagtaccaccagcacaggtttgtaataaaaatattataatgtttcttctcatttttattcataattttatctgtttatgactggtaaatcaaaaagcacctaaatcaagagccaatttgttgttcaagcactgttgtctaaagtttttctgagcattgccttttgcactttggtaggagttttagcttaggctctaggatagcatttggaaaacccagataataactttctgcttgtgaactgataattctggttgttagttatttacaaaagtgactctgaagtctctctacctatttcccactcaggtatatatctacttgggatttgttgtgggattgattggagtacattcttggcactgagagatggaattataacagaaagaacaaaatacaagtggaaaatattaattatgacttttagtttagtgaggattaaatccatgtggaatcctcttaaatgatagttaaggaataaactatgatataatcccctatggacaaagtatgaaagagaagaaagaggacagtggggaagagatgtcaatagaatttctgaaaatggaaaatagaatagtagaaacaagtacctttacttagattgcccaaaattatttggctgaggagcaagtagcagtgaaatggtactttatgctgtgtgccctggcagagggtttgcagacatccagaagaaaggtcttctttttcttcctacaaaagtacattccactcattctaaaggggttaccttttctaattcaaataaagactggctagagtcctggtggtagcaaccttagcagaatgaagaaagctgaaacttgtgcctgctatgggagaaggcaatcagattcaagttgatttacagcgtcaaacctgggaatggcttgagtattggaggaaacatgtaactctgaatatagggattaagtactgaaaacatgatggtttgtggaatgtctaaggcagtgctgtccagtagaactttctgaatgatggaaatgttttataatcgacactggtccaatactgtaaccacttgtttatgtggctgttgaatgcttggaatatagctagtgcaactaaggaaccaaattttaaattttattttaatttgatttatttaaatttaaattgctgcatgtgactggtagctcccatattaaacaccacggctctaagatttacaccctcagattcttgccctcagccccacagccacagaccattccttacttgcatcagcagaagtccggaatttattctaaggagtaggtagatccttaggttttctccgttagctcagtggccagatgatgactcacttcttgcctcagcagaagactggtgtttactccttagagaagcaccatcccatttgtacttgctgtggtgatgagcatgttctgtatctgcattgtccaatacggtagccatagtggctactgagtacttgaaagtgtatagtgtgacaaaagaactgaatttttattttatttagatttgattaatttacatttaaatacacatgtagaacacaaaaccaaacaccacatgttctcactcataagtgggagttgaacaatgagaacacatggacacagggaggggaatgtcacaaactggggcctgtgggggtgtggggggcaaggggagggagagcattgggacaaatacctaatacatgcggggttgaaaacctagatgatgggttgataggtgcagcaaaccaccatggcacatgtatacctgtgtaacaaacctgcacattttgcacatgtatcccagaacttaaagtaaaataaataaatagacacatgtggctagtggtaccctattggacagtgaagctataaagggattgaaacagagtcaggggctccaggtacagcttatatagcaagagcgagaccgcatactgaaaacagtgaatggttgcatactgaatgttgagacgctccagtttggctcccagaatgcttgcaacctgtcttacatatttcaggcagaattggtggatttcttccttagtaaactgcagcaggagaagagacctatctatatactgaatttttggagtcacctgatgaaatggctagtctgtgtctgatcaccagatagatggaagctcaccatcaggaaacttccccatgcacacagagcttccagtttgttttttattatcccttttggaaattaacagacaggtcggatggtagctcatgcctataatcccagtactttggaactttggtagactgaagtgggaggattgttagaacccagtaggttgaggctgctgtgagccctgatcacaccattgtaccattgtactacagcctagacagcagagtgagactctgtctttaaaaaaaaaaaaaaaaaaaaaaaaaaaggctgggtgcggtggctcacacttgtaattgcagcactttgggaggctgaggcagatggatcgcctgagctcaggagtttgagaccaccctgggcaatatggtgaaaccccgtctctactaaagtacaaaaaattagctgggtgtggtggcacgcgcctgtagtctcagctactggggaggctgaggcacgagaatcgcttgatccttggaggaggaggttgcagtgagccaagatcgtgccactgcactccagcttgggctacagagtgagactctgtctcaaaaaaaaaaaaagaaaaaaaaagaaaaaagaaaatgaacagccagccaagaatcattagacattgcaagagtaatctctaacatgaaagacagagaccaaaacaccaaaggctttcattgaaacgaaagggagcacatttattttttgtgtgtgtgtggatatccagaaatatttgtaaaccatatatctgatgaggggttaatagccaaaatacaaaaaggattcatataactcaatagcaaaaaaaaaaaaaaattgaaaaataggcaaaggacttgaatagacattttttcaaacaagacatacaaatggccaacagctatatgaaaagatattcagcattcctaatcatcagggaaatgtaaatcacaaccacaatgagatatcacttcacacttgttaggatgcctgttatcaaaaagaaaagataaccagtgctggcaaggatatggagaaaagggaaccattgtacactattgatgggaatgtaaaatggtacagccattatggaaaacagtatagtgcttcctcaaaaaattaaaagtagagctaccatataatattacagtcctacctctgggtatacatctgtaagagatagaaaaataaaccaaactattttttctattttaattctcaatacagaatacttcacttctggtcaccaaaatgcgtcagatttcttcccaccaccaagcagttctccagcagacactgactgggtatcctataattcaattcaattctgacactacctggagttaacatcagatcctacaggttaagagctcagtcccacagactgctcacctatacttctgactgaccaactataagttaaggttcccatgaccccctcctcaggttcagttaatttactagagtggttcacagaacttagtgaaacactttacttactattgctaatttattacaaaggatacaaatgaatagccagatggaagagaaggataggacaaggcatatgagaaggggtgctaactgaaggggtggagaggggatgttccctttcctccccatcataagggtcacggctgatacccctataacaaaaaacaagtaaacaagataaaaggataacaactttatttgatcatagttttacgtgacactggagccttcagaataaggacccaaggatatagagaaagttagctgactttatgcttcgattcaattcagactgggacagcagtgtagaaatgtgattggacaaaaaaagcatgagctaatggtaatagatggagtgggaaaacctagcaaggccttttcttggtgtctctgttgtagcgtttgttccttctgggtgtagggtaatacttctctggaatgagggttttaatttgtttatggccagtggttacacagaaaggtaggggaaggttagattaggctttatggctggctttggaaaaaaggggttctagtgcctatgactggccttggggacgataaattcttgtttccatgacttgcctctagtgagaatgaggaggtgagagacaggggaggggcgtctggagaaggtcagagaaaaactttgcttctgaggctttcattttggggtatcattttctgaacctcaatgaagcttttgtgccctctgtgggcacgccaccttccaggcacctccacgtgtttagcaatttgtaagctttccgaaccctgtccttttggtttttatggaggcttcgttgtggaggcacaattggttacatcattggccattggtgatcacctcaactttcagcccttctctggttcctggaggtgagggaggtaggattgaaagtttcaaccgcctaatcccatggttggttttcctggcaatcagtcccttatcctgtggctatccaggagctcccagccaccagtcattcattagcatgcaaagggatacttaccacttaagagatcgtgtaagagttttaggagctgtgtataggaaatgggagcaaaaccaagtatacattccttacaaattacaatatccgaaggaaatgaaatcaccatcttaaagaaataatctgcactcccatgttcattgcaacattattcactacagtcaagatatggaaacaacctgtatgtccatcaacagatgaatggataaagaaaatatagtgtgtgtgtgtgtgtgggggggggggtgtgtttgtgtgtaatgaaatattattcagccttagaaaaagaaggaaatcctgtcatttgcaacaacatggatgaaacttaaggacattatactaattgaaataagcctgacacagaaagataaatgctgtgtgatctcacgtatatgtggaaccttaaaaaaaaaaagttgaactcctggtgacagagagtagaatggtggttaccaggggctggggggtgtggataaaggggagattttaaacggtaccatccttcagttataagatgaataagtactgaggacctaatgtatatcatgctgataatagttaataatattgtatttacttgaaatttgttaagagagttgaactgaagtgttctcactacacacacaaacaaggtaactacatgaggtgatgggcatgttaattagcttgactgtggtaatcatttcacaatgtataatacagttgatccttgaacaacatgagggttaggggcatcgaaccctgcatactgtaaaaaatccatgtataactttggaatcacaaaaaacttagctgctaatagcctactgttgactggaagccttatcaataacaaacagttgactaacacatattttatatgttatatgttatttactgtattcttacaatcaagtaagctacagaaaagaaaatgttattaagaaaatcataaggaagagaaaatatatttaccattcactaagtggaagttgatcatcataaagatcttcatccccatggtcttcacattgaacagggctgaagaggaggaagaggaggggttggtctagctgtctcaggagtggcagaggtggaagaaaatccatgtataatggacctgcacagttcaaacttgtgttgttcaagggtcaactgtatatcaaagcatcacgttgtacaccttaaatttgggagttcagtcagggtggtgggaaaaattatagaagaaaagttatgaagatagttataggaaatagacacaaaccttcttggaaggctgggggggttgcatagcttcagtaaaaagttcagctgaagtcagcctaatcctcttaccttgagttaatagtttaaagtaggtacaaaggaatgtaagggagtttatctaaatagcttgtttactcatgtggccctaagcccaaccttttatcatctgtgagtgcatgattgctctctactcgaggggttggcagtgttaattaccttctagcggtgtttactcgagacctttgtaatttaatcagtactaaataaatgcgaacttccccggcttatcgaggcagatgctgcagactcaggcagcagagccccttagccagactgacaggcaaagtatctgtgtcagtgtacgtctttcatccgtcattgggtcagggtcagcgggatggacatggcacttaaatataaaaaaattttatttgtaactcatactttaataaagctcgaagaaaaaataaagaggaaaaatggagcatattcataggagtgctaatcagcatggctttctagcagcagttgtggaaactggcagatgttggaatgataccttcgaggactaagggagtatttctaacattctacattcaaactgtcatcaaatgtgaggtagaaaaaggtttcaaacatgcaagatcttagaaatttttactcccatgtaccctttcttaggatgctagcagagggtgtactataccaaagtgagggagtaaactaaaaaaaggggaattcttcttgtctgagattgacagatatgcataggcctagtaagcagccagtcagtagtttggagtacaggagttgtctccaaaaaaaaaaaaaaaaaaatagaaagtaagagatgatttgatacgtttgtccacatggagagatgttttatacttctgtcagagtcaagaatgaatttataataggcatatagaaaatttttcaaaagaaaaaatggggccattaattactttaggaaaaacaaaaacttacaggagaaaggaaatgtaatcatattactctgtagagtttatctgtgaatattttcttggtcataataatataaacactagattttgatttagtgaaaaactgtgacatagttataatagcagagatttatatagtatttgctgtgttctagacactgttgaaaatgctttacatatattaactcatttaattcttatgttaaccctgtaaaacaagtactgtcattatcctcattttacatgtaagaaaacagaggcatagaagttaaatgacttgttcaaggtcacattgctagcatgggttagagccaggattcaacctaaggcagtgtgactgcagagtccatgctctttaaccactatgttatacttctgaagagagaagtatgtttatgtgaattgataggaagcggggaggctgggatggtggtggtggtgtgggtaatgtaagaaatccaagtcctcatcttccttagtgatactccaataaatctaccattggaaaatttaaaacaaatagcagtagaagcatgttattaataaatatgagggcaaatagaaattaaactaaaagagtttaaagtgggaatttgatcttagagattgaaataattagaatgggctgggcacggtggttcatgcctgtaatcccagcactttgtgaggccgaggtgggaggatcacttgaacccaggagttcgagaacagcctgggcaacatggtgggaccctgtctctgcaaaatataagaaagattagccgggcatggtggtgtgtgcctgtaatttcatcccagctaatctgggaggatcacttgagcccaggatgtcgagggtgcagtgagccatgtttgtgccactgcactccagcctgggcgacagaatgagacgctgttttccaaaaacaagcaaaaaaaaaacaaaaaaacaaaaaaaaggagaagtagaattgaggattatgtcttgtcagctttgtaattatttttaaatttaaaaactgtgtacatgaagtactatgataaaaagttaaaatttacaagagagtgatttaccagcacttaatttggtaattaagataaatttttgtttagtttggacgtataatagaatactacctcacattttaattttagcacattttagttgatagtatttaatattaataatttataattaatagaaaaatcaatgatatttacaacatttaattggcaatatatttatattctaatagctcaaaagttttaattttccttttaaatgaaatttttcagtggtcaagtcagacctagtatctgttagaattatctaagaaacattcttcctttggacctggaatgataattgctttttaatgttgttgtcttactgttttctttgctgatttttttgcatgtgaggtaagcttatgtgagcccataaaatgttacattttttattagaattttgagaaatatttatttgatgtcacttagtgactgtaattaaccttgataaagctgacttacagttttcttacctctcattttctattgtttttatacagagtatctttgctcacatagtattttattcctcattattcattttctctatggccaacgaaagtaatttcttaggatattattctagttgaattgaccagtgttttcttttattatttcagtctcaccagcctaatatcgtacctttcaaaaaattcatttttcctatatttatattttttatgttagccttctccaggttttatgccaaacatcttagtggttctgatgagattactttaaagaatcacatagattatttgttcttttcttaccattccaatgaatatatatttttcattttttcaaataaaggccacttttatgagttgtaaacttcatattgtttaatagtttgtacattctgcttttgacaagaaaactctagtgaaatatagaaaaattaacttttttcaataagaacagagatggcaatagaattttagttggtatcagtgttgtcagatttttccacctggtgtcagaagtacaaattatttaaatatgcaaagtatcaatcaagattgtgatgtctcaatgtaatttgagactattgaatggtttaaaatgatagatgtcatttatatttggaactatataattaaatctttattttttattgacagatatgtttaaagggtaaggtgcacatatttaagtacttaaatattcaagcatgttgcagaatggataagaaaccagattccctggatcttccatcattgagtaaacgaatgccctcacagcctctcacagacaggtaatgtaacattcttacagtttcatttgatgattgctgtcttctctttttatgaaatatacttattaatcttgagtgttccgaatatatttaggctgattggtccagcactaaaataaataattggctgaagctacatatcaccatcatagaatgaagttctaggatactagaatatttttgacattttctcaatcattaaagttttagtagtaaaaatgtaaatgtttgacattatattacggaaacactaatttctcagcatgtgacaactgttaatttattttgtgatcactgtattgtacatttgtaacaacaagtagaatttgactttgaactgaggttggtggaagagcaagacatttggggagtaccttttccctttcatcatagtctttatgtctggatcaaagatgatatatcataatgacatataatgatatatcatctttgatgaacatctttgatgttctttatgatttcagtgttttgatcctcatgagattttgagatagtagattgaacattctgtttttaattcatcctttcaagatgtagattggtctgaaagattttatgaaagtataaatccatgtaatagtttagaaaataacctagaatggggtgagactacagaaagctagaccatgcccttgcctaaaatatttaaagatttgtcattgcatatatataaattttatattgctttgaatggcaatatagtaagtactattgttaacagcacaagtttgtgaattcccaaataggactttttcttgaatatttttattttgtaagtagaattaagtatctaaacattagattcagtttttaaagattattttgtttaatattatgaacagtattagaccaaacaaggctccaaaaattggaattaaggcattctaatctctattaatctgctttatatttattttaacatgaatttacttttagtaatggcatttactgttttagtcatttattttacaaatatcagttgaatgcctactggtagattcagttatgttttgttgaatgtcatatatgttggtcttggcctcttggtgctcacaatgtagtggagcaggagtcagtgaataaacaaagcaaggaaatacacacacatataaaatttcaaattgtattctgtgctatgaaggaatgtatttcaagagtgtcgtcagggaatgaataaaagccagctctgtgaagagcaaagtaagagcatcttaggcagaaagaatgacattgccatggccttaagttaggaaggaactttgtgtgttcaaacaactgaaaggagaccagcgtggttggagcagagtagctgaagggaaacgtggtacatgttgattttagagaggtagtcagagttcaagtcatgtgggtgctttgtaggatgtggtaagaagtttgaattttacttaaagtacagtgggaagtcattggacagttttaagtgggggaataacatgatttgactcatttttttaaaaaaaactattttggcttataggagaatagattggaagtaagcaaaaatagaagcacagggaccagttggattgttgtagtattgccaagagatcagggggtctagaataaagtaattgcaatacagatgaaaagaaatgggcagaattaagatatattttggagatattctctagcaggaccatccagtaaaaatataatgtgagccacatatataatttttaattttttgttacccattttgaaaaaagtaaaaagaaatacatgttatttgagtatatccaaaatattatcatttcaacatgtaattaatgtgaaaacttggtgagatattttatatgcttatttaatattaaatctttgaaatctggtatgtactttatgtgtatagtgtgtctcgatttggaatggctgtatatggctactggctgcttaccgtattggacagtgcaggtctatagagtgggttgtcagttgtattaatttctcactcacagcctgtattgaactacttagaaaattcttgtatgtgctttccactttcatactcaggctcttggctgtatggttcttactacctagaatgcccttccatgccttgtctgttttgtaaactctttattatacatagataggcactacagtacttacatataatagcttttggagtcagacataatatggctttgaagcccttttatgactcttaataactgtatgtccttgtgtattaatgtctctggtcctcagttttctcatatgtaaaaaagaaaataattacacaggtgctgtcaggattaaatgaagcaatgtatgtagagcacttagtgcaatgccttacccataacatttcctcaacaaatagcttattatcatcattgtcatttactacaaatacatggagtattttgtgcagtgcagtcagatgaattttggctctaatcatggtttaactacttaatttctctgtggccttgtgtaagttatttaacttctctgagcctgtttccatacctaaaatgttaaccatacccacttctacagttgtgagaattaaatgtgtgcctagcaattagttcaataaatgataaacagcaaatgttataatttttccccttgggacgttaacttttgtaagctttatttttttttgtaaaaagataataattataacttcaagactgtaagaattatgtctaaaatatgaggtgcatctaacacagtacataacacagtatagacactcaatgaatgctaacagttattgcctcttcatccacaagactaagctcaaatgccacattcttgagtgatgcctttcctaactttaccgaggagaattagttgaccttttttttttttctcatagcactttgtatttacctttgtcatagtcttcaaaacatttaaacacattcatttttcctctaggctgagagctagctctttggaggcaagttttaaaaatgtattttctcttaagcattcagcatagtacctgatacttggtaggtgattccctaaatgtattcatatacttctgaaaagtacaaaaaaaagtttttttttgttgttgttattgttttttttttttttttttttttttttttagcatgaaactggttttaggagcggaattaaaacatagtgattaccaccagggactttggtgctagataattgagggatcaaatttggactgctggctgcaagttgcgtatccttggataaattgcttaatccattccagtcaaagttttatcatatataaaatgagaaaacaccatcaatttgctacagtttttcacaataaatatgtaatgttttgtcttttaaacatttagcacagttcctcatacataataagtggtcattgtagactgtgtggtaaaattgcaaattaagtgaaaaatactttgcttcctgggtggcatattttgtaaatcagaaatttgcaaggacaaagtgaatttgaaagtattaaagtgcatattcaatactttgtagctttcatttttacatcctctctttattagatgggcattatttatataaataaaacatttttagagccaatgaagagtaaagcatataaattgaagttaaaagatgtttcgaagctctgtgatgaaatttgacaaaccaatgggaaaaacaggtcttccatcaagataatgttctaacaaggcagcctgattttctgaatctctgaggagaaataataggttattgttgacaattgacactatagagtacacgaagggaacaatattgcatgagtggcatgaataaaatgttttgtaggaagagttctgatatttttctcctcatgtccctaattaaggatcttagacatcaaaagtatatattctgtattatctagggaaattttaggtcaaatgtgcattatctatttaagaagaaaatcctaactgctcttaggatttctatttccatagtatggaagatttttatccaaataaaaatcatggccctgactctggaattggaagtgataatggagagaaacgattatccacaacagaagtgagtattttctattgctgatccattctgttttacaattttattagagcattgaaatagagacccttgtgcatacttgagtttattttgcttgaaaatatgatcattatattttatgactaaaactgaaaaaaagggcatgctgatttttaaagctgagcagtaaaccttatgttaattttgggtttgaaaactggagatgtaaagcagacattctgtaattcatatgtaaaattgaagtaacataatccatatcgtaagtttaaaatgcctcatttgtactttttgcttattccttttagccatcagatgatgacacagtcagccttcattctcaagtctcagaatcaaatagagagcagacatcaagaaatgacagtcacataataggaagtaagactgattctcagaaaggtaattcatatggtacctgctatttttgtttcatgtacatagcccacattaaaaatgggctttgaaaaattatattgtctttagcaaactcttacattgagaaaatacacatttttctaaggacagcagtgtcaagcatacagtttactatgtacattttctaataaatattaatctgtacctagaccaggaggtatatgattttgttgaccccaacacagaagatgtagcagttcctgaacagggaaatgcacatattggatcatttgtatcattctttaaggtaaataaaactttgaacaaatattaataacatgttctcttgatcttataaaagtggactatacaatttaaaatgtaactttcttttatataagggaaaagaaaaatgttctgaaaaatctcggaaaaatgaagaattaggagatgaaaaaaggtaagcacatatgaaaatgaaatgttatttataagcccttgagccattcattagatattcctacttgaaagagtacttgaaaaaaatataattttttgttcacttacctcttatgtttagatagttaatttataaatacttcacatctgtctgtattcctcaagtaaacacaaaattatagtaagcgtttgagtgtaggatgtgcactatttttacccctgaagtgtaatgatgacttctattattattattgaggaggactataccgtcatatacattgcttcatttgagctatttaacaaccataacaatagatggtattgacatcactttaccaattaagacactgaaaccaggagttttaaatggctggaactcagatgtattgtctcttgttctactatactttccatttggtcatgctgattatgacttttaagggtacttatgtccatattttattaaaataattgtgctttggatcttttttgaaccattcatcttataaaatgatgaaatatgacctaccacatttttttcagttactccttcaggttgctttatagatgcagaaaggaaagaagaaacatttggtgaatacctaccatataccaggattagtgctatgtgctttcccatgtttctcattttatcttcattaaaatcctgtagggtagatactgacctcattttttcaggtgaggaaggtgaagttcaaagactcttaagttttatgcctaaaaccacttagccagtgtccactagtacctagagtgtgaaagtagctctctttgatttttaaacttttctcttttctctacattatgcttcctccaaatgacttcacagttattagttaatcatctctgatgtcctgtaaggaggtacattgctttgtcttgaactgtttagatttcattcttttactttctcacctcatctaatgaggtcagttgcttaaacttgagaaacacctgtagcatgtacgatgtggtaaagtcacaaagattcatggtttgatactgtttttaaagtgaaatctaaagataaaatgactagagtttggataactattttaaaatttttttgttctcttttataaagatgacatattagtattttcacgcaaatttgccaatcttatttgaacctattttggattttctttatttagacatatacagatttttaaaatcaaaatcaataaactgataaaaacaggatggtgcaattaaatgacaaaattttacaatattttaaatttatgtattaagacaggccatatagaactctgcagtcctttttatactgaaggctggagaatatacatttttagattactattaaccattacacatttcagaaatctaaaaaatggtttatatactttgctattatttgttagtcattaattatattaatacagccagtatgctacatttcataatgagtagagaacacagaagttttccttatttcttattttagcattttaaaagaaggacctaggattttaactttcatatggtgttaaaaacaaaaatggtttctatttctggaagctggcataaaatgtagtctgccttactttttggataaccatgtttgtgtcacctttcagacttgagaaagaacagttactggcagaggaagaggatgatgatttgaaggaagtaactgatttgaggaaaatagctgctcagttattgcagcaagaacagaagaacaggtattcctttcagtaatgagatttgaattggcaaattttataatcattaaattgattatttaaagattatcaaagtatatgaagttttgagtaaacaatagtgccctcttaagatctatctcaagggactaactacagattgagtattcctcattcaaaaatctgaaatcggatcccaagcatttcaaataagggatactcaacctgtactaaaaggcaataggaaatacttaggacgggaatataaaattacatttacaactaacagaatgtactcatatatatagtcactatatttaatattgcctaggtatttcttttttattcctgtgtgtgtgctgaatcataataactgatttatttgttgatattaattttagctcacagtagcattatttacattgtaagcattttttttctaggtacatgtcatgaatataacgtgctttttaaaactcagattccaaacttggcatacgtctaaactccttagaatggagttgaattttgcaagagttgattaaatcagtatgatgatttgagggtcactggctcactttggtctgtttcttggtcaaagaccattttcctcatcttttggctaggctttcttcaagtacatgttgttggcaatgagaagggtactgtgtgaatgagaataaaatcaagacatgtccacttctaatgcaggaaaagttccatatgctgctgagggtcagctgttattgccatcttcatgtactgagaggactacatttatagttttgaaatgataaagatctgaatggtttttttttgctttgagaaaagagaataattttggtgcatttaacatggataagtaaaatattttatttcatttattcaaaataataaatgtttatggttaatatgaccatgttttgggaagtttcaaatttaaatatactggcatttgtttaaatgtacattgaaaaatacaactaaaacttatcaaatgacaaatatatggtttctaggggccactttttaggggcaatctatataatagctaataagctaaattgcctaagtgtcttttttgcacagttgctacatttatagatatacaaaatcatactagaaaatcactaacctttattcctttcatatcaaatgtatcttcatcagcagttcacatttttcttctgctgtaactttcggtctgctttttctgtgatgtttatcttttcaacttttcctgtgattcttttctaatgggccttttaaaaattggctacttatgaggctgtgtttgtttttccccctccaatataatttaagtgttgattgccctgtgatttaaaaggtttgatgaagcaagccaccacctgttctgtggagcttaaaaagtttctgtctcctctacctagcaggtgaaagaattgtatttatcattatgggacgataatattgtttttttaagaacccacagctagctgggtgccatggtttatgcctgtaatcccagtactttgggaggccgaggtgggtggatcgcttgagctcaggagtgcaagaccagcctgggcaacatggcgaaaccccgtctctaccaaaaatacaaaaaattagccgggcatggtggtgtgcacctgtggtcctagccacttgggaggctgaggtgggaagatcgcttgagcctgagaggcagaggttgcagtgagccaagatcatgccactgcactccagcctgggtgacagatctcaaaaaaaaaaaaaaaaaaccgacaggcctatccatttttctcgtggtattaggaatagcatttgagtgcataattatagatttttacattgtcatatacgatatttctgtatttccattttcttattagcatattagtttttcatctatccatgtgacttaaattattctttctagcctaggtacaacattgactgaatagttaatctttcattggttttatttttgtgatagttttgtaatcagtacaaaatagcatctagcactgtgccttatacatagtaaatacataatatttttgattgactgcttgaaaattaaatcaatacatttaaaactagtaggagaaattagttaaaaaattatatgttctccctaaaaaaaacttctgctgttcttcaagatgtatgcaaaagtaatttctttttctaattctcttctttatcatcctttttagatgttagtacatactaatataagaactttttagattaaatattaatatacagtgacattgttgtgataagtatgtctaattttttcagacattaaaatatttataatatgatcataaagtaaagagcacttttttttttgagacagagtcttgctctgttgcccagtctagagtgcagtggtacagtcttggctcactgcagcctctgcctcctgggttcaagtcattctcatccctcggcctcccaagtagctgggattaccagtgtgtgccaccacacccggctattttttttgtattttagtagagacggggtttcgccatgttggctaggctggtctgaaactcctggcctcaggggttccacccgcctcggccttccaaagtgctgggattacaggcgtgagccaccacgcccggccaaagagcacattttacttttaaaatttataacgtatggagaattttagatccctagccaattctgttaatgcctgaacttaaactggatctcagaatttttaaatgctaaatctaatattttttctattaaataatctttcttccttctacaatatgttactattgcttagatcttttagatttagggacttaaaatttttagtttactgtcacaatacttgaatttgaatgagaccaaaaatctaagcgtaatcctatatgagaatatatcctacagtggatttgatataatttataccttctctggttgtggattttccttttcatgctgtattattgtgtcttatattccaaatatattagtgaaggatctgaaatgctatttaaaattgtaggccaggagttgtaacatctctttttaggttttaaaataattattgtaaattttgtttgtttttagtcttgattaaaaataatttaactggattaagattaccctcgcctaccaggaaatatcatccaggactgctactttgactgtatattacttaactgttctttaacttgctactagtagaagacaaatgcaatgttagctctcagctaaatgaagccatgtatcttctcccaaactagaggtaattaaaaaacagcttacattgagttcagtgatgatttccttatggcagttttgccacttgcttagttcatatatatttttaattttttaatttatttttttttaatattttttgagacggagtctcactctgttgcccaggctggagtgcagtggtgcaatctcagctcaccacaacctccacctcccgggttcaagcaattctcctggctcagcctcccaagtagctgggactacaggcatgcgctagcatgcctggctaatttttgtatttttagtagagacagggtttcactgtgttggccaggctggtcttgaactgctgacctcgtgatctgcccgcctcagcctcccaaagtgctgggattacaggtgtgagccaccacgcctggcagttcatattattttttaaaatgtctttgattctttaagaaactttatgccagtacttggtacatgaaactatcctaggggagcagcaagaggatattgtacagaattaatactcaaaaagggtgagaaaagagatcagcaaataaaccatcaaattggtaactcataaggttttaaagtctgaagcctagttgtttagaagactgcctccactttgtctgattaagatgtgtaggttaagctactttatgtttacagtttattgttgaattttttttttttttttttgagacagtctcactctgtcgtccaggctggagtgcagtggcgtgatctcggttcactgcaagctccgcctcctgggttcacgccattctcctgcctcagcctcctgagtagctgggactacaggcgcctgccaccacgcccgactaattgtttgtatttttagtagagacggggtttcaccatgttagccaggatggtctcaatctcctgacgtcgtgatccgcctgccttggcctcccaaagtgctgggattacaggcgtgagccaccgcgccgggcctgaatttttttttttaattgataaacagtctttatcatcccctgtcaaaatattggattattatttctacttgcatctgagtgtattgaagtcactctgaatcaatgactttgactatatttaaatagctattcatcaagttctaattttaccttcactattattttgggaaataaaaacaagtcttgaaaaaaaatcattatcttaaaaataatgttgcatgatgagtaagttctagggatctgctgtacaacattgtgcctataattaacagtacagtattgtatacttaaaaatttgttaaaagagtagatctcttgttaaatgttcttaccaaaataaaataaaattgacaaaagggagcatgttttttagaccaagaaaaatcaaggaaggaactgagaataaaatgatactattagaatattcttaatattaacttgataataaaaaaggaaattctgttgaaaaacaaaaaagttgatatgtattattaattattgagccagttttacaaatttccatgagtcttactcatttatgttagtgttgaaaaggtggctactgctctttttcttatactgattttctttgggggcgtaataagtagatgtttagctggcttcttaaattttgtttagttactattctaaagaaaggattaaaatatatgtgtgattttgcagtaaatagcttcatttaactggttcccattgcatgtttgttcctgctaacttacgctgtagtattttctgttgtgtctttccttttagtaattattttatttgcttttaggtgtgtcttgagagtttttctttattgtggaaagatgtgcttctaattactatgtgatacagctaaataacaaaaagcaattatgaaaagttataattaaagtataattaaggatcatggaaagcaaaactaggtttaggaagtttataattttgttttagaattatagaaattatggacattacctgttttattatgatttttccctgatcatgtgaacatttcaatttgaggagcatcatgttaacctctagcttgttataactaattaggtggatctctcagtccttgaaatctatgtattcttttgtttctgctttctttacaaatgactaccctgtctctccaaaaacatcttctcccatcttttggtttggttgatttatgtgaaatatgaatacagacagaggcctttaagttgtaggagcatcattcagtgataaactcttccagaggaccagagcagcaggacatgaatcaaggtatctagagtttgtggaagccttcaagtattatggggccaggttgacatagctgaattgtatagtcttttacttaaaataagtactagtaactggattagggaagtatgttaataatctagatgtttaattagaatagatgtttgttttgacttttggtatcagagtaaatcataaaataatgaacatagcaaaattttacataggtgaattctcaagtacataaaatatattgtataggtaagtggatctcaacttgtttttctgtttcaatataactcatacacaaccgtaatcacaatgctaatgaatgtgtggtgagaaggagttagaatttactatagtgaaggccattgtagtttgagtcccctcccctgcaataattctgaaatttcccccagggtagtacttactgcggtctcttctttaaaaaaaaatcactcttttaaaatatatttttcctaatagttttagatatttcattaccttaatttttctgtatttaagaatttaaggcaattttaatgcatgcctatacaaagaagaagtgtccttaattctgaaattgtttggcccaaagctacactgattggtgtgtgatacttgtcctttgcatctcattatcactttttcctagtgaggccctactagatccacgctagtgaggaatccagcgtaatggactttggtttctttatgctaaccatatttctgtaattaccaacttatatttaattcattatgtattttattagtcaatatatagcttttatttaaaatccatttctgtattcttttggcagttgacgtctggagattttattttgaataaaaggccgagattttacttatattaaattttaaaagtgaaaattatatttatatatagtaacattaagaactcttaagtatagttccttatgttaaggacagtaattcattacttttgactttgagattaatacttagaattatgtaacattatgtagaaatagttctctcttataatggttcatcattttctttctttggttttctttgaatggttttatttagttattaaaagtttaagaaacttgtgtttttttaaagaattggactggagcgctgattttgcatttagaattaaaatttttcatttggcaaaataactatgtattacataaacatacctcatatcatttgctgtgctgggaaaaataaatcagtcacgatggtacctctgtatctctttatcttctatctcagccaaaagttagatatgcaaagggcaataatagcatgggtagaagatatccaaactttgagaaagggtttataaacgaagatgcatggaaaagttgccgagcttcattttgttataaaatagtacacttatgggcatctgatctaaataatatttaaatattattttctagcaaagatcttcaaggaccagatgcagtttattttagagattttttttatatcatgtgatgtaatattcttaatagatttgggaattaatgtgttgatttacttctaggattcttaatcattcaacttctgtgatgagaaacaagccaaaacaaactgtggaatgtgaaaagaggtataaaaatatcttagtttttacatttaatattttataatgagtattgatcctttgacagtgatgtttttgtatataggctttaattaaataagtgatacagatttaatataactagataatttaaataggaaatgttttagaacatgagttaaatttacttttgatgtaagcaaaataaaaaatgctgatcttttttgctcatagatgcatttttgtcttgatagaatcatttatttgttcattcagtgaacatttattatattgctattcctgccaggaataatgtgtttctttatcattgattgtgtttattctctatgatactgtttatgttttcatttcttttcaattgggtggtactaaattcttctatgtgaatacatgatataaatccacatatatgaattcctgagaactagaagaccttgaaagtttctatttattctttttgatggtttgaatttagattagactcaactcctgagtcaatcctctgagaatgttcaggcccagtctttttctgcttggcttattccagcagtcccaagacatagctcctttttttcaggtttgcctagctttaagtctgtcttctgcacaatggaagagtgataattctgaaacaaatcttacttgtgactcccatttattatcttctaatgactctttacaacttttagaataaaccttaaaatatttaacttaacccataagattgaggtgggtttctgcttaccctgagagcttcatcttgtacattcccccactggcaccatttgcatttaggaacagaacttctttcttcattctcttggggaagttatttagcttactctgagccacatttaccccttctataaaacacaaataataacagtgtctacctcatggttactgtaaggatgaaatgggttaatgtagtaaattgcttatgacggtgattagcacacagaaagtgtcacatatgttattagttgttaaactaagttattactattgtgaactttcttatttttcctttcttttgtatctcagcccttcctttttcaattctaacctccttttttgttcaaaagggaaatagctttgtgggtattctttttctggtattaagaagtattatatgaccttaacttttttttctttttttaaattatactttaagttctgagatacatgtgtagaatcggcaggtttgttactaggtatacatgtgctctgatggtttgctgcacgtatcaaaacacattaaattatgggaatatattttaaattctgtgacttttttcagcagtacgtgggtgagcacaccccaccccttccccacctttagaaaaatctcacatactttctgttaacaaaaatgagatcatactgagtatactatttagtaatatgcagttttcacttaatattatagtgatggttttatatacctactaaatctaaatatacattttgatgaactttatatatcctgtacacttgtattttccttccttccttcctctctttctctttctctctctctctctcttttttttttttttttttttttttgacagagtcttgctctgtcgcccaggctggagtgcagtggcgcggagatgagatttcaccatgttggccaggctggtctcgaactcctgacttcaagtgattcacctgcctcagcctcccaaaatgctgggattacaggtgtgagccaccacacacctggcccacttgtattattttcttaacttaaatgcttaaagatatgttattgatggattaaaacatgagtgtacatttaaagcttttgatatgttgtctccagaagcttttatgtttgcattcccacaagtaacacatggatagctttacttccatacttgttaacactatacattatcaatctatttaatctttgccattctaaaaagaacaaattatatcaaaatgttttatttttcatttcagtgattaaattagtgatgatgagtattatttcaagtttttattgcctatctatattgcttcttttgtaatttgtttgtttgcatctgttgtggtcagaagcactttctattgttgaaatatattgagtatttttatggcccagaatatggcctatcatggtaaaagttctttaggaacttggaaaaaaatgtattctgtggttattggttagagtcttatataatgtcaactatgttaagttggttgatagtattgtttaaatcttcaataccttacctattttctgttttcttgttctatcagttagtaagagaaggttattgaaatctccaacactaattgtagatttatctttctccttgcagttctataatttttccttcatacattctgaagctctattattagatatataaatgtttaggattgtattgtcctcttggtgaatttgtactgtcattctgaaatgacttttctttatattcttgataatattctctgctctgaagtccacttttctgatattaatattgtcagtccagctctcttttgtttagtattagcatgatgcgtgtttctccatccttttatttttaactgatttgtgtctttgtagagaaagcgcatttcttatagttagcatatggtagtatcttcctgctttttattgaatctgacaatctacgttctaattgcaatgttaaaaatcatttatgtttttgtaattaatgatattttgaggtttgctgtatgttttctttctgttctatcctttttattcatttttcctccttctctgttgtcttttgaattatatttaaaaatttttgtttatttcctttgtgggcttatttgctgtaactttttgttatgttaatggtttttttaggggttagagtatgatatttagcttatcacagtctatcttcaagggctattatgccatttcgtgtgtcatgtgagaaccttagaacagtatacttattttttttcctttttagccttggtgtgttgtcatacattttactttttatgtatctgttatgtgtaccataacaagttgttatttatgctttaaacagttatttgttcttaagaacatttagataatcagaataatgtcttttatgtgttcaatcccttagttactatctccagtgccctttattttttgtgtagattcatatttacatgtgcatcactttctttctgcctaaaagagagattttaacataattttactactggtctgctgattgaatgcttttagcttttctatgtctgaaaaagtctttttttaaattttttttttttaaacaggatcttgctctgtcaccgaggctggagtgcagtggcgccatcacagctcactgcagctttgacctcctgcactccagtgatcctcccacctctcagcctcccaagtaactgggaccacaggcatgtgtcatcccacccagccaacttaaacatttttttttttttttttttgtagagacagggtctcactatgttgcccaggctggttttgaactctcggtctcaaggaatcctccttccttggcctcccaacgtgttgggattacaggcatgagctaccatgcctagctcaccttcgtttttgaaagatattttggctcatacacaattctagtttgacattttagttttcttcgagtaccttgaagaggtttctccaccatcctctggattgtactgttttctatgagaatattcttatctttgttttactttgcctaatgtgtccttttttcctctgggtgtctgtaacattttttatcactcgttttaagtaatttgatggtgatatatcttggtgtagttttcttcatgttacttttgtttggagttcattgagcttcttgaatttgtgggtttattttcatgaaatttgaaattttggggcccttatttcttcagatatgttttctatcatttgacctcttctattatggaactccaattaggccacttgaagtttgccatggaacattgatgttctattcattctttaatatttttctgtctgtgttgggttttggcaagtccttctgctttgtctttgtgtttgctagtcatttcttgtgaaatgtctaatctgcagttaattccatccagtttgttttaatttcagatgttgcactttttatttctagaagtttgattatgtctgtacttaacatgttcagtcttttcctttagcttcttgaacattgcttggttgaatttttgattaaatgacagacattgtgtactttacattcttgagtgtggatattgtattattatacatacttttgacttttgttctgggatatggttaaattacttggaaataatttgatattttgggacttggttttataatttatttatgtgggaccagtgcagcatttagtctaggaataaatttgtccccttaatgaggcaagacatttctctactggatgtcctgtgaattatgaggttttccagtttagctggtgggaactggtactactcctggtcctctgagaatctgggaattattccctctaagctttgagggtgattttatccttttgcctagggtattttcctcacatacatgttcaatgatcagtacgctcagatgaaaatttgagggatgcctctgtagatctctttcctttctctgtgcattgcccttttgtttgttactgtgtgctatgaactcactctgcccttttctccctggctccagctctgtctcctgaattctgggcctgctagactctgccttagtttttttctcctgggatgtggactggaaactctttccatgcagcaacttggctcagttatgggatttacctccttactcatctctaaaggataatgtcattttttgcctaatattcaatgtcatggaaggcataattttaaatattttgcccattcttttagttttttcagtcaggatataaatctggtcactgttagcctatcttggccactagcaaagtctagtttttacattttatgtgttcaaatttgttagtatttaattttgattgtttgtcccataggctctctctattccaatatttaaaaaattactgcctgtatttttctgatactttgtgatttcttctttatatttaaatcttttaatttttcattttgatatttggtatgaggtaaggaatctagttttcttcctcccccacctttttctcactgtgtctcctcccccttttttattctttctttcagtgtatattttacacgtgatcaatcaggtgtctctctactacttgttatataagccattactttcacaatgatcttaaatgtcatttttttcagaagttattatactcgtggtcctgtactcctcttccattgaaaaatctgtagattctggagctagtagaaaggagggttgaaaagtcctctttattatataacttttctcttcgtgatcatccattcttccaaattaactttggaactcctttgtcaaatgtttaaaacaaaccaaaaaatacttcttgagttaaaaaaattattattacagttcatttcagttattaattaagttgaaagagaagttatacctgtaatacttatctatccaagaaccttttggttattcaagtctcttactagacatttgtagttttttcatgtaggtcttgtagaagtatagttaagtttcttcctaggtattttatacttttctttccttctatgaatagcatttttttctaatatatcttttaactcattatagttgatatgtaggaaagctattaacttttgtatgtttttctttaactggtaaccttacctcttataataatagattttttgtctttttctcttggataatcatgtgttctataaattttaaaaattggatctttatatccaatttttattttctttttgttattgcactatacagaaattccacaatagtgttaagttatagcagcttcagtggacattttgtttatatattttttccacaggaactccttgttcaaaattgccatctaacaacagcatgcatagtctgccttatctcaacaacaaaaaattagatgaaaataatttccttcatagcccctgttttgttagaatgaacaggttgcatctcataatcagtaattcagtaggcaaaaataactactcgcttgagctctttggcatttagacaaaggaaattattagttttttttagtctttgttaattattttaatataataaatatcctgtctgtcctttgacaatatatctttagatatttcacttattttagcttctgggaattccttagaatagacctatgcatagggcctacatagaataaacccattttgatatttcctgtagagcaacaggttttagaaacttaaatatatttctgtcaactttaagttttatgttgttaggccaaagtgtagacatgggtaaattctttacaatgtttttaaaaagataacatctaaggttcataatatatatttaaggatttattctaaatattttaacgtattaaggcatcttcaattttttagtgtctcagcagatgaagttaattcaccattatcacccctcacctggcaggtaagaagaaattaaattacaattatatctatcattttgttctcttttatttagttaaaataaattgtctcattatagcccttagaaaatcagaaggatcaaatagatgaacaaccgtggccagaatctcaccctataatctggcagagtgaagaaaggaggcggagcaaacagattagaaaagaatatttcaaggtactctatattaagtttttaaatttactttgtaattattagtttttattttgtcagttttgttttgagttaataaggtagactgtaactctctagttaaatgtagtaaatgtgttattttgatttctcacatatatggggtaatacaatctaattatatccataaggtttcagtaattgagaataattgagtagataaatataaattatgatttaccaaatactttgcaagatagacgaatgtttgctgcactgctagttgtagcaatatgtagtatgttttaaaagaattgtccaggaaaagtctttcattggatttgtttcaataaatatttgacacatatttacaattagcatttaactgttcctatgtaaataagtgttgtttatatagttctgaaaatgcttgagggcagatttttccatttttttcttcttgttaccttagtagattgcttgagtgtcttttatcttagctaaaagaaaagctcagatcatccaaattatcccacatttctagttagcagggttttaatgaaattttactgtgtacacatttgtaaatattgtattattgtctatttgtgattggggtctgctgtatttgtagaagccaatcattagaattcagaataatattcaatactagccagaattcattactggatttgactcaaatgaatagtacaaacaagcttctgctccatgaatagcaaattttgttgtctttgtacacgttttatgtttcccaaagcctaattattattagatgataatagtaatttcatctgaaacatagtactagtctacattgtaggttcaagtttatatcactaataaataggattatattctctgtttttctctggtagaaataggtctgtatgcacatttgtttgtttctatatatgggtgtgtaacatacatttggaaatagtatcatgactaaaacaaaactgttatatgtcttagtggatctgtggtaaatttaagccttcaacaaataaatactgagtccttttaatgagtcttacatttcctggtcaatataagagataacaaagaaacagaagacatgaggaaaaagggaaggacattctaagtagaaccctggtcaataatagtgaaagtttatttatcctaaccctttatacatctgtaattgtgtttacattccagcattattttaaagtttccctttttagttcattggaccttgaacaaagcactgaataaaatttgcttgtagataaaacttagtgaatgactgatggtatgggggaaattttagtagtatttcatataataaaagaaatttaatatttatttgctctcctttattgtagtataacaatacaaattcttagtatactaccaatatcgtagtataacaaaaccagttctcctttatcatagtaacaataccaattctgactatttgtcaaaaaacttacatagcacttattaagtgccaggcactgtcctaagacttcacaaagatcaactcatttaatcctcataacaaccttatgaggtaagtacaattatgactatttctgttttacagatgatgaaattaaggcacagagatgcaaagtagtattcttcagttcacttagtaataagtggcagagttgagatttgaacccaaagcctatgctaggctgcctctttatctactgtgtatagcttaatatcatatcagcaaacactttcaaacaaacacagttttactggtttttaatttttttttttaagagacagagtctctctctattgcccagactgcagtgcaatagcgtgatcatagcacacagcagcctcaaatgcctgggctcaggccatcctctgggctcacgtgatcctcttgcttcagcctccccagtagctagaactacaggtatgtcccccagtgccctacaaattttaaaattttttgtagaggtgagatcttattatgttgcccaggctggtctcaaattcctggcttcaagagatcctcccatctaggcccccccaaagtgctgagattactgacatttttggcccacttttagtgtttaaaaaacgttttacagtaacttgagtggacttctcaagatgtcttaatagaggccacattttaaaaatgtgcattttaaaaactgagcattttaaaaacataattctttggtttcatagcatcatttattggtattttattttttataaaataaacatcttctataatattagttatgttataaagttattaaaagagatcaaatgatataatatttgaagtgctcattacataatcatcattcaacaaatgttaatttttttccttaataaattaggtgcaaagataagcttcagtcactgggaaatgttttaaggagatgtgtagttctcctaaattgtcagaagatgtcagtattaggacatagtaaaatgagtatgtcactagttttttttcctaagatgtcaagaaaatataaaactgacatacagtttcctaaattaaatcaacactattattcagaattgtcactattttcatgactaaaacatcagcagcttctaagaggaaatttctcttaatcacctatctcccgataattgaaagtgctattggtaggttgtattattaaagctaatctggatttatagttcattaaacagtaaaatacactacacttgaggtttatatcagattatcactgagtttgttcaatggtggctcttttaggttttgctatgttacgaaatgtacagaacttttgtgcaactttatcttaatacgtataaatgactgaggcacaggatttctttgtttctgtcccatggtaaattatttgtcatggttattcagtgtatttattgaatgtgtgtgtgtgtgtgtgtgtgtgtgtgtgtgtgtgtgtgtgtgtgtgtgtgtatgtatgtaagaaatccaactgtatttcttcttagttttgaaggctaattttggatagtatttttttcaggtaagtccctgaaactaggtaaaactgtttcaacatattggctagattatgtgagcaagaacacaaattgggtcaggttaagttagtaagtaaatcatggtaggaaagttacattgactcttttagattcccaggccgctatcgtatagattattattctagtatataaaatttagtgttcttatagccaaaataaaatcactgtatttcagggaacttcatgatgccaggaagtattttattaaacatctttttttattttaaatttttaatttttggcgttcatattaggtatatatatttatgggatacatgagatattttgaaaggcatacaatgttcaataatcacattatggggaatggggtatctattccttcaaacatttatcatttgtgttatgatcaaattatactcttagttattttgagatgtacaattaaattattattgactatagtcaccccattgcgctatcaaatactaggtcttatttattctattttttatgcccattatccatcttcacctaccctctactcccccactacccttctctagcctctggtaaccatccttctactctctatctttatgagttcaattgtttttacatcctacaaataagtgagaacatgtggtgtttgtctttctgtgcctggcttatttcacttaccataatgacctgcatttcaatccatgttgcaaatgacagactctccttctttatggctgaatagtactccattgtgtatgtgtaccacattttctttatctgttcttctattgatggacacttaggttgcttccaaatcttggctattgtgaatagttttgcaataaatatggaagtgcagatatctctttgatatactgatttcctttctttgggttatatacccagcagtaggattgctggattgtatggtagctgtatttttagttttttgaggagcctccaaactgttctccatattgttcgtactaatttacattcccaccaacagtgtacgagggttcccttttctccacatcctcaccagtatgttattgcctgtcttttggatataagccactttaactggggtaagatgatacatcattgtagttttgatttgcatttctctgatgatcaatgatgttgagcaccttttcgtatgccagtttgccatctgtatgtcttcttttcagaaatgtctattcacatcttttacccatgttttaatctaactattagatactttcctaaagagtcgcttgagctccttaaattctggttattaattccttgtcatatgggtagtttgcagatatttcctcctattccgtgggttgtctcttcactttcttgtttcctttgctgtgcagaagctttttaacttgatgtgatcccatttctccatgtttgctttggttgcctgcgcttatggggtagctcaggaaatttttgcccagacctgtgtcctggagattttcccccatgttttcttatagcagttttatagattgaagtcttagatttaagtccttaatccattttgatttgatttttgtgtacaacaagagataggggcctagtttcattcttctgcatacggatatccagttttcccagcctcatttactgaagagactgtcttttcccccgtgtatgttcttggcagctttgttgaaattgagttcactgtaggtgtgtgaagttgtttctgggttctctgttctgttccattggtctgtgtgtctgtttttatgcaagtaccatgatgttttggttaccataggtctgtagtataatttgaagtcatgtaatgtgattcctccagttttgttccttattcccaggatagctttggccattcttggtcttttgtggtttcatctaaatcttaggcttgatttttctatttctgtgatgaatgccattggtattttgatagggattgcattgaatctatagattgctctgagtagtatggacattttaacaatattgtttcttccaatccatgaatgtggaatatctttccatatttgtgtgtcctcttcaatttcttccagcagtattttatagttttcattgtagagatcttttacttctttggttaatttctaggtgtttaattttgtttgtgagtattgtaaatgggattatttttaaaatttcttttttagattgttcactgttggcatatagaaatcctactgacttttgtatgttgattttgtatcctgcaactttacagaatttatcagttctatttttttttttttggtggagtctaggtttttccaaatacaagattatatcatctgcagacaaggataatttgacttcttcttttccaatttggatgccctttatttctttctcttgtctgattgctctaggtgggactcctagtattgtgttgaataacagtggtgacaatgtgcatccctgtcatcttttagatcttaggggaaaggctatgagttttggcttttattatgttgagatatatttcttctataccccagtttttgagagtgtattagtctatttttatgctgctgataaagacatacctgagactggtcaatttacaaaagaaagaggtttattggactgacagttccacatggctgaggaggcctcacaatcatggtggaaggtgaaaggcacgtcttacatggtggcagacaagagaagagagcttgtgcagggaaactcctgtttttcaaatcatcaggtctcatgagacttattcactatcatgagaacaacacgggaaaaacctgcccccatgatttagttacctcccactggtatctcccatgacacttgtgaatcgtgtgagttacaattcaagatgaggttttggtggggacacaagcaaaccatatcagagggtttttatcatgaaggaatgttggattttagcaaatgcttgtccggcatcaattggaatggtcatatgatttttgtcctttattctgttgttatgatgtatcacaacaattgatttgcatatgttgaaccatgcttgcatccctggaataaatcccacttggtcatgatgaatgaccttttaaatatattgttgaattcggtttgctagtattctattgaagatttttgcatccatatttatccgagattttggcctgtagttttctattttggatgtgtctttgtctggttttagtattaggctaatactggccttgtagaatcagtttgccagtattccctcctcttcaattttttgaatactttgagtaggattggtattaggttttctttaagtttttggtagaattcagcagtgaagccctcaggtcccaggcatttctttcctgggagactatttattacagatttgatctcattacttgttattggcctgttcacattttggatttcttcatgatccaattttggtaggttttatgtgtctaggaatttgtccatctcctctagagtttccaatttatcggcacatagttgttcatagtagctagtagtggcccttcgaatttctgtggtatcagttgtaatgtctcctttttcatctctgattttatttgggtcttctcccctttttatcttaatctgactaaaggtttgtcaattttgtttatcttctcagtaaaccatatttttgtttcattgatcttttttatttttcttcatttcaaatttatttatttctgctctgatctttattatttcttttgtttttgtttgtttgtttgtttgtttaaaccagagtctcactctttctcccaggctgaggtgcagtggtgtcatggctcactgcagccttgacctcccagggtcaagccatcctttcacctttcagccttccaagtagctgggactacaggcaccaccacacccagctaatttttgtattttttgtagagatggggttttgccatgttgcccaggctggtcttgagctccttggctcaagcgatctgcccacctcacgctcccaaagtgttgggattacaggtgtgagccatgacacctgggctgtttcttttcttatactaactttggatttggtttgctcttccttttctggttctttaagatgaatcattatgttatttgtttgaggtttttcttctcttttgatgtaagcacttatagctggaaattttcctgttaatactgtttttgctgtatcccataggttttgctatgttgtatttgtattatcatttgtttcaagaaatttttcgatttccttcttaatttcttcattgacccactggtcattcaggagcatattgtttaatttccatttgtttgtatagttttaaaaattcttcttcttattgatttctggttttatttcattgtggtcagagaagttgcttcatgttatctcagcaacttctttgttgtttgactgttttaagacttattttgtgacctaacatatggtctatccttgagaatgatccatgtgctgaggagaagaacatatattctgtagccactggatgaaatgttcagtaaatatctgttgggtccatttggtctatagtgcagattaagtccaattgttctttgatgattttctgtctgggagatctgtccagtgctgaaagtggggtgttgaagtctccagctattactgtattgagatctatctctcttgagctccaataatatttgctttatatatctgagtgccccagtattgggtgcatatatacttacaaatcactatatcctctgactaagtttacccctttttcattatataatgaccttctttgtctcttgttcatttttatcttgaaatccattttgtctgatataagtatagctacacctgctcttttttggtttccattggcatggaatatctttcttcatccctttattctcagtctatgtgtatcttcgtaagtgaactgtgtttctttttttttcttttttctttttctttctttcttttttttttttttggtggagtcttcctctgtcacccaggctggagtgaaatggcatgatctcggctcactgcagcctctgtctcttgggttcaagcaattttcctgcctcagcctcctgagtagctgggactacaggcatgtaccaccatgcccagctaattttttattttttgtatttttagtagagatggggtttcaccatgttggccaggctggtcttgaactcctgacctcaagtgatccacccccctcggcctcaccccaacattgctaagctaaagggaaaggtcaagctgggaactgcttaggggaaacctgcctccaattctattcaaagtcaccactctgctcactgagataaatgcatatctgattgcctcctttggagaggctaatcagaaacttaagagaatgcagccatttgtctcttacctacctatgacctggaagtcccctggccgcttccagttttcctgcctttctggactgaaatattgtttgtcttacatatgttgattgatgtcttgtgtctccctaaaatgtttaaaaccaaagctgtgctctgaccaccttgggcacaggtcatcaggactgcctgaggctgtgacacaggcactatcctcaaccttggcaaaataagctttctttttttttttttgagacagagtcttgctctgtcacccagtggcgtgatctcggctcactgcaagctccatccccaaggttcacgccattctcccgcctcagcctccagagtagctgggactacaggcacccgccactatgcctggctaattttttttttttgtatttttagtagagacggggtttcaccgtgttagccaggatggtctcgatctcctgacctcgtgatccacccctctcggcctcccaaagtgctggaattacaggcatgagctaccacgcctggcctcaagtgtgtttcttgtaggtagcaggtcattgtgtcttattttttcatctattcagccattctatgtctttttattttaatagtttagttcatttacatttagtgttattattgatgttttattctactgcggccaagatggcactcacaccacaatacaaagtccttgccactcttctttcccctttccacaggtagaggaacctctctcagtggccaccaccaccactggcccatgggaggttctgctagcccgctgctcatgttctgttaaagcccaagggctcttcaatcagcttgtggtgaatgctgccagtcctgggactcaccctgaattctggcttggggcaggtccagaaatgctgcccaagagccgaggcctagattcctgaactccaagagactgcttgttgcttacctcactgtgtctgagtgggttcctaaggtgccaaattcccctttgtttttccctctgcttttctcaaacaggagactctccatgtagccacgacatctggttttgtgctaagtcttaccggacgccagcacatctcagtctctcccaaggtccacagcatactacctgggtatttctgctggttattcagggcccaagggctctttcatcagctggtgatgactcctggcaggactgggtccttcccttcaaggcagtgggttccctttttgcccaggggtatatgtctagtaatgtcatccaggagctggggcctggaatgggggtctcacaactctggccagtgccccatcctactgtggctgagctggtatccaagaggtaagacaaagtcctcctcagtcttccctgtcctgtcctcaagtgaaaggaaggggtctctttctcattgctgcgagctgcactgtctggggttgggggaggagtggtgcaagcactcccttagccacccctgctggtgtctccctaagtcacatgccaccctagtacactggttctaagcttagcacagcactaggagttgcctagaaattgcaatccttgtgccctagactgcctttcaagtttacctagaaccccagagtactttggcctgcgattggtgaggttactgagaaacttaagttcaagctgctggcatgagcgattcccatctggttagggctgatccaaatgctcccgccatgcctgggtgcttgttgagcacagcacaactttgttcccctctgtggcagggcagcactaagttcaatgtaaagccccccagtccctgtgctctccctcccccaagtatacaggctttctctccctgcactgctggctactgtgggtagctggctaatttttgtatttttagtagagaccgtgtttcaccatattgtctaggctggtctcaaactcctgacctcgtgatctgcctgcccaggcctcccaaagtgttgagattacaggcatgagccaccgtgcccggccacaggtgaatttctaaatgcatttaataattgatttctagacaaaacagttaaaaagtattagagtatctgtagccagttagttttaaatattatttgatttatttaagtggcatatatgtcttcaaatgtatctcattactattatgataaaacataataactcataaaatacatattgatttcataaatatagtacactatttttatttaaaggttaaccccctggaaaatattttgacacattttctatgatcattgttcgttttatatgggagtaaagaagccactgggattgtaaaataacctgatttattctgagtcagagtttatgcacaagttattgtctctcttttgaaattattacaagcttctgaggctagtccgaattcaatggtgtttacaacgaattgctcacaattacacatttgtttattttccactcctgctgcttcacttgactagcctcaaaaaatatgtatatgtatatgtatatgtacataaaagcttctgagatggactgacctttctgtttttctggtttttaaactaggcctttattgtaacatttgaatttagatgtaataaaacttcagtaattcagaattcagattaatactagttggggatagccgagttgaattagtaaaaacttggaattagagagtattttcaaatctatgtatatattaggtttggagtttcaagacatttaaatatgtgcagtaatgcaaacttagcatctttctaagttttcatgtataatgagtattttaaattagaattatagttgagtaacagtaatacatttcccattttctaagttcttaagtatatcatcttgtatttctttgcatttcagttatcctcttattcttctatgtctttcctgcctctttacctttcaccttataaatatgctcaaacctctgttatagggaagaaaaagtagtatcttttccctactcgttgcaagaatgatagctgacaccccataacaaaagatggattaacaagagaaaagcataaaaatttactcaagtttttatgtgacacaggatccttcagaaatgaagacccaaagacccagggaaaaccgtatgttcatgctaagtctgatgaaagaaatgaatagttgtggagacacgtgattgaacaaaaaagggtatgatctaatggtaacaaactgggcctgtttgttgagaatcttttctgtgtctctctatgacattccttctccttcggtatgctgcaggaaacctgtcacatgcatcttaaagggagaagggaggaggtcagagagtgacctttctagattgtatggcttgctttgtgagacggggaattctagtttctattacctgccttagggagaggaaggggggcgaagaaaggggggcctggagaaggtcagagagtgaccttgaaggtgccatatcttggggtagtattttctgagccctgacactaccattatccctgactgcccttttagctgttgccttatctctttgctctcttttagggctaaactttcttttttttttctcttgagacggagcctcgctgtgtcacccaggctggggtgcaatggcgtgatctcagctcactgcaacctctgcctgccgggttcaagtgattctcctgcctcagcctcccgagtagctgggattataggcaccctccaccacacccggctgatttttgtatttttagtagagaaggggtttcactttgttggctaggctggtcttgaactcctgaccatggccagggccaaactttctatttctagttctccagtttctgatcattccttaacccactgcaatctggcgttcgcttccatttctccattgaaatagcccctcgctagattttaacatgcacctactaatggcaaaatccagtgtagcatttgacaatgatgaccacatcttccttcttgatactcctgtcttggtttctatctcatttttcttccctgttatcattttgatgtccttctctaacttttcttctgcttgctcttagggtctgatcctcattttattactctaaaaagctctctctggagtgttaatgactctagatgtttcttatattctgctgtgtctaaatttacatcctataactttttttctgttccctaaatctgtgtttctaattgtttggatgccctcattcccatcacctaattggttatcagccctaatatatgcatcgtttctgcaattcatgtctatctctattgcccttgccctttttggaaccctcatactttcttgcccaggcaattgtgataactgattaatggtcctcctttctcagccgttggataattctctggctttaaatttctttattctagtgttcagtagcaccataggttgactatagttaataataatttattatatattttaaaatagctagaagaaaagattgataatgttcccagcacaaagaaatgataaatgtctttgaggtgattaccctgatttgatgattacacattgtatgcatgtatcacaatatcacaagtacctgataaatatgtacaattatgtatcaataaaaaataattatcagacaatgtgagaaaatgcccttaaataaaactgtaaatctgtaaattttctcttaaatctgtaaaactgtaaatcatccaaaaaacttcttactggcttcccattaccaataagataaagtttggatttgttaaaatcttcgtggaccattccttctttccttttctatatttcattacctgccaaaattcactttcctcactagcctcattaaactgctctttgttttctacacaggctgtgctttcttagttctttttgcttttcttcttctgagaatgcccattagcccttttatctctggcaaattcctattaattagtgtttagaaatgggagtatagttgtccctctgtatctgcaggttccacatgcattcagccaaccttgattgaaaatatgtggggaaaaaaggcaaaaaaaaaaggtaaaaataatacaaataaaaaatatagtgtaacaactgtttagatatcatttacattgtattcagtattataagtaatctggagatgatttaaactatacaggaagatgtgagtagcttatatgcaaatactgtgccattttatgtaagggaagggacttgaatatctgtgaattttggcatgggtgaggcgggggtaggggtcttggaaccaatcccttgcagatatcaagagatgattttatggcacagtgcctgggcttatagaatcaaaccacttgtgttccagtccttacttggatacctattaactatgtgactttgtcaagtcatgtaaccttaattaagtttgttttttaaaactttataaatgagtgtaacagtacaggcatacttaagagatattgtgggtttgattccagacaatgccattaaagcaaatatctattcaataaagcaagtcacatgaatatatatcaataaagcaagtcacatgaatattttttggtttcccagtgcataaaagttatgtttacattgttctataatctaagtgtgtaatagtattatgtatgaaaaaatgatataccttaattaaaaatactttattgctaaaaattactcacaattatctgagccttcagtgagtcataatctttttactggtggggggtcttgtgtagatgttgatggtggttgctgaaaattgggtgaatatggcaatttctagtttgccacatcaatggactttcctttcacaacagatttctctgtagcatgcgatgctgttagatagcattttacgtacggtagaacttctttcagaattggagtcaatcctctaaaaccctgccactgctttatcaaataagggtatgtcacattgtaaatcatttgttgtcatttcaacagtgttcacagcttcttcaccaggagtaaattctaccttaaaaatccctaccttttttgcacatccattaaaagcaactccttatttgttaaagttttatcatgagattacagtaattgagtcacaactttaagctctacttctaggccaggcgtggcagctcatgcctgtaatcctagcactttgggaggctgaggtaggtggatcccttgagctcaggagtttgagaccagcttgggccaatggcaaaaccccgtctctacaaaaaatacaaaaaaattagctggtcacggtggcacatgcctgtagtcccctctacttggtcgggggtggctgaggccagaggattcttagagcccaggaggtcaaggctgcagtgagccaagatcacgacactgcactccagccaggtgacaaagtgagaccctgtctcaaaaaaaaaaaaaaaaaagaaagaaaagaaaaggaaataaaaactctacttttagttctcctgctgtttccaccacatctacagttatttcctccactgatgtcttgagcccttcaaaatcgtccatgacgatcagaatgaatttcttccaaactctcgttaatgttgacattttgacctcctctcatgaattataaatgttcttaatggcatctagaatgatgaatcatttgcagaggttttcaatttgctttgcccaggcccatcagaagaatcactatctatggccccaatagctttatgatatgttattacttagtaagacttgaaagttgatattactccttgatccatgcactgcagaatggatgttgtgcatgaaaacattgatgtctttgaacgtcttcatcagaactcttggttgactagactcattgtaaatgagcagtaatattatgaaaggaatctttttttctgagctcgatagtgggcttaacatattcagtaaagcatgctgtaaacagatgtgctgtcatccaggctttgcaggtctatttataaagcacaggcagaatagatttagcataattcttaagggacctaggagttttggaatcgttaaataaacattggcttcaatttagagtcagcagctgcattagcccctaacaagagtcagcctgttctttgaagctttgaagcaggcattgacttctctctatctacagcagtccaatagaaggctattttgtctacatagaaaatttgttgtttagcgtagtcaccttcatcaattgtcttagctagctagatcttctctataacttgcttcagcttctacatcagcacttgctacttcgccttgcacttttgttacgcagtcagcttctttccttcaatcttatgaaccaaccaacctctacagcttccagcttttcttctgcagcttcctcaccttgacttcataggattgaagagagggccttgctctggactaggctttgtcttaagggaatgttgtggttggtttgctattctatccagaccactcaaactttgtccatatcagcaataaggctgtttcactttcttatttttggtgtgttcactggaatgagtagcacttttacttttcttcaacacttattttgcattcacagcttggttaattggagcaagaggcctagcttcaccctatctctgctttctacatgtcttcctcactaagcttaatcatttcaagctttttatttaaagggaaagacatactatttcttttcacttgaacacttaaagaggccattgtgggattattagttggcctaattacaatattattgtgtgtcagggaataggagatagggaacaactggttagtggagcagtcagaacacatgcaacattgatcgattaagttcgctttcttatatgggcgtcgtttgagtcacccctcaaaaattacaatagtaacatcaaagatcaatatcacagatcaccataacagacatgataataatgaaaaagtttgaaatattgtgagaattctcaaaatttgacggacatgaagtgagtacgtgctattggaaaaatgacaccaatagacttgcttgatacagggttgccacaaactttttctgcacattttgaaactttgtatttgcacatttaaaaaattgtgtatcccgataaataaaatcactggaacaaaaaaactgatactctgattaaactgaattttatagcttgcaggacaccttgggccagcttggttttactctagctttcactgtcattccaccctgcttcttccttcaccaacattcaaattcttttccttatctgccagccaggcagatcggagaggcaagagcggtcttcattttcagtagctcttgattctttgatgtgagaggagcagcacagtcgtttaaacttgatccaacctctttgcatcttgcaaagtcaatcagccaaaagaagtaaaatatgaaggcaatgcttgtgcaatgtacagttcgttttcatgatgtatacctcattatgatttgtctgcttgcttctcctgtttggtcatttctttggaaggcagtggatttttttcttgtgttttttgtcttcttcaattttgacttaccaaatttctcaatcccagccatatcgggtttgttggatgtggttgccaaggaagtggagtaaggcgtttgagcaagcagaatctggtctgctcataactattaaattatttaataataaaagtacttagaattacacttgccacagagtaaccacttagtaaatattagcatattcactcaagtatcactgtttcattgacatagattaaaaccaaaaataagtgacttcagtgattgtcttgcctgataaataggattttttcacacgtgccaatttcattcagtggctctctggcacactgggttgaaggcatattgagattctgtgtgagatcacctggaaagaacatgctgctagattagtgatagttgccataggagagacagtggaggaagaatacgttttgtatttattatccctaatatagctcacttcccagtttttggctgagatatcaggttggttatctatttttccaagggttgtggttgagatatcaggttggttatctatttttccaagggttatggaagataatgctgcgtatgtaaaggggaccattaaatagaccaatggaacagaacagagccctcagaaataataccacacatcgacaaccatctgatctttgacaaacctgacaaaaacaagaaatggggaaaggattccctatttaataaatggtgctgggaaaactagctagccatatgtagaaagctgaaactggatctcttccttacaccttatacaaaaattaattcaagatggactaaagacttaaatgttagacctaaaactgtaaaaaccctagaagaaaacctaggcagtacctttcaggacataggcatgggcaaggacttcatgactaaaacaccaaaagcaatggcaacgaaagccaaaattgacaaatgggatctaattaaagagcttctgcacagccaaaaaaactaccgtcagagtgaacaggctacctacagaatgggagaaaatttttacaatctacccacctgacagagggctaatatccagaatctacaaagaactcagacaaatttacaagcaaaaatcaaacaaccccatcaaatagtgggcaaagcagatgaacagacacttctcaaaacagacacatgaaaaaatgctcatcatcactagccatcagagaaatgcaaatcaaagccacaatgagataccatctcacaccagttagaatggcgatcattaaaaagtcaggaaacaacaggtgctggagaggatgtggagaaataggaacacttttacactgttggtgggactgtaaactagttcaaccgttgtggaagacagtgtggcgattcctcgaggttctagaactagaaataccatttgacccagccatcccattactgggtatatacccaaaggattataaatcatgctgctataaagacacatgtacacatatgtttattgcagcactattcacaatagcaaagacttggaaccaacccaaatgcccaacaatgatagactggattaagaaaatgtggcacatatattccatggaatactctgcagccataaaaaaggatgagttcatgtcctttgtagggacatggatgaagctggaaaccatcattctgagcaaactgtcgcaaggacagaaaaccaaacaccgcatgttctcagtcgtaggtgggaattgaacaatgagaacacttggacacagggtggggaacatcacacactagggcctgtcatggtgtggagggggggggagggattgcattaggagatatacctaatgtaaatgacgagttaatgggtgcagcacaccaacatggcacatgtatacatatgtaacctgcacgttgtacacaagtaccctagaacttaaaatataataaaaaaaattgaccacaaatataactatatacaaatgtaaaaataataataatttaaaaaaatttacaaaaaagaaccttgaatgccaggcatagaaatttggacataatctgaaagttagtaggtgttacaacagggcagtcatgagttgtaaacggaaggttaatctgccactgatttgcaggatcatttgcagtgaagaggagtcagaagtaagaattccagtggttgtcatactgtattttcttgactctaagaagcattttttcacatataagcatggttcttatgtagtagggttgttaagaagattaaatgggttaatacatgtaagacatttaaatcagtgcctggcatatagcaagcactagtacaagtgttagctgtcatcattattacagttattgaacaatcaatatatacatttaatgtagtgttttttaacatgaaagcagtaggtttcttaataatgaatgacatcttagaatggtgagattatagaccaggtgtaagataatgagggcctggaaaagggtggtagttgtgagaattccaaagaagtaagtctgagagagattaaaaaaagaatcgacttgatgacatattggatatagtgaattaagaaaaaggaaaattctaagacaaccctcagattgcacacctgaatgaatgggaaatagcttggcttaagaaagaaatgttacttgatctgtataaagtacttataacaatgccttgcacatggaaagcattatttttgttagttattagtagtaggactatttacacctgttatatacttaaatttgttatcaggtaatgtaataaagctaccaaaatatgaaagaaccttgtacataatttactagtagagaatttatatgttcaagggaaaataaattatgtgttttaaatatttttcagtataaatcaatgaggaagagttcaagtggcaatgaaaatgatgaggtgagaaaagataatattaataattatttgaaatgtttacttatcatatgaagttggctcagtgagagtaaaatgtaatccatttttcagtttctttgttattgatttaatgcatggttttttttcaacaataaaaacatatgagcatcatcatacaattattaatttaatcatttaatttccatatgtcctttagaatggaattactaataattcagttttagaattttatcatcattcgtcttagacctgtcatatgtgagtgtgtgttgtctttcacatcttttatctttctaaatcagcctggtcgtcaattgagattttttttaggaactttgtttaggaactccttccacaaattctgcatgctattttaaaatttaaaattcgacttctacagtttgtgcattaccataaacctttctactgcacagtgtaaactatgcagcagcctatcattgttgaaaagatatattctcattaccataaatacttaagttttgtgtatttttgttggagagattggtatttaatttgatgttgggtacttggcagggcttctgaaaatgtcttcagttttaggaaatagaatcacacagggaaaaataatgaatagagccagatgattggtcgtctgccagctcagatgccgatttctctccattggcctctccagtagtatttactgggatgaataaaagtcagttatggctatagctggtcatattttcactgttagtatttatatttaagcctaaattacatgttttgtatgggtatgcttggcaatatttacccatgcatcagcacaatcagttcctgtacacctgcccaagctttccattgcaccaactccacaagatcccagcctaccctttaaatattattcccagggaatggcctactgtgtggtctctagcatgtcttcaccagctgtcaagccttcagtgaataacacctgtgtacctgctgaagcctctcagatttgtctgtagtccagacctctcccctgaggttcaagcccttgcaatattttatccatcttcctacctgcttagaatttctgctggatatatctcataaacccaataggactaaatatgttcaaaactgagtttttaaaaagtttttgcttctaaacccactttttcgctaatatccgacagtttgtgtagtggctctcaactttggctgtacactaaaattaccaggtgagctttagacaatactgtcgcctgggtcacaccccctagatattataatttaattgacatgtggtatgttgtggtatggactgagcaatgaagtttttaacgtttcccatgtgagtttaatgtccagccaaggttgagaactactgagttaatggaatcaccttccatcatctagctggagcaggggctggcaaattatgatccaggggccaaatttgacatgctgtatgggattgtaagtaaagctgtatcagaaaacagccatactcatttgcctatggctactttttcattactgtggcagtgtttgagtatagtagctctccttttttctccatttcactttccaaggtttcagttacctgtggtcaaccacagtctaaaaataggtgagtacagtacaataagacacttagagagagaccacatttacataacttttattacaatacattgttataattgttctattttattattagttattgatgttaatctcatacctgatttataaattaaactttatcataggtatgtatgtataggaaaaaacatagcacatatattataaagggtctggtactatctgtggtttcaggcattcactggggttcttggaacatattcctcatgaattgggggacagttagttgtcacaaagcctaaaatatttgtcatctgcctttgacagaaaacattttcttatccctgcctcctcataccctcttttctcttgcctgcctcaatatctaatcagcagccaagacttactgtttgtttatttgcactaaaatattttgcatacattccccttttatttctactgtttctgctccggcagaggccctcgtccatttcttgcctgttctactgcaataacttccttgcacttctccctttctctagtccattctcactgcagccagagtggtcgtttcaaagaacacagatgcaatcaggccattcccttgcttggaaaccttcagtttccccccataacttagaagataaattctagatcctcctttatcaagcccttgcttgccacatcagccttaattcacaacttgctcttctttcaccttaccctccattcaccttaccctccaacaagacaaaactgctcagaggttttctgcactcatctttacatttgttgcttccatgctttggttcttctcctctcatcttagcatgttgttcccttctttctttttctggtagacactcagttttttactgaatttatactttctcaggaaacttgcctttctctaccatcttcatcatcccccccaagtgccccttatctgtgcctcataatatgccatgcattgttctgtattatactgagaatgttgtattacctgtatacattaatctatttctgtcctcgactgaaaggtccttgaatgggtgatattttactaaatttcagtactctcactgtctagcatagtgtctgacatatagtaggtagccaataatcatttgttgaatgaatacattttctatgtagtgtgcatattcaaagttaaatgtcaaaattttcatatttggttggcagtagaatagtcatttaaaaatcatggaccatttaatgttttattaaattaaattctttgtaattatcaataagcctatattagatacatgtaaattttcagatgaaagttatttggggtgatggagattttgcatgccttcatttacatgtctcagattggtaacacgtccctgctattatatgtagatagtatttttcaaactttactatatttcgaaccacttgagggtcttactgaaatgtagattctgattagttaggtctcgggtgaggcctgagattctgcatttctaaactcccagaggatccctatgctgctggtttacagaccacatgtagagtggcaatgtgctggatggcatatctttagtaggtcttcctttagtagttggtcagaacaatttttattttccttttatatgtttaaatcatcatttgtattgtaatttcatcttccatctttttatttttatgttttagcaagacagtgataatgctaatatgtcaacacaatctccagtatcatctgaggtacaagttctgtttttatttgtcttaaaaatacgttttgtatgttttctgtgttttacataagagtcttccttgccagttctctgtaacctgattttttttgcaatataatttattcactcatattttaaaatccgtggcagattagtttgtacaaaccttctagcctataaaaaattctaagaatgccattttttggtaaaaatattgatactagcacttgtttatttatgattttctgtagtgtctgtagtgtctgtagtgatttttggaagtgtctgtagattgcagaaaagaattcactttatcaaatctatgctttctcattcatccgtattttaaaataaatgatagattttaagaacaactttcaaattttaaatttgaaaaaagtacttcagcattgtgcaatggcctttggtttttcttgtaaccagttaggtctgaaaccaatgcaaaagaaatttcctttttccacgagaaacatccctgcagtgggttgttcctatcgacaggaggttacacgtttttgggagaatgggtatcagaaagttagagtttgtgaaatctcgatcaaatactctggtggcttgaatgactgattcttctaatttatttattcaagtctattgctttacaacaagagataaatttaaaaaattctaaactctatctcttctacttaagattaccttaaagtgtattggcattagtaagtaaatgattacacattcatttgatgaattcaacactttgctcaaagtgttggatggcccaaattcactgtgtaactttggttacatagatgctgctaatatttcattatatgtaggtggtgttgcttttttaataggctaggattctttgttgttgtgggtgatctgcattacaaaacttttgaatggatttggacattaattttataaacatgtttctaaattattcatatgataggtaaaatggtatacacacttttagaaaacaatttaaattaggatatcttaaaattagtctttgtcatatgcttttgtaattcttttactttaagttacaagtataagcatataagtgactactacttatttgtctgcttgatatatgattttatgatctgtgttcacagggaagactattcataccaaatttcccaaataatttacattgatatatatatacgtatatatatacgtgtatatatatatgtatatatatgtatatatatacatatatatatacgtatatatatgtgtatatatatatgtgtgtgtgtatatatatatatatatatatatatatatatatatatatatatatatatatatatatatatatatatatatatatatatatatatatatatatatatatatatatatatatatatatatatatatatatatatatatatatatatatatatatatatatatatatatgacacatgatctcactctgttgcctaggctggagtgcagtggcacgatctcaggtcactgcaacctccacctcccacattcaagcgattcttgtgcctcagcctcccgagtaggtaggactacaggcacatgccaccacacctggctaatttttgtatttttagtagagacagggtttcaccatgttgatcaggctggtcttgaactcctggcctcaagtgatctacctgccttggcctcccaaaatgttgagattacaggtgtgagttttgtaatatattttttatttcatttggatcagtgaaattttcatctaggaattcatattaatttaaccaaaatagtgaagacaaactgggaggcttgtagatttggatagggtggtgagtatgtatgtgctttggtaactcaactgacatttaacctgaactgcatatcacgtgttaacagaagatttaggtaatctacagaattctgattacattaatttcatgtgtgaatggaaaagagtaaaactaattggtgtaatgctttagtattaacaaagtgcttgcctgtatatttgtacctaaaagcagccccataaaataggtatgatcctcatcattttacagctgaagagatgggtaactttccaaactatcttagttaataaatggcagagaagtgactgaagctgagccctactcacttcacagagttgttgcacagattaaataaggtgctgctaagattacattattttatcatcatttagttatctcatttaatcttcacagtaacctcatttgaaagatgaagaaacaatcacagagaaattatatgttgtgctcaaaacatagcctaagctttctaactccatcttcagatttgtttaatgtactacaaatctttccatagcaaaccactgtgtgtgaaagatttgaaaaaatattcattcaaatagaagagatgatatttatcatctatcattctgcagtccctatacaaatatgtttgccttcagattatctactgttaggtgttaagtccatagtagatgctgagtaaatgctaaattcacttaccttttcattgaagcttacttctttttttcggaaacttcagtctgattctttcaaaaagtatgatctattttatacagttcactaatgattttcattttctttctactatgaaagtatttaaagcctatatggttagctcaactagcaaatattagttgacctcttaaaagtgacatgtatcaacttgaattgaaatgcaagttacttttctcttcactaatcataggaaaataagtatttccccaaattggaatggatgtgaataagcaccttgattattttgaaagaaaagaagttttattatttatttatttttaactttttaatttttttttaggaatatgacagaactgatggtttttcacacagtccctttggcttgaagcctagatcaggtaaatagatattctgtaaataaaatttattagttatatatgaaactagtttcccagcttaaatgggattgattccatagtcttaagtacacatagattctttcccctctcctaaaagcaattttctcttaacgatatttgtctttccaattcccattcccatttctttcttcctctttaccttcaagctcctgaaacctcagctttttgccttagatatactgcagtcttatttctactctactgtgactgctgttagaatgaccactctgccagcagaccaaacactgtttgaaattatagcactccattatattgtggttttataaagggatcttttcgcatttggcaagcccaaaagaaaatggatccatgttacttgtcaaggtattgaactatagtttttattcctgaataactgtattgaccttcaagaataatttccttttttaaaagataaaaggctgacatatgttcagtaatcatttttaacctgggccataagtttctaataacgtatgtttgaataagaacatgtataggtggtagaaatcattacacttatcttccctgttgctttcaattatgcacataaatagagttcaaatatattctctaaaaatatttggaatgtattagtgagtaataatattttatgtaattttgtattgattcatcatgcctctttccccatcaatagttgctccttcccattaactttgtaacaagttaggaaatttctgtttttatagcttttagccgctcatctcgccaagaatatggggcagcagatccaggatttacaatgagaagaaagatggaacatttacgggaagagcgagagcaaatacgacaacttcgcaacgtaagtcagattgctctttcagatctgctttgtggaaatgggtttaacttggaaaattaataaggcgtacagatttcattttcaatgctccttaaaatgtttggatatacaacaattagtaatataaacatttaacatgtatgtttagatagagtatctgatttatacctgtttttctatagaatcttgaatccaggttaaaagtaattttgcctgatgacattggagctgcactgatggatggggttgttctttgccatttagccaatcatataaggccacgttctgttgctagtattcatgtaccatcaccagcagtggtaagttttgtttacaatttgttagttctctaaaggaagatatagcttcttaaaattgtctttaaataatatacctcagtgaacttagttttcagttttgattaagttccatagaaaaatgcctaaaagtacattttttccctcttactttacagcccaaactgagcatggcaaaatgtcgaagaaatgtagaaaattttcttgatgcttgtaaaaagttgggtgtctcacaggtaattgttatttatctaacaacgtgatcacttaaatttgaatttattacatgcaaactggggttcttcttagagcaatgaataatgctttctgaacatgaaaatgaatgccttctcttggtaccttctcctaagctccagctttcactgtagcagttatctaatgaatgtttttaagctacctttaaagtaatttataaaatagctacaaatatggaaaatcatgcacatcactgaccaaacataactcggtggccatatttacaacttggttgtgatgtcattgttaccatctttttttccttcttttttttttttttttgctagagaacatttggaccccattgtaattcactggatagattctgattggaagatttgcattcagtgtgaatagctttttaaactttatttaaaatgcaaaattggaaattataccagcatattatgataatacctgtattggacaaactttgaaatttttaggaattgtcttatgtttcatgtaataattgcactactatacaataatcattaaagcagtattgtaaatatgtaaggaagatatataatcacaatattgcttctttgtaaagtgttataaacctaacctcaacatgaatgactatggagagaaatgacattgttatcagagcacaattaagttgtgcttgttaagctgtcttttgaacagtgtcttaataatctggtctacagatcccactttaatctcttccctcaagtaagtaaacataatttaatgtgtagagaatctgaattgttgggtaatttggaaattacataatgttctctaattacctcttgtatatagttgatgtgatggttttgtttttgtttttgcttttgtttttttgagacagagtctcacgctgtcgcccaggctggagtagtgcagtggcacgatctcgtctcactgcaaccgccgcctcccagttcaagcaattttcctgcctcagcctcccaagtagctgggactacaggcacatgccactacacccagataattttttatttttaatagagacggagtttcaccatgttggccaggctggtcttgaactcctgacctcaagtgatccacccgcctcagcctcccaaagtgctgggattacaggcacaagccactgtgcttggctgatgtgatgttttaaatttttaattcttaaaaatgtttgttgtttcttttttctactctcaatctttcagtggggaaatagcaaacttagcaacgttttctgcagccattacattatacagattttcccgttttgccattttttcttttttaaaattaaaaaaacccctttatttatttatttatttatttatttattattatactttaagttttagggcacatgtgcacaatgtgcaggttagttacatatgtatacatgtgccatgctggtgcgctgcacccactaactcgtcatctagcattaggtatatctcccaatgctatccctcccgcctccccccaccccacaacagaccccagagtgggatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggcgtatatgtgccacattttcttagtccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgaacattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagttgaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattaatttttttataaggtgtaaggaagggatccagtttcagctttctacatatggctagctagttttcccagcaccatttattaaatagggaatcctttccccatttcttgtttttctcaggtctgtcaaagatcagacagttgtaggtatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcaggttaaggagattttgggctgagacaatggggttttctagatatacaatcatgtggtctgcaaacagggacaatttgacttcctcttttcctaattgaataccctttatttccttctcctgcctaattgccctggccagaacttccaacactatgttgaataggagtggtgacagagggcatccctgtcttgtgccagttttcaaagggaatgcttccagtttttgcccattcattataatattggctgtgggtttgtcatagatagctcttattattttgagatacgtcccatcaatacctaatttattgagagtttttagcatgaagggttgttgaattttgtcaaagttcttttctgcatctattgcgataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctgaaattctcttttttggttgtgtctctgctcggctttggtatcaggatgatgctggcctcatcaaatgagttagggaggattccctctttttctattgattggaataatttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagggtgtatgtgtagaggaatttatccatttcttctagattttctagtttatttgcgtagaggtgtttgtagtattctctggtggtagttcgtttttctgtgggatcagtggtgatgtcccctttatcattttttattgtgtctatttgattcttctctctttttttctttattagtcttgctagcggtttatcaattttgttgatcctttcaaaaaaccagctcctggattcattaattttttgaagggttaaaaaaaaccctttttttagagatggagtctgactgtgttgcccaggctggactggaactcctgagctctagacttccatttcacaaataactgggattacaagcattcactacctcactaatattatgtcatttttgttttaagggttttatttttagcttcattgcttttctctgaactcagaattggtaatatataataatttttaaattaattttctttgttttaggatgttttccaatttttaacagccttattgagttattaacatacaatatagggcatataaataaagtgtacaatttgatcaattttgacatatgcatacaccatgaaatcatcaccacagtcaaaataatgaacatatctactgccccccaaaatttcctcatgtgtctttgcaatccttctttctccagcaaccactaatctgctttctgtcattgcagattagtttgcactttctagagttttatataaatggaatgatacaatatgtattatatttttctatcttctttcactcagcataattattttatgactcgtcagtgttgttgcatgtatgaatagaccattgctgttcatttctggatagtattttattgtatggatataccacagtttgttaatcccttgacctgctgatggacatttgggttgtttccagttttagcggctgctacaaataaagctgctatgaacatttgtatacaagtctttgtatggatttatacattctttaatttttagtaaatacctagcagtggaataactggaacatatggaagtgcatacttaacattttaagaaactacataactcttccaaagtggttgtactgttttacattcctgtcagcagtatgtgagagttccagttcctccacatcctcactaacattcagtatgatcaatcttctaaaaattttagtcattgtgatatgtatgtactgacttgccagtgcagttttaatttgcattttcctaaagactaatgatgccgatcatcttttcaaggcttatttgccacctgtatatcttctttttgaagtactttgaagtatactttcttttttgaagtacatattctaatctgaggtatattttgtattgggttgtttattttcctatgattgaatttcagatttctttacaagttatggataaagacatttaccagatttataaatattgcatccaaatctttggcttgtcctttcattgtccttagagtgtctttcaaggagcaggatcttcacttattgaagtacaatttattttttaaaatgggctgtgctttttgtgtcaaacctaggaaatcttcgtataatccaaggccacaaagatttctttcctatgtttacttctggaaattttataatcttaggttttgtgttcatgtctatgatcaattttgagttagtttttgtatgtggttaaaaagtatggattgaagttctctttttttaagcctgagattgggcatatacattgatttttttaagaaaatatttttattgagatataattacaatgccatagcattcactgatttaaagtgtacaattaaatggtttttagcataatcacagagttcagcaacagttaacaacaatctgtttaaaatattttcgtcaccccagaaacacagcccttgcccattcgcagtccttcctctgttctttctatggatttgcctactctagacatgacatataatgaaatcatacaatatgtggtctttagtgtctggcttctttgacttagtataatttttccaaggttcatccatttgtagcctaaatcagtacttcatttctttttatggctgaatagtgttctgttctaaatacataccacatgttgtttatccattcatcagttgatagacatttggattgttatcactcattgtttattatgaataatgttgctttgaacatccgtgaataagtttttctttgaacacttgttttcagttctcttggttatacctagcagtgaaattgttaggttatatggtaactctatgtttatattttttaagaaactgacaaaatatgttgcaaagtggctgcactatttttacatttccaccagcaatatatgagggttctaatttcttcacatcatcaccaacaatggctactactgtctacctttttggttgtagctattttagtgtgtatgtgatgtgatatcttattgcggttttgatttgcgtttccctagtagttaatgatgttgagcatcttttcttgtgcttattgatttgtatatgttctttggagtaatgtctattgaaaccctgtgttcatttctgagttagattatttatcttttttttttgagttgtagttccttatgtattctggatacaaattgcctaagagatacatgatttgcaaatattttctcccattctgcaggttgtcttttcactttcttgatggtatcatttacagcacaaaagttactaatttgatgaagtgtagtttatcccattttttcttctgctgcttatgattttgatatcatatctaagaaaacattgtgtaattcagggtcacaaagatttacacctgtgttttcttctaaaagttttatagttttagggcttacctttttgtctgtgatccattttgagatcagttttgtgcatggtatgaggtacggatccaaattcattctttcacatgtggatatccaattttcccagcaccatttgttgataagactcttcttttccccattgaattgtctgtcttagcacctttgtcaaaaatcaggtgaccataaatataaggctttatttctggattctcagttttttttaccactaaattccttattccagtatcacactgtcttgcttactgtaattttgtgatgcattttgaaatcaagaagtgtgagtcttccacatttgttctgtatcaaggttgttttggctatactgagtcccttgcatttccatatcaattttaggattgattagcttgtcaatttctgcaaaaaagccacttgggattttgctgggattaccgaatctaaaatgatttggggaatattgtcatcttcacaatgtttattcctgtgatccattaacatgagacatctttccatttatttatatcttttaatttttattccaacagtgttttgtagttttcagtgtatgagtctttcattagatttgttaaattaaatgcttagtattttattctctttggtactattataaatataattatttctttaattccactgtcaattttttattgctacttcatagaaatagaagtgattttcttttattgatcttgtattctgcaaccttgcagaactcatttattagttctataatagtttttttgtgtgtgtttctgtgccttaggagtttctctttacagaatcatttaattattctttcaaagaattcatccatttcatctaacttgtcaaactattattatgaagttatttataatgtctccttattatcattttggtatttgtagaatatcttgtggtgtcacttcccttatttatgatattggtaatttgtgtattctctctttccttcctgattagcctagcttgaggtttatgaatttttaaaaatcttctaaatgaactaactttgggttgcattgattttttttatctattgttttttgtttttttactttattgttttcctctctcattctcattatttgcaccattcttttgccattggtttaatttgctcttctttttttagtttctagggtggaagctgaagtcattgatttgaagccttccttcttttctagcatacacttcagtggttatttgaataaataagcaaaatattaagagggcaacaaatatagcagtgaagatggagatgaggcaataattttgagaactctttatgggataccatcattagtatttggagaatgggttatgggagtaaggaagaaagaggaagactattatatttcacaggtttgtcaatggagattgaatagtgtattactaagacatggatcgcagaagggcaaattaatttggtaaagtagttctgttgtggacacattgattttgatatgtctgttagatgtccatttggctgtgtccagttgatattgtatttggagatcaatagagagatcttgggaggaaataaaaacttggaagccatcggtatggaaggggtagttaaaactagaaatagatgagaataccaaaagagagggtatagtgtaaaagagaagagagtgaagacagaacccttggaaacatttggaatgttggaagaggatcggtgagggctaattaatgaaagctactgcacaattgctgtcagaaaagttgaagtagaaaagaatggtgtcacacaagacaggggaggagtaaggttcccagaaaggcattaatcaaaggcataatatgactgagcagtcaactagacatgtgcaacatttgacatttaagatggcattggtgatttttactaaaatagttttagtgggcatatgctttagggttagatgtaagatagcagtggttgagtagtgagtgggaaatccaaaagtggtgaccaactcttttataaacattttctttgtagagaaagaggtacaagtgtggaatgacagcatttcaaacaaggccgacttctataatcttttttcttagtataaattaagaatctaaaaacattttagattacaatatttataagagaaaacttagaattatgtagttttcttgacattttatagaaatcatgtttttaaaatcaaattctgacttaattttattacacttctaaaaaatgaatgttcaaatatctcttttttttctccaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagttgaaa

SEQ ID NO: 3640 - DNA, 123438 bp, human
gggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcaggtgacaggacggggggaggggaagctggctgtgaaggaggaggtgcggggagtgggtggctgcgtggctgcgttgttggactctgcgggtctgggcgggtgcgcggggaccgccagactaacaaagtcggggcagcccgttctcctgaacgtgaggggcgaatcaagcaataggggaggggaggaatgctgcctgaaggatgtatagaaactggtaggatgttaggggtgaaagagcatcattgttaaagcaagtttccccagtttgggtgggagggagtcattgacaccttccttaatgcacttctttcaactctcctggatcttcccgtctttcccggaaaaccaaacccaaccaaactaaacgaaacacaaaaatcataatctctacatattccttaaaggcatacgtgcctgaaagaatggcatatcctttttcagagtacagcagcaggattgccatggtttttctgtgtggtttaatcatcctacgatattcttggcttctttcttgtcacgtatgcctttaaagactgagatttttcattttcctggtgttgagaaggtagtggtggttaaattagtatttgctgcagtggtaaattaaatcatcaatcacttacatgtctgcttactagaagaaagctaatccttgttttgagttatcttagagtcttaatttttatagtagaaagccaacaattttaagggtatttttgagaaaaaattatctccattctttatggagttgtggattaaaggtttatcactttgggtgagaaattggctattgtaatgttcttcatatactctctggtagtctttgttgtggctggcattttttgttagggacacactctcttataaaccaatgctggattattttagatatgtcttgatttgatgaaaggtttttttttactttttataatctttaaatttgttatttatttctgttttcatctgctttgctgaaataaatctggacaaaattattttaatagatgtcgtcattttgaaacaatatagtaagtaaattcacccataatgaggagtagtaaaataccacttattttcaaaacaagacaatttcagatgtattcagtttttagatcttaaatcaaggtatttgtgttggaacaaagtggggagaggaggaaaacctaaaattgaagctttccacccagtgattcttttagcaatgatcctaagaactatgaatgtgtaatcgaccactgattttatattttgtaaagcatgttggagtatttactccttcactcagaacagatttcctaaataatatgttcacatattcatgactgttagcaagatattatgcaacttggtgtgttcttcaaaggcttcaagtaaaacagtttcagactgcatcattatagtgatttttttcttttcttcttcttcctcttttttttttttttcttattgttctttctaacctataaaggatccttctacctgcaggacaaagtttaagcatcctagcttggcattcaggactttcattgttgggctccactttattgttgcaaccttattccccaaaatgctcccacatagaatcctctcttccaactaggtcaactctctgtctctcaaatacattttgtgcatttctgcctcatctttgtacaagatcatctgtatgcttgggatttccctcttttctccgtctatttaattttattgaagccccagctcttccaagaaattgtctccaactcccttagtccacaagaatctcctgtttctttgaattcccatggtacttattgtctttaccacttacttggcagtgctggttttattttctttttatgtttctgtcttgctatccctgagaagaaatagagccccttaaaaggcagggtgtaagccatatacttgttcagtcttcttattatatatcccctttattgtatttgataatatttctcataaatatgaatatcatctgatgcagttacagcctttggcttttaagccttcagttggttttctgaggcaagcttcaacacaaagcagaaccatatctgttcatggtaaacattcattcatcataagtttcattttactttttctcttcagttgaatgagcatttcttgtgggaacatttcaaaaatcagagtaaacaagatcttgtgctgctcttttttttcatttaaattagatatctttgggtgactcatttgccatttgtttttgataaaatttagccacgaaatttttaggggcagtattttttaatgtagagagaccactattcattatgtgtaaatgacggcaggtacattggaactgaagaaaaatagagtgtgtttgagattatacatacatatgtacatacatacacacacatacatacaggaacacacatacagtatattctctatttgatgaaaatgatctgtttggtgatcttgttatacttaaaatgactcagtggaatactgtttcagaaccaaaccgattagttagacaagcattccttattgcattaggaagagacaagaggaagggaaaatagctaagaagcggttaatgttaatctaggtgagaggtggtgagaatctgggtgaaacaatattgaataaggagaaattaatacatttcaaaataaatgggggaaggtttttttacattaagatgaaatagacccctggttctccaccctggctgcacattacaattgcaagggagattttttgtttgttttttcaaccctgcctggatcccaccctagaccaattaaatcagaatctcaggggccaaggaacttaaggaaaaaaaatcttcccaggtaattctaatatgcactcagggctgagaaaccctaaaattgtttattttttaagcactcaagaaatatttgttctttgagtgaataagaacattgataaaagtttagttattaaccttaaagccacttgtcaagaaagtcaaaaccaaaactaggaactaaatactcaaaaattgtttcaaattgtttgataaatttacgtgaagaaaatgatgccccctaaacatgtagcagcaaaatcttttctctgctaacaggcttcctatgagggaaaatgtattttaggcagctgtttgcagagtttatctttggtgtctttttacctctctctgcatttctagtgtctgttcttcacttgcctcctccctttgtccccatcacacttttctcctttctctttctctcttcaacctcactcctcttactttattgggatagagctcaggtaaatgattatggcagcctctctaggagattaacatttaaaagggggagtttgctaatttacttgaatctccaattggtgattggagattcatgacctttttgagtagatctcccttccagatactccttgattaaaattttcacccacataaggacataaaacagtgatcagaaagttggtaacccatttcagtaaagtagctgactcttgctgtaatgtcttctccgagatggtctgtagatagatttgacaagatgaagggaaattgcatagaactttttggtccatctggatactatgataatttgttgacttgaaagtgaatttaattgttacccaaacaaatcctgaaaccttgcatagttgactctgtcaccagtgctacaaataagtggatatgtttcagcgtacttgctgctgctccctctgcttctttatacctgtttatgtacatgagcagtaggtctgtgaaacagatttaggaattcttacatcagattctgccgtgtcctggataatcacgtgttttcctgtaaaccaggagtcaactctagtatttcctacatgtgctggttcaccttttcaactgtagggcatggtgcattgtatcaggttgtaaaatggagccagataaacacagcatttgattttgtgaggtgaaggtcctctcagtgcatttagtggaatgagctcatgattgtgattttgtggccttattcaaatatctgccttgcttcatttaataaatgtcttcctgaaaaatcgaatgtgaagcacatttttgacagttgactcatattttaattgctatagattgaatctgaattactgaaccttgtactgatttattcagtgataagttctacagcatacttatcccttaatttctttcatttaaaataaaatgttatctttaattgaagggtacattcatcattaagataataccatttatacagctctttatacatttttaagtactttcatatatattatcctattgtatcctaataataaccctgtgagcttggcagagtacatagtaattgctcgttgtggttgagagacaggttaagtgatttgtccaaagttaaatggtgagtctggcagagtgtgtgggtcagagcctaggtttttcaactccagtgctatcctaatgttatttccagtgtaacacattctctctttataaaaaagcagttattaaacaccatgccaataaataggttatttattctgaaaattcaatgcttatttaacttcgtaggttatatactttttgtttgtggtatggtgtgttttgttttgtgtgtatttgcatagctatcatgcctctcttatggttttagaatagattcattaagcaagcatttattgaactcctactttggaaacatgattatggctaataaaaagagacatggtttttgtacttaaaggatttatacaatagtcaaatgtatacagtaatataacgattagaaaagaatttcactataatatataatagtattcaaaataatatattttaatatactgtacacataagagatctggaactgtggcataaggcttaattttagaggggattaatttagtttgagaaagcttcctgaaaagttaggttaggtatttgttgcatgacaggtataagaacagaagtggttgattgggatgttttaaaattggggttagtggaatacttttgcttaaggtttaaatttaatatttcaatttagattatttgtgatataaattctgaagcatttatttggcatgaaggtagacaagatccagaacctcactgagaacataagaagtaatgctagggacacttactacaaataaagataattgaagacttacaaaattgatttgctgggaggtgccatttgtttaagttcctaggcacacagtgaaactttgcaaaagaggcatcttgttctcccagcccagcctagcagcccactctgtgagatgccttaactgcatgatacacacctccccattctgcagaggctagtgatcatcatgacctagaaagggaaatattttagttttctttttttctctacactttgagtgtatttgggtgcttcttaaaacattgtaatactcttataatcagttatctggaaagtttcagaaagggttgtctgcttctcatttacagaaaaaaaaataccttacacgccagggaaccatttaatgtaattaaagaaaactgtataagccaatttaataacaatgtaagtttatgtttactctcactttcagctagtgcactcaatctgctaaaggtcaaactgtaatgtttaatctttacatttctcttgtttcatgtaaatagatagcattccattaacagaatacctgtcaatggactgtaatggataattcaacagtagatattttctaatgtattttttatatcaaattctttgaggaaaagttttttccaaataggaaagtaagttctttccttttcaggaacacttgattctgtgtagtcttttctaatttgtgacagagaatgttgtcactttatttttagattaattacttgtctcagtagaatattagagattcaaggtgacaagagacaggtataagataactgtgacataaacttttctttgaaccatatggagatgaactgattctagaacatttgtgaatttggatttcactcagaaatggctttttgttaatgattatgttcctaagagaatctagtatgtatagtctagagtttttcacttcttaaaaaaataattgcaatacgtaaatccttagtattttgagctacttggttggggatgtctatgtcaatgggaaataattacatttaaaggtttttgtgaattagaaatagtaaattaaacatagatgactgtgtccttaaactaccttaatgagtatgtaagaatggatttgtcatatagatattttgtaaaggttgtaaagttgctgctttcagtgagttaatgatttcataatggtttaaaataagaactcatatacctattatatcctagatcagtagttctcattgtggggaagggtagggttggagaggttgcctccagaggatatttgacagtatctggagacttttttttttttttttaagagacaaggccttgctatgttgccctggctatgttgcctgggctggaatatagtggctgttcacaggctctaactcgggggctcaagtgatcctcctgtctcagcctgctgagtagcttggactatagtcctgcagcaccacacctggctgaagacatttttgattatcacaatttgggggttgctactgacatctagtgggtagaggcaagggatgctgccaagcatcctacattgaaaaggacagccccatacaacaaagacttaacttgtctaaaatgtccatggtgccaaggttgagaaaccctgggttagagtaagataaatggaaagtgcagcataggttcaaagagggagggataacatttgatttggtcgtttgaacagcagaggggggctttataaagaagttggaggattggcctttagagaggaggcatcagattttatagttattcttagatggaggaaactacatgaatgctgatatctcagagtctcctcaaactcaatatgtcaaataatgaactctcgttattcaccctaggcccccttgtcacccagatctaaaacttgggagttattctccactcttccctttccctcagcctctatatctagtgagggactaaggcctgttggtcataactctttgaatagctttcagatcagtttcattcctttctattctcaatgtcattgttcagattctcctctattccttacctttaactggacctgtcagtagttttctaaatgatctctctgtctcaagttttcttcaacttaaattagttagtcctccacactgtagctaaaccattctttctaatatgcaaatctgattgtcatgtgttactaaaacaatgttactaaaacaccttcaagccagtagccagttttcaagccgtacgtttcaaaatcttatttccttattccttgttttgaacattaaaaaaagtaatacatacactatgttttatttaactgtggtaatttttatattttattagttaaaattaaattgctaagattcatccaaattgttatgtaaaactgtggttcattcttttggatggctgtgttatcttgcatcatgtgaatataccatctttattcactttctcactgatagccattttcattcccccctcctcctttttctcttgggaatagcactactatcattattatacatgtctcttgtacttgtgcaaggatttctcttgtgtatatacttgaaaatggaattgctgggttgtatagtatgtcagtgttcaaaccgatttatcatttctgtttccattgacatgtataggagatcctatgaatctatgtgccctccaaaacagtactgtcaaatttaaaaattttgaccaagtgtgtttaaaaaggtatttcgatgaagtctttcttgatttacattcccctgatcacgaatgatgttaacctttcttcagatgtctgttggtcatatgtctttcctgtactgtgaaatagcttttcatttattttgcccattttctgttggttggttgtccttttttaaaaaatagaattctatgggtttaaaaaaatactccttatactaatcatttgttttgtatattttgaatatcttgtttataacttgcctttttgctctttgaggggtgttttgatggacaaatttgtaaattttaatacagccaaatgtatcaatcttgaattttgtagtcaatgatttctgtgtcctgtttaagaatatgtaaaatatattcatctacattttttactaagagttttagttttgtttttggtattaaagttcttaattcatatggaatcgatttttatgtatagcacgaggtggagttccatgttcctgtttttacatatggattatcttttttcagatccatccttacctatgttggggctcagaaaacaatacccccaaatgaaggcctcagcagcagcctcagaagcagaagttttgcactgactttgtcctgccctcctgtctctctgtcccattctcctccaaggctagccgtagaaactagaatccctcttccccaaggaggatcacagaagccagaaccccttttcctgaaagccagccataagacctaaaaatattactctaatttcccctctgcctttctgtgtaaaaactggacacaaagaaatgatctaacctaccttgtttgactgtaggtcttaagacccccattccagagagggccctgccccacagtcagaaggaaggaatacaggctcagagaggcctagaagaatctatttaataggcagacaggccttgctaggtttccccactcagtctgtcagctttagaatatattctttttggccaatcatatttctgcacagctgggctgtccatactttgttgaacctaagcataaaataggcaattcctcctttgggtcttaattctgaaggctcccatatatatactttaagtaaacttgtatgccttttctgcttttaatcaatctgcctcatttcagtgatttttcagtgaaattgtgaaactttagggaccaagggccttggcttctgtatctacttcttttctccctttcttttttctttttttttttttttgacagagtctcgctgtattgccaaggctggagtacagtggcacaatcacggctcactgcagcctcaacctcccaggctcaagtgatcctcctacctcagcctcccgagtagctgggaccacaggggtgtgctaccatgcacagctaatttttgtatttttttgtagagacagggtttcatcatgttgcccaggctggtcttgaacttctggactcaggtgacccacctgccttggcctcccaaagtgctgggattacaggggtgagccactgcacctggcctacttcttttctttttaacattttattgagagttcacagaccaaaagtggaccaatttaaagtatattgttgattggttgttagctgtgcacccatcactataatttagttttggaatattttcatctccccctgaaagaaatcctgtacaaataaatccctttccattctccctgcctcctccccaaccaatcaaaccctaggcaaccattcatctattttctgtctctatagatttaccccatctgtacattttatgtaaatgacttaattcaggatgtgaccttttatgattggcttctttaacttactatgttttcaaagttcatttatgttgtagcatgtaccagtattatgagaattccaattttttttgcattctcagcagcagttgtttttatctttttgtttatagccatcctagtgggtatgaggcagtatttctttccttcttcttcttcttttttttttttcgagaccgagtttcgttcttgtcgcccaggctggagtgcagtgatgcaatctcggctcactgcaacctccgcctcctgggctcaagcgattctcctgcctcagcctcctgagtagctatgattacaggcgtgtgccaccatgcctggctaatttttgtatttttttttttttccagtagagacggggtttcaccatgttggccaggctggtcttgaactcctgatctcaggtgatccacctgcctcagcttcccagagtgttgggattacaagcgtgagccaccgtgcccagcgtgagtcaggatttcattgtggatttgatttgacttttcctcatgactaatgatgttgaacatcttttcatgtgcttattgactatttgtatattttcataagcaaaatgtctattaggaccctttgtccatttactaattggggtgtcttttcattactgagttgtaagaggtttttttaaaaaaaaaattctatattcaagttttttatcagatatatcacttgcaaatatttctttcctattctgttggttcatctactctgaaacacaaaattaaaacatactgatatcacctattttatctattttcttatgttgcttgtgctttttgtgtcatgtctaaggaagcattgcctaacccagggtcagaacgatttatccttatgtattctgagtttatagttttagctctttcatttttttacatttagctttactgcttatttaagttgatttttgtgtgtcatgtaagatcagggtccaacttcattcttttacatgtgggtatctagttgtcctagcaccattttttgaaaaggtcatttttttcttcatctgattgtcttgtgacccttgtttaaaatcagttgaccataaatgtcaagatttatttctgaactctcaattgtatttcattgatctatatttctgttcttaacccaataccacactgtattgattattgtagctgtgcagtaagtttggtaattgggaagtgtgaattttccgacatttttttcaagatttttggggctattctgggacccttgcatgaatttcaggataagctacacaatttctttggaaaatgcagaatgcaagttgggattttgaaaaggagtgtgttgaatcatcaatttgggggaattttgccatcttatcaatattaagttgtccaatccatgaataggggatgtcttttcatttatttatatctttaatgtcttttaacaattattttgtagtttcctatttttagtttttgatgttgttgtaattggaattttaaaaatttagtttttggattgttcattgctagtgtgtagaaatacaattgatttttataagtgatcatttatccttcaaccttgctgaacttgtttcttctagtagtcttttaaatggattcattagggtgttctatgtcatgtcatctgcaaatagagatagttttacttcttttcaaatctggagccttttatttctgtttcttgcctaattgtccccgttagaacttctagtttcaataatgttaagcagatgctgtgaaagtggacattcttgttttgttcttgaatttagggggaatatattcagtctttaaccattaaatataatgttagctctgtttttttcggtaaatggtctttatcaggtggaagaaattcccttctatacctggcttttcaaatgtttttatcatgaaagggtgttgaattttgtcaaaggctttttctgttctatcgagttaatcatatggtttttgtcctttgttgtattaacatggtatataatattgtttggtttttgaatataagatgaccccactttgcattcctgacctacctgcacttcagtttagtctcatactgcctcggacctctacattccagcctatcaaactataatatgtgctgctcgttgaaagtatcatgctgttcgatgcctcagggtttttctttttttttttttttcctgttaatatccttctttggctttccaccttgtgaactcctattgattctttgtatcccagatcaggcctttatcttttccctttcccctcatcttctacataacagtgattactctatacctctattatagccgctgtgattttgtattgcagtgaatatatttccttcaccctagtatgcaccatcaatttaataacttttctgacaaataaacaccacttcagtaaatgcatacatagatttcaaaaatgttagcattagaagaaaatatgcattgttgaattaaagaaatatgggttatttgtttgcatttccctttttattggttttagagttatttgagtatagtgactttgttgccactccagtagctagtagtacagtgtgtggtacatagtagttgtttagcatattttgttcaattaagcctgcttcttcccatgggtgcctttttgagtccctgcacaatttgtccctttggttttcctctgtgttttccactacttcataaatatataccctgttcttcagggtgtatatctgaacccctcattgttttcctgatttttgtttttattgttttgttatttttaaaaatgaaaaaaattagaaaaaagacatatcttgttattgcttcataagcagatatatgagtattaaactttaacagtttggaaatttgctgtagtttatatatatatatatatatatatatatatatatattttttttttttttttttttttttttttttttgttaagatggagtcttgctctgttgcccagactggagtgcagtggcgtgatctcggcttactgcaagctctgcctcccaggttcacgccattctcctgcctcagcctcccgagtagctgggactacaggtgcccgccaccacgcccagctaattttttttgtatttttagtagagacagggtttcaccatggtctcgatctcctgacctcgtgatccacccgcctcggcctcccaaagtgctgggattacaggcgtgagccactgcgcctggccggtttttatatattcttatactatgccgctagatatgtttttattttagagtagctggccgtttaaaaatatttaggttagcgcttcattaaaattgatttgaaagtactgtttatgatgttaaataagattgacattgaaaatactacattacaaaatgttttgaggattaatatgttcttttaacaaattctattttgaaaatcacgtttgtagatgaagtccaggaaaaatttagagataaatggacatttcatgattaggtttaggagttttctcggtagtatagctctgaattgtttaaaattgtgttttagcatgtcttggtcttactttgtcctcttactgtctgctctcctccattagccatgtgcaaagttaagatcccaggatctgctacctttcagttacgaagtttatcatccttagtaggatcagagcttaaaggcactcacaacagctctctgtattcactgcttcttctcttgcaaaaagcctcatcacttaatgaatgactaaactttctcacatttatcaatataatattgttgccttaaacatctttccattgtagtctattgtatactcttcttctacattgttctttcagaaagttttccttatgccaccattccactgaagaaaaatgtatggatgcaccataacttatttaaccattcctctatcattagatgtttaagttactgtttaatattaataaacaaccaggtgtaattgtgctcctggctttacattgctttctccccagagaaatttaaacttctttaggacagataatgcattctctatataaattctcgacagtgtttggttcaatgctatgactctctgaaatagtttataatagatgcttctcaaatttttaaactttatgggaaagagtgtgacaattttatatactgacttcctatactatttgtgtgtaggacaatgcctctgccatggtgccttggtgatcttgcatgtacccacataggccacataggcaaggctcaaccacaatctgtctcaagtcttgggggaatactctgtgatcctccttgatacatggtaagatagacttgtgaggagctgtcacaaggccatttcctatccacctctgtatcttacaggaggcggcctcaaggcagcttattatctcctattttcattttggtaaggcatgggagtttccttcaggcacagttgtgactataaaatgacatagctgcagtctagaattgactcctcaacaacagagcaacccactgtgtgtgttgtctttcatttagtccctccagtttgggtttctcttgtaggactagggacatggggagctgataccatactgatcatgccttctctgcctgtgttagtaataaaccatctgaatccatttggtcttgtcttactggcagctgccgccgtgctgatgtgtaggggctgcttgaccacttaatgtaaacaaatgggattttttttttttccagtttgtggaatttgtcattactttttaattggtcaatttattgtaaattgcttttaatttcaggattcagtggttagtgctttgctatcaaatagctcaggtaaggatggtccttgctctgtaaatacagtattattttagggggtacagcatgcagctataaaattagtcttaatctgaataaatcaaagataaagcaattagttttgtttagtacagtggcctgcacttggttttcttttttcttcctctcttctcaaggactacttttgttttgcaatctgaagcctgcttaagttgtcctggagagtcagttggatgcagacctttctcgtattatattagactttcctttctcatgcagtagaaaggtactaaggtatcttaacatgcaaataaaatgtatattgtatacacagatctacctgattttcagtggctggttgaccttgacctaggcagaaagatcaaagtcaaactgttgccagtggagggtgtccaggttcttggtgttttgaacaaagaattggacaaaatgcacaaagcaaggaaagaatgaagcagcaaaagctgagatttatcgaaagggaaagtacactctacagggtggcagcaggccgagcagcctctcacagccccgatacagaatgttcttgggtccaaataccctgctagaggattcccattggccactttgtgtttacctcatataaatgaagtgatggcctgcaatcaatctgattggttgcagaaagcgatgaaacagagcctaaagtgaagttacaaagctgcactgctatgttaacgaagacttggcgtgcaatcagtctgattggttgcaaaaaacaaacaatcagaggctgaagttacaaagttatacgcctatgcaaaagtctgattggttacagaaagcaaccaatcagaggtactttctatttcccatctgccatgcagaaatagtgggggtttgccaaggggctagtctctggtccttttgttacttaggtgtggaaagttagggttttcctttcagtttagttctaggaagtcagcgtgaaacggccctgcctccagatcctatactcctgcctcaaaactaattgaacatcatcaattctgatgtactagacatggttaagatacatgttttgccattggttacttcattaatcagaataatcataacaattcagatattaggggttttttttggtttaaaaaatgttacatgaaagcatgattttgttgaattaattaattaattaacttttttattctttgagacgggggctccctctgttgcccaggctggagtgcagtggtccaatcttggctcactgcaaccccatcaaaaactgagcgaaggatatgaacagacacttctcaaaagaagacatttatgcagccaacaaacataagaaaaaaagttcatcatcacaggtcattagagaaatgcaaatcaaaaccacaatgagataccatttcatgccagttagaatggtgatcattaaaaagtcaggaaacagcagatgctggagaggatgtggagaaataggaacacttttacactgttggtgggagtgtaaattagttcaaccattgtggaagacagtgtggcaattcctcaaggatctagaaccagaaataccatttgacccagcaatcccattactgggtatataaccgaagcattataaatcattctactataaagagacatgcacacgtacgtttattgcagcactgttcacaatagcaaagacttggaaccaatccaaatgtccatcagtgatagattggataaagaaaatgtggcacatatataccatggaatactatatagccataaaaaaggatgagttcatgtcctttgcaggaacatggatgaagctggaaaccatcattctcagcaaagtaacacaggaacagaaaaccaaacactgcacgttcccactcataagtgggagttgaacaatgagaacacatggacacagggaggggaacatcacacactggggcctgttgtggggtgggaggccaggggagggatagcattaggagaaatacctaatgtagatgatgggttgatgggtgctgcaaaccaccatggcacttgtatacctatgtaacaaacctgcacgttctgcccatgtatcccagaacttaaagtataataaaaaaattgttatgagtttgggggtacaagtgtagttttgttacatggatatattacatagtgatgaagtctagactattagtgtaaccatcactcgaatagcgtacattatacccattaggtagtttctcacccctcaacccgctcctaccttcctacatttctgagtctcagggttctgcaggtacatagaagttgccaggttttcttgccatcctcgccattcgaaattcagttctgtacatctgcctatattcgttgtgatagtgcttcgctttttcatagataaccttcctccttgccttttgaagtatgttttgggcaaacttctttctcaggcacttgatcttcagttctgtaaaattcctttactttttcttaagggtttctggcacagcaggaaccttcttcatcttctcttctacaccctccatggttccagctggaaaaagaggatgatttcttttcttttgggtagatacctaatagtgggattgccagatggaatggtagttctatttttagttctttgacaaatcgtcatactgttttccccaggggttgtactaatttacattctcactaacaatatataagcgttctcctttctccatatcctcaccaactgttattttttgactttttagtaatagccattctgactggtgtagggtggtacattggctgtctcaaaattttgtctgttttaatttgcatttctctgatgcttagtgatgttgagtatttcttcatttcatatttttcattttttcatatgcttcttggccatttgtatgcatacaacaaaagcggtgcttgcttattgtagaacatttggaaaatagaagcatagggaaaaaaatacaaattgcttctcattccagcaaccttgaataaacattaatattttggtatatttcctttatattcccaacactcatcatcttgcacatacctgtaggtctttataaatttatgtatggtctttaaagaaaactattgctgcacttggtgtatatagttttacattttaaatactctagttattatactgtgagcatatttccatactaaggaatcgagtctataatatgatttttaaaggctacaggatattccatgttaaagatataaaaatttgtttagcctttatcttattgttggacatttaagttgtttctaatttttactattttaaataatcctgaaatatgcatattttttacatatctctattaggtttcaatcaaaaattgctattaattgaattattggatcaattattatgaacagttttaaggaccttgattcactttgccaaattgcacttcagagaagttacctcattttgtattcccaccaatgatgtatggaagtgcctaattcaaaatagccttgccaacaccaagtgatagttttaaaacctttaaatttgattaatgaattatgttttttttttttttttttttttgagatggagtcttgctctgtcacccatgtcacccaggctagagttttgtggtgcgatcttggctcactacaacctctgtctcctgggttcaagtgattctcctgccttagcctcctgggtagctgggactacaggcacacggcacctcacttggctaattttttatttttattttttgtatttttagtagagacggggtttcatcacgttggctagtgtggtcttgaactcctgacctcaagtgatcctccggcattgacctcccaaagtgctgagaatacagacgtgagccactgcacctggccaaattatgttatcataatttttacgtttattttgattacagtgaggttgaagatattttcatatgcgtcttggtcgttgatagttttcattttgaaactgtttatgtccttggcccaggttttatctatgagttgttggtatctttttgctttttgatagactgaagtttttccttctttttatgtaacttaacctagaaatctttcatgtgtgaattctttctttatattaacactttgaaactccttccccattctaatattaggtgactagtcactataatgtttttcttaaagcttcattttcatgtttatctttttcttccatctggattttattttagtaaaagttatgtgataaagcaatagtatttgtcttgaaaatatagttattcaatagccatttaataagtaatactacattgatttgaaatgacaaatttataatacattttataatggttgaagtatagtgccattcttaaatatctctttgatgtttgaatgctgttacagtgattcattagtcattatttcttggtgaaactgaaaaacttactagaatttcctacagataactgcatagagctgcccctccctcttcttttaaataaggtcttgtctttccatgtggcttaattgttgcgagactcacagtcctttccttactgagcatgcacgtatctgccctctggttagcagctgtggtttccccttgcaatatctgtttttgtttgcacctttgcttctcaaggttcctgtgctgaaaatgagcctttcattactggttgcttcaggtcggtgagatctccttgttattgtttatcataattgttaactttgaagcatttttttccttcattttttccaatgtctacaagttgtttttttctctctgctgcacttatggttaaaattttaattcatcatggagtagcttagaaattctgtaatccatacatcttacttgttcaacaaggtctcagtgttatagactgttcattattttgtcctgcacaacacccttctagggaatactgaatcaagaaatcacctgtctttgcagagggcatctgttgaggcagatgccagagccatggggttgtcatttcccatcaggctccatccagtatcagtctctaatacttcaaagacactttccatccttgcatccgacagacagctgtggtgccttctgttttcttgctgcttttgtttctagtcttaacagttcttttagatagaaaaatagatgaggaattgctaacatttgagaacatattaatcagattttacatactgtaattgtgctcaaatttgagtaataatagttaccaaagaacagagaacatttaattttttcattttcatgttaggaaataagtatctgagttggctgattttatgcactctcctgaagacatatttctgctatatattttttatgttacaagaaatgaatataatggtctaatttccatcattttattttctatctttatgaacattacctatcattatgtacaagttgacaattttcccttcatttctattgattatttcttctagggattttaggttgttgcagaatatttagtcattaccaatagctctgaaataggaattaagtgattttggcactatttaataggtagtagtagattcagaaatgcagttcagatcaagtctagtgttcatctcccctcttttttagtcagtaagacttctgtgaactttgagacataccccaaggatgatgctgtattggtctagccccaagagctttatattatagaaactacaattttagtagaactaaatggaggtgattctttttgcattctttcactgaagtgttactatctaagcaggtattatttggtgttggagtggaataagaattgatattacctagagttggtgtctggttgagcttttgatttaccctaacatctcatgcttagtttatagttaatgtttaatggaattttgtcaaatggatgataaaggctgtgagtcaagtcaggatgctacctggcaaatatggagaatgaggcttggaaggtgaggatcagaatttgcttgcctctatcacagactctggaaatgcaggacgacagataatttgatattaagatatttgaatattttaccttgtatgttttccgtggttaggctgcaacttctaagccctgctggaaaaggaatggtactgttcaaagacagttcaccatggcttcatgtttctgcgcatcttacaagtgagacactaactgccctgtgttctgaactttattttcaatgatgttggtacagtgaacagctttgcaagataaacctactgtttgccttcaaaacaaagtgcagactggacgcagtggctcacacctgtaatcccaacactctaggaggccaaggcaggaggattgcttgagcccaggagtttgagaccagcctgggcaacatagcaagaccctgtcctttttttttttatgagacaaggtcttgctctgtctcccaggctggagtgcagtggcacaatcggctcaccacagcctcaacctccccaggctcaggtgatcctcctgcctcagcctccgaagtagctgggactataggtccatgccactacactcggctatttttttgtattttttgtagaaatggggttttgccatgttgcccaggctggtctcaagctcctagactcaagcaatccaccctcctcggcctcccaaagtgttgggattgtagatatgagccactgcccccacccaagaccctgtctcttaaaaaaaatagccaagcttggtggtgcatgcttgtagtcccagctacttaggaggctgaggcaatagcactgctttagcctgggaggtcaaggctgccgtgagctgtgatcacaccactgcactccagcctgggcgacaaagcaagatactgtcttaaaaagcaaacaaagaaaacagaaacaaaccaaagcaaagggcagatttgcttgcatccttggacaaattagatagtatttctctccaaagcaaaagataatcatgcttaatgttgaataaaataaagataatgtctcccttagaataaaaggcaggcatgcttactatgataaaagatttgggttccctcagctcaggttcctttcctataatgtgataatactgcatgtgcatgcatccatctgggcccatcagtgttgcccccatgagattttggggagtacggggaactgacccaaatatactgttcatgccatttgctgtgctgtgagcaataaaggcctctgtctctcacacgggagtctcatgtcttctgctagcatctatacaacagtgttaggctaacatactggcttacaagtagggcaaaatccgacccttcagagttcttgacaggtactcagcacaatgcttttggctataagatgttatcctcctttagacaaaatttgtttgactaattttctttaatccttgtttattgaattggttaaaaatattgaaaagtaataagagcccatctctttaaggggccaagaaagctgtgtgtcatctcagatgaaacaattttgaattggtaaattgggaaaagctgagggctttataatggtgttcattattctctaaaacaaaaattgaacctagaagtaagatttacattctgcctcctattgcaagaagcaatcttgggggggtgtgtggatgttgttagatttagaattcttctgaccctggtgtgtggttgcagtgggacagaatatttgagatgtgggacagaaggccacagtagtgtgttaaaggagtggaaaatcacacatagaacataggctttgaagacacatgagtttggaaccccagtgctgtcagttattactagcttttcattttttttacctttgggaaggcatgtcattcagtctatctttgcttcatatgtgtattagtctgttttcacgctgctgataaagacatacccgagactgggcaatttacaaaagaaagaaatttgttggacttacagttccacgtggctggggaggcttcacaatcatggcagaaggtgaaaggcacttgtcacatggtggcagacaagagaagagagcttgtgcagggaacctcccctttttaaaaccagcagatctaatgagacttactcactatcatgagaacagcacgggaaatacctgcccctatgattcaattatttcccaccagttccctcccacaacacatgggaattcaagatgagatttgagtgagaacacggccaaaccatataattctgcccttgactcctcccaaatctcatgtcctcacatttcaaaaccaatcataccttcccaacagtcacacaaagtcttaactcatttcagcattaactcaaaagtccacagtccaaagtctcacctgagacaaggcaagaccctttcggctatgagcctgtaaaatgaaaagcaagttagttacttcctagatacaatggggatacaggcatcgggtaaatacagccattccaaatgggagaatttggccaaaactaaggggttacaggccttgtgcaagtttgaaatccagtgggggagtcaaatcttaaagctccagaatgatctcctttgactccatgtctcacatccaggtcacgctgatgcaagaggtaggttcctatggtcttgagcagctccgcctttgtggcttagcagggtacagcctccctcctggctgctttcataagctggcactgagtgtctgtggcctttccaggtgcatggtgcaagctgtcggtggatctaccattgtggggtctggaggatggtggccctcttctcacatctccactaggccgtgccccagtggggactttgtgtggggcctctgaccccacatttcctttctgcactgccctagcacaggttgtccatgaggtccctgcccctgcagcaaagttctgcctggacatacaggcatttccatacattctctaaaatctagccagaggttcccaaacctcaattcttgacttctgtgcacctgcaggctcagcaccacatggaagctgccaaggcttggggcttgcaccctctgaagccacggcccaagctgtaccttggccccttatagtcatgcctggagtggctgggacacagggcaacaagtccctagcctgcacaccacacaggggccctgggactggcccacgaaaccattttttcatcctaggccttcagtcctgtgatgggaggggctgctgtgaagacctctgacatgccctggagacattttccccattttcttggggattaacattcgggtcctggatacttatgcaaatttctgtagccagcttgtatttctcctcagaaaatgggattttcttttctatcacattgtcagggtgcaaattttccaaacttttatgctgtttcccttttaaaactgagtgcttttaacggcacctaagtcacctcttgaatgctttgctgcctagaaatttcttccaccagatactctaaatcatctctctcaagttcaaagttccacagatctctagggcaggggcaaaatgccaccagtctctttgctaaaacaaaacaagagtgtcacctttgctccagttcccaacaagttcctcatctccatctgagatcacctcagcctgggtttcattgtccatatcattattagcattttggtcaaaaccattcaacaggtttctagggagttccaaactttcccacattttcctgccttcttctgagccctctgaactgttccaacttctgcctattacccagttccaaagtcacttccacatttttgggtatcttttcagcagtgccccactctactggtaccaatttactgtattagttcattttcatgctacagataaagacatacccaagactgggcaatttacaaaagaaagaggtttattggacttacagttccatgtggctggggaaacctcacagtcatggtggaaggtaaaaggcacatctcacatagtggcagacaagagaatagagcttgtgcagggaacctcccctttttaaaaccatcagatcttgtgagacttattcactatcatgagaaaagcatgggaaagacttgcccctgtgattcaattaactcccaccaggtccctcccacaacacgtgggaattcaagatgagattttggtgaggacacagccagaccatatcagtatgttaaatgagaaacagtaactagcttacaaaattgttaaaaggattagaaataatctatgcaaagtgcacagtactgtgatctagcatatagggtgtatgtgtataatatttgcctcaattccacttaggttattcttgatgtgaatttagagttctgatttcaagttatttctccattaactcccatgttccttcaagcagacaattctatggtgattactctaatgatgaagatgtgttcaaacagcacacttcattattaggaattttatcagaggtaaaaatcacatggccctctccttaatgtgtctgtttaatttccctctgctttcctcttataaggatacacgtgatggcatttttagggccagagataaaagtgtgtcaggctttcaaatattacctaggatttttttaaaaggagagactatggtaatctatattattaaacagcacttaaacttaagtttaacaatttgtgcaaaaaactctctctacccgtttatacactgaataagataagactaagactataattagtatagtataatagtataatttctgaaagtcattttgtatatttggcagaaatggtagccagtgggccaggaatttcaatgggccgcagatagaccaatctgtggctctgtgggtgcagcttgggagacagcagatttccattccatctgactcctctccttcttctctagcttccttgacctctgaagctcaagagtgatacagaacataatttagattgggttacttaagattattgaccaagatctctaatagactgccagcagttttacaaggaatgtcttgaaggaaggcaggaaacaggacacagcaatctgtctactgttgatttactgccaatactggattttatgattaaaaatgagacaagaaaaacagcttagtggttataaaggtgcttatccctttggatgctaattaactgagatatcgatactgcacaagaaaaaaatacacagctatgtaattaaaaaatatttacaatcattctcttattaattccaataaactatcattatggtatatattagtttcttgtgcctgccataacaaattatcacaaacttaatagtttaaaaaaaagaaaattagtctctcacaggtttggagactgaaagttagaaacaaatttaattgagctaaaatcaaggttttggcagggccgcactccctatggggaggctctaggggagaatccattccttgcttcttccagcttctgatggctactggcattgtgtggcacaattattccagtggctgcctccttctccacatggccccctcttcagtctgtctggtttaccctctgctttcctcttataaggatacctgtgatggcatttagggtccacatggatgatgcaggctaatctcatcacaagactcttaattacatctgtaaaacctttagcatataagataacactcacagattccagaattagggtctgatatctttgagggccaccattcagcctacaacaggaagataaatacacattttaatgtccttttttatgtggaaaaggtgaaccatttttataattgtcttttcccaagtgctgtttgttgcctaagaaggtaggctttgaaattgttgtgaagtgaatctcccacggaggaataagtgagcagttttccgatttttatttatttttattttttgaaaaagacagggtctcactgtcacccaggcatgagtgcagtggcatgatcatggctcactgcagcctcaacctcctgggctcaaaccatcctcccacctcttagcctcccgagtagctggaactacaggcatgcaccatgcccagctactttttgtatttttttgtagagatagggtttcgccatattgcccaggctggtctggaacacctgggctcaaatgatcctcccacctgggcctcccaaagtgttgggattacaggcatgagccaccgactgcacccagctgtttttttttcccccgatttttaggtggaatttttatttatttaattttttgctggaactcagttaaaataccagttttgcatgtatttctcaattatttgttcattattagtcatattttatttttctagttgccctagtatacatgttaattgatttttaatgtttaaaaagctcctttattgtatatcacaagataaacattttaaatcagtttaaattttattaattatagctatataaaagttaatcttcacttttttgatggaaaatatgagatgctgttagtgtgagatagttcaagaaattaagatacaaatagttttatgttatttcccatttttctttccaaggttgagtttttttttttttttggcactgttattgtatttacccaatgcttaggatgtttatactgattttaaatctgaaacacctaagaattagattttgctgagaccagctcagttgtggagaccctaacccagcggcgctagaggaattaaagacacacacacagaaatatagagtgtggagtgggaaatcaggggtctcacagccttcagagctgagagtcttgaacagagatttacctgcatatttactgacagcaagccagtgataagcattgtttctatagattatagattaactaaaagtattccttatgggaaacaaagggatgggctgaaataaaggggtgggtctggctagttacctgcgataggagcatctccttcaggcacagatcgctcatgctattgtttgtggttcaggaacacctttaagcggttgtctgccctgggtgggccaggtgttccttgccctcattccggtaaacccacaaccttccagtgtgggcgtcaatgccatcacaaacatgtcacagtgctgcagagattttgtttatggccagttttggggccagttcatggccagatttgggggcctgttcccagcaagatttattattctttatttaactccattaaattagaataataattataattttaagtggtgtttactaaataaatacatgaaatcatccagaaaatagtttatgaatgcacatttaattaaattccctgagggagcttctaatattactttgtaatttaactaaataatcttttatttggaggggaacgaacataaagaagcatgaaaaatgtgtagattagtaatgtcttgatattatttaaatcattaaattattcttgttattaatactgatgttttagtatatttttctgtccctttttggtagtttatttgcctttttatttcatttttttttgcatttttttttgtgagacagagttttgctctttttgcccaggctgaagtgcaatggcgtgatctcggctcactgcaacctccgcctcccaggttcaagtgattttcctgcctcagcctcccaagtagctgggattataggtgcttgccactatgcctggctaattttttgtatttttaatagagacagggtttcaccatgttggccaggatggtctcgatttcttgaccttgtgattcacctgcctcggcctcccaaagtgctgggattacaggcgtgagccaccatgcccagctgactttttatttcatatgttatttttcagaagttttaggtttacaaaaaaattgagcagatagtacaggtaccccatactccttttctccagctcatagttttcctatttttagcatcttacatttttgtaatgtattttttacaattaatgaaccaatatatggtacacttgatgatgatgaaaattgatgaagctatactttattattaaagtctgtacattaggattcagtctttgtgttgtatagttgtatgtgttttgacaaatgcatgtgtcatgtatgcatcatcacagtatcacatagaagagtgtaactgccctgaaaattctgtgatccatgtattaatcactctttgatatggtttagctctgggtccccacccaaatctcatattgaattgtaaccactatgtgtcaggggagggacctggtaggaggtgattggatcatgagggtggtttccccgatgttgttcccatgatagtgagttcttatgagatctgatggtttataagtgtgtagcattctcctcctgccctctgccttgtgaagaaggtgcttgcttcttcttcaccttccaccatgattggtttcctaaggcctccccagccatgtagaattgtgtgtcaattaaacctcttttctttataaattacccagtctcaggtggttttatatagcagtgtgagaatggactaatacagaaaattggtactaaagaagtggggcattgctataaggaaacttgaaaatatggaagcaactttggaactgggtaatgggcagaggttggaacggtttggagggctcagaagaagacaggaatatatgggaaagtttggaactctctagaaacttgttgaatagttatgaccaaaatgtgatagtgatatgaacaacgaaatccaggctgaggtggtctcagatggagatgaggaacttactgggaactgaagtaaaggtcactcttgctatgctttagcaaggagactgatggcattttgctcctgccctagagatctgtggaactttgaacttaagagacatgatttagggtatctggcagaagaaatttctaagtagcaaagcattcaagatgtgacctggctgtttctgaaagtgttcagtcatatgcattcacaaagagatggtctgacattggaacttatgtttaaaaaggaagaaaagcataaaagtttggaaaatctgcagcctatatggtggaaaagaaaaacccatttactgggaagtaattcaagcccgctgcagaaatttgcataagtaaaaaggagccaaatgttaattgccaaaagaatggggaaaatgtcttcagggcatttcagagatcttcatgacagcccttcccatcacaggcctggaggcctaggagggaaaaatggtttcatgggctgggcccagggccctactgctctgtgcagcctcatgacatggttccctgtgtcccagccactccagcttcagctgtggctaaaaggggccaaggcacagctcataatgttgcctcagagggtgcaagcctcaagctttggtggcctccacatggtgttgggcctgtgggtgcttagaagacaagagtggaggtttgggaacctctgcctggatttcagaagctgtatggtaatgcctgaacgtccaggcagaagtctgctgcagggccagagccctcatgggtaacctctactagggcagtgtagaggggaaatgtggggttggagactcacacagagtccccattggggcagtgcctagtgaagctgtgagaagatggccactatcctccatacctctagactgacagtttgtaccgagcacctggaaaagctgcaggctctcaatgccatcccctgaaaccagcgacgggggctataccctgaagagccacaagggtagagctacgcaaggccttgggaacccaccccttccatcagtgtgctctggatgtgaggcatggattgaaagaagattattttggaactttaagctttaatgacttccccattgtattttggacttgcatggggcctgaggccctttgattttggccaatttcccccatttggaacgtgtgtatttacacaatgcctgtacccccattgtatataggaagtaactaacttgattttacaggctcataggcaaaatgggacttgccttgtctcagatgagactttggagttggacttttgacttaatgctggaattagttaagacatttggggactgttgagatggaattttgcaaatgtgttgcagtgtgataaggaaatgagatttgggaagggctgtggcagaatgatatggtttagctctgtgtccccactcaagtctcatattgaattataattgccatgtgtcaggggagggacctggtgagaagtgattggatcatgagagtggtttccctcatgctgctctcatgatagtgagtgagttcttacaagatctgatggtttataagtgtgtggcagttcccctgccctgcctgccatcttgtgaagaaggtgcttgctcttcctttgccttctgccatgattgtaagtttcctgaggcctcccagctatgtggactgtgagtcaattaaacctcttttctttataaattactcagtttctggtagttctttacagcagtgtgaaaatggaccaatactctcttcctcttcccttattccctcttttcctcccaaattatggcaaccattgatctttctactaccaccatagttttacccttcccagaatgatatttactaggaatcctagcatatgtagacatttcagactggcttctttcaagaagcaatatatgttaaggtctctccatttcttttcatggcttgaaagcttgtttcctggaagctattccattgtatggatattccacagtttatccattaacctattgaaagatgcatcttgtttgcttctaaattttgacaattatgaataaggctgctataaatgttagtgtgaagactttgtgtagacattagttttgaacttatttgagtaaatacccaggcttgcaattgctgaattaagaccatatttatctttgtaaaagcataccagactgtcttccagtgtggctgttcttgttttttcactaaaaatttatttatataatttatggcatacaagtgcaaatttattacatgcatagtagtcaagttaggggattcagagaatctgtcacccaaataacatacattgtacccattaagtaatttcttattatatacccctctcccactctctcacccttctgagtctccattgtctatcactctgctctctatatctatgtatacaccattttttagcattcactaaaaaatgagtgagtgacaacatgtgatatttttctttctgtgtctggtttgtttcacttaagataatgaccttcagttctatccatgttgctgcaaaagaccaatgctttggctatttggactcttttttggttctatatgaattttatgattgttttttctaattctgtgaaaaatgatgttggtattttggtagggattgcattgaacctgtagattgctttgggcagtatggtcattttaacaatattaattcttctgatccatgagcatgagatatctttccatttgtttttgtcatcttcaatttctttcatctgtgttttatagttttccttgtagagatctttaacctctttggttaaatttattcctaggtattttattttctggtaggtgtggtaaataggattgacttcttgatttcattctcagtgagatcattattggtatttagaaatgctactgtgttttatatgttaatttttgtatcctgaaactttatcaaatctaagagttttttggtggagtctttaggtttttctagatataagatgatatcgtcagcaatctgcgatactttcacttcctcttttttgatttggatgtgttttatttctttctcttgcccgattgctctggctaggacttccagtactatattcaataacaatggtgaaagtgagcatctttgtcttgttttagatcttagttggaaggccttcagcttttccccattcagtatgatacatgggtttgttgtatatggcctttatttttttcaggtatgttccttctatgcctagtttgttgagggtttttttaccatgaagggaagcttaaccttatcaaatgcattttctgcatctattgagatgatcatatgttttttgtcctaattttgtttatgtgatgtatcacatttattaatttgcatatattcaaccatctttgcatccttggtataaaacccacttgatcatggtgtatgatatggtttggctctgtgtccccacccagatctcatcttatagctcccataattcctatgtgttgtgtaagggatctggtgggagatggttgaatcatgggggtgggtctttcttgtgctgttcttgtgacagtgaatgagtctcatgacatctgatggtttcaaaaacgggaatttccctacacaggctctttgcctgccaccattcatgtaagatgtgacttgctcctgcttgccttccacaatgattgtgaggcctccccagccatttggaactgtaagtccaataaacctctttgttttgtaaattgcctagtcccaggtatgtctttatcagcagcatgaaaatgaactgatacagtgcattatctttttgatgtcctgtattcaatttactagtattttgttgaggattcttgcatgtatgttcatcagggatattggtctgctgttttccttttttggttgttgtgtcctcgtccagttttggtattagggtgatagtggcctcatggaaagaattagggagaatactctcctcttcaattttttggaacagtttcaggaggagcggtattccttctttttatatttgatagaatttggctgtgaatccctcagccaagctccctcaacaatccctgagcttgtctttattgggattttttttttttttactactgattcagttttgctcttcattattggcctgtttagattttctatttcttccttgttcaatcttggtaggttgtatgtttccaggaatttatctctttcctctaggttttcttgtttgttgagtatatagttgttcataatagtttctgatgatctattgtgtttctgtggtatcagttgaaatatttccttttttatttctcattgtgtttatttggttcatctctcttctaggttagtctagctactggtttatcagatttatttatctttttgaagaatcaactctttgtttttttaatactttgtatttctttggtccctatttcatttagttctactgtgatctttgttatttcttctgctagttttgagtgtggtttgttcttgattttctagttttttgagatgcattgttaggttgataatttgtaatctttcttttttttgataataggcatttaatgctacaaatttccctcttaccactgcttttgctatatcccacaggttttggtttgttgtgtttccattttcatttgtttcaaaaaatttttaatcttttgtattaatttcttctttgatccaatgattgttcaggagcttgtgtaatatccatgtgtttgtatcgtttctgaagttcctttttgtattgatttctatttattccactgtgttatgagaaaataattgataggatttcatttttaaacatttgttgatacttgttttatggcctaacgtggtttatcttggagaatgttccatgtgctcatcgaaagagtgtatattctgcagttgttgggcagaatgttctgtaaatttgttaggtccatttggtgtaaagtccaatttatatctaatgtttctttgttggtttcctacctggatgatctgtctaatgccgtgagtggtgcgttgaagtctcccaccattattgtatctgtctatctctctctttaggcctagtgatatttgttttatggatctgggtgctccagtgttgggtgcatatacatttaaaattgttatagcctcttgccagattgatccctttattacagaatgaagttctttgtcttttttaaccgtcttttatttaatatctgatttaattgatgcaagtacagctagtgctgctcacttttggattttgtttgtgtggactgtctttctattcctttacttttggtctatatgtgtctttacaagtaatgtgagtttcttgtaagcatcatatagttggattatgtttttaaaatctattttgccaatctatatcttttaaatggggcatttaattcatttattttcaaggtttatattgatatatgtgagggtttgttcttgtcgtattgttaattgttttctagttttataaattctctgtttctttttcttggaatgtttgcctttggtttggtggaattctgtagtggtgccatttgattcctttttcttcctcctttgtgtgattactttaccagtgagttttatacttttgtgtgtttttatgatgatgaatatcgcttttacttccacgtttaggacttctttgagcatttcttgtagggccagtttagtggcgatgaattcctcagcatttgcttgtctctgaaagacttcatttcttcttatttatgaagcttattgctggatattgagttcttggctggcagtcttggttttttttatttcagcatttttaatatgtcattcccttctcttctggcttttaaggtttctggtgagaagtctcatgttagtctaatggagtttccttatgtaggtgacagggtgcttttctcttgctgattttattttattttattttttctgtgaagctgttctttatttcagggagaggacaggacagggagctcagtctttcatagcagcaactttcctcgtgatggccaggacattgctcagctcctcccgcttcctcttggtgtggatgtgtgtccccacccttttcttgatgaacttgagggcttgtttgtccttggagaccttcagtaactccatggtgcaccgctcgtatggggtgaagccacatacctcttggatcatgccccgcacacacttggtgtgtttggtcgggcgcccaaggctacgactgtgtctgggcttgctcaaattcttggtcaacttgtggcccttgttgaggcccacgaccatagtgtagcacagaaccattgctgctgctctgcaatggtggctgtggtggaatgctgtcttgctgattttagaattctttttactttagacagtctgattataatatgctgtggcaaactcctttttgcattgtgttttcctgggaatcactgagtctcctgtgtctggatgtctaaatcttgctatacttggaaaagtttcgtttcttattttgttaaataggctttctaagccttttaatctctcatatccctcaggaataccaataatttgtaagtttggtcattttatgcagtctcaattggcacatgtatacctatgtaacaaacctgcatgttctgcatgtggatcccagaacttaaagtataataaaaaaataaaataaagcaataagcaagttcaaaaaaaaaaaaaaagaaaaagctttgttcattctttttctttatttttgtctgactggattatttcaaaagacctgtcttcaagttctgaaattctttcttctgcttgatctagtatttcaaatgtattttgtattttcttcaatgaatcctttagtttcggaatgtgtgtgtgtgtgtgtgtgtgtgtgtgtgtgtgtgagagagagagagagagagagagagagagacttgttctgttgcccaggctggagtgtagtagagagcgagagtgagagagagagagagagagaaagagagagagagactttttcttttgcccaggctggagtgtagtggtgtgatcatagctcagtatgacctcaaacttttggactcaagtgatcctcctgcctcagcttcctgagtagttgggattacaagcatgtgccaccacgcctagctaatatttgtatttttagtagagacaggttctctctatgttgcccaagctggtcctaaacacctgggctcaagcagtcctcttacctcggcctcccaaagtgctgagattgtaggtgttagccaccacactcgggctttttatcttttaaagatatttatctccatgttataagtttttatttgtattctgaattgattttctgagttctttgtattggtttttagatttctctggcatctcattgagcttctttaaaatcaatgttttgaattctttatctgggattttgaggatttttttttcttttttggttaggatctactgctggagaattattacattcatttgaggccataatattacttagctttttcatgttttctgtatctttatgttggtttctgctcatctggcttcatagttacatctttttaaaaaaataactttcacgtggatgggggacttttttcttgaagatatgacaatgatgttcgttgggtaaggccttctggctttgcttccaggtgcatgcagtagtgaagactctgtataatttgtatggctatccttattctgttaatgtgttgttcttggtggggcctgtggtgaagttgtgcttgtgactggaatgcctgatgggcccatcatcaggttgtaatggtagcagaggtgtgctaagtatgtctatccttgtgacctgggacagcatatgctggctcctgtgttggcagtttccaggcaggctcatgtttgggcatctgggtggcttcctcagatgccagttttagtagcagtataccaggcagataagcaggctctcaagctcctgagcagttggagtagtgtgggtgatagaggtagcagtggtggtgagatagtctccttgttcccatgcactgtgctcttgtgttggaagtggttgcaacaggctgtgcaaactggcttctaggccagaaggtggtgctttcaggtaagagccagctgagactgtagaagcagggtgtttatgctcagtctctgtccccttggtgctcatgtgcccctggtggtagattgggttgtggaacacccagaacctggcccccacagttcatgttggcatagggttaggagggtgaagctgggtggatccagactgggcaagcttgtactcaacacctcccaatggcaagtgcgtgcatgagccatgatgtgggggtggggcaggcagtgtagtcgtcatgcccctggtgaaatgcttgggtgagaggtgactgctgctgtgctgaggtcctgccatgggtgccagggaggatgagaccactgctgtccctccctcatcccatctgtggcagccaacctggctgttctgttagtatggcagtttgcacccagcccataattcagccatgagccatagaagccagcacccagctcaagaccaagcctctgcagtaactcatcctgctcaggattggagcattgggagcctggttccagtgccagaggctggagcccatgccatgtccgtttcttagttttgattgtgggattccccattgatccccattcctgctcaagcccctgctccacaagatgcaacctgatcttccccaatggccaagactggtgctgcagattcccaggaccactcatagtttgctaagagctaggattaagaatcgcatcttactgtggctacttagttctcaggaattgtgtgggacccagggcatgttgcctccttgaagcagttccttctcacagtctcttggatgctccctaaatcagattcaggatttgggtgggtcagggtgctctgctgtggcctggactgtatgattccccagtgggaaagtggactgcagaaagatactcactcactctctcttagggattcattgccagttcccagccggtcttgaccacgacaggctgtctgcttttcttctcattcccagattttggagtttcctttcactttttctgttgaaccctgtgttccctgttgggtaatgtattcaaagtgtgattgtctacataccactttggtttttctaagtggatgaggtgtgctggaaatgtttttagtcagctatcttggaaaacaaaggtcatcctcctgtcactttttgaacttctttggttactgtgttttctcatgactattattttcagccttctctgcttgctgttttttctctactcactaagtgttggccttcctgatagcccattcttgatctctctaattcaatactctgatattaggtgatgccttccatttctgtgatttaatagaactaaccatattcctacaactttcaatttttttttttttgagatggagtctcactctgtcactcaggctggagtgcagtggcacgatctcggctcactgcaatctctgcctcccgggttcaagcaattctcctgccttggcctcctgagtagctggaattacaggcgtgcgccaccacgtctggctaatttttgtatttttagtaagagacggggtttcaccatattcttcaggctggtcttgaactcctgaccttgtgatccgcccacctcggcctcccaaagtgctgggattataggcatgagccactgtgcctggccacaactttcaattttatatatccatcccagacttcacttaggagatcaagattcatctgtctaatgcccatttaacagcccctctttgagtctctctcagatgtctcggtttatacagatataaacttgaacccttcattgcacctctgtttcaaaaaagcaaaaacctcaccagtagaagaagctacaaaaatcctgttacactcccactgtttattagatattattattttagctgtccaggccagaatcctgggtgccattcttgattctttcctctcatttcttccacatacctagctctttgccatcccctatgagtactaatttcaaaatatatttcaaattttatccattttctcttaaccctattcttgcaatcttaatacaagttactatcgtctaatctctgagaccactatattatttatgagtacttaatactaggtattatacagaataacaaactgggcatgattttgtttttaggatttcaaattacttgtaaacagtaattttgaactcccagaattctgaagttacaagaataagaggtaaaaccctaaatataaagaaacatatcctaaactaaaaacagtgacttcactttcttccccaatagaactgtgtgatgcttgggtatccagaggaggtaagccagaatattgggaaacatttatttctagtttagattttggtttctagtaattctattgtttttttagttattcagaattttatggtgggaggaggaagaatagaaattttcatattatataaacatagctattttttgccagttatacaattttacataaggttaagaatgagaatatatatctctctccttctctatatgtatctctatatattacatatatagtaatgcatatgttaatgttctgaataaggaatttactatattgctaagtgaataggcctcatcccttggaatgaggaagttgagcattactgagaggaggttgtttttatgagggcagaccagatgctaaatgaggtacattgagctaggctggatgctcttcctgacagaggcacaaaattttcttacatttttaactaaataagtatgagctagtgtgagcaaagtaaatttctatgataaggtaactaacttgatagttactcaggtagtttttgggggtttgcacctttggggacattatttgtctgccatgaatagaggttgttgctggcatctagtgggtagatgccagagatgctgctaaatatcctacagtgcccaggatagccccctacaatggttatccagaccaaaaaggtccacagtggtggggttgagcaactctcttctagagtatttatttttcaacccactgctataatgtcctaagtatttttcaaaatttcatttaacaaataaacccttaataggagtaatggttataacgattccatgattttatttttgtgaaaatttaaatgaatggaagtatatttgtgtgtacttgcaataatttaggagaggaatgaatcaaggatgaataccaggtttctggcttgagcaactcaccaggaggatgttgttgacattgagatgagaaaaaaaaaattgtgggaaaagatcttcatttcagatgttatatttgtagaatttgaggtgcctgagagatatcaaggtgaagtcctgaagatcagaacataggcttttagacatatccttaatttgcaattcatcggtatgtaaatataatttggatctaggttggatgaaatcacccagtagagtatcttttttttttccatttacttttcagatttactgagtgaacataatttttcataaacatttgatctaaatcatttttgttgttgttgttgctggttgtttggtttttaatactgggaacacagagattcagtttgaaagataccctaaaatcttaagagtagtatacaccaatccctcccactctccacccacaatctagttggtttaagtgagcagaatgatccatttttccattttaggtgagcagatgtttatgaaagatcttagaactgtttgcctcatttatcaggaacatttacaagggaagaagccattaatcgtatttcaacttgtaaatagaagaagactaagactcaggttcatatcttatacttttaacaagaacttgttgaaagaaacattaacaatttcaaactaattttaagtttttcctcacaaaagcataaaaatggagatcttaacaggaaattcttaaaaggtaaaaacaactcctacttatactagtccttgggtagttaacatagaacaggttcttctttttgtttctttgaaaaggaatttttgggcccaagtctgttcctgcttagtatctgctccggccttcccccctctcgaagcggcctccttgacggcctccgcccctgggcaccctgcagcctgaccggctgtaagaatcatgcaggggagggctgcccgtttccatgggcagagggagcccacgatccggtctgcctacccggtctcgacccctcgagtagcggtcgctccggccgtaactgttgctggatctgtcgtggtcgccgctgtaggcgtcaggcaagctgccctggtactcctcgtagtggcctcctcctccgtagcggtcgctcaggccgtaactcttgatggaactgtcgcggcccccactgtgggcgtcaggcgaggggcctcggtactcctcgtagcggcctcctcctccgtagcggtggctccggccatgactgttgttggaactgttgaggccgcggcccccgccgtaggcattgggcgagcggccttggtattcctcgtagcagcctcctcttccgtaatggtcactccggccatagctgttgctgaaactgtcgcggcccctgctgtaggcttcggtgtagtggtccccgctgtgggcatcgggcgatcggcccctgctgtgggtgtcgtgcgagcggcctcggtactcttcgtagtggcctcctcctccatagcggtggctccggtcgtaactgttgctggaactgtcacggcccccactgtaggcgttgggtgagtggcctccgctgttggcatcgagagagtgacctcggttctcctcgtagcggcctcctcctctgcaggggtcgttccggctggaactgttgtggcccccgctgtaggcattgggtgagcggcctccgctgttggcatcgagcgagcggcctcggtactcctcgtagcggcctcctcctccgtagcggtggctccggctggaactgtcatggcccccactgtaggcgtcaggcaagcggccactgctgttggcatcgagtgagcgacctcctcctccatagtggtcgctctggctggaactgtcgtggccccggctgtaggtgtcaggcgagcggcctccgctgttggcatcaagcgagtggcctcggtactcctcgtagcggccgcctcctccatagcggttgctctggctggaactgtcgtggcccccactgtaggcatcaggcgagcggcctccactgttggcatcgagcaagcggcctcggtactcctcgtagcggcctcctcctccgtagcagttgctctggccagaactgtcgtggcccccactgtaggcatcaggcgagcggcctccactgttggcatcaagggagcggcctcggtactcctcgtagcggcctcctcctccgtagcggtggctccagctggaactgtcgtggcccccgctgtaggcattgggcgagcggcctccactgttggcatcgagggagcggcctcggtactcctcgtagcagcctcctcctccgtagcggttgctctggctggaactgtcgtggcccccactgtaggcgtcggcagagcagcccccactgtgggcgtcatgcgagcggcctcggtactcatagcggccttctcctccatagcggtggctctggccgtaactgttgctggaactgctgtggcccccactgtgggtgtcgggtgaacggcctccgctgttggcatccagagagtggcctcggttctcctcatagtggcctcctactccgtagcggtcgctccagctggaattgtcgtggcccccactgtaggcctcgggcgagcagcctccactgttggcatccagcgagcggccttggtactcctcataacggcctcctcctccgcagcagtcgctccagctggaactgtcatggcccccactgtaggcgtcgtcggaccggcccctgctgtgggcatcagtggagcggcccccgctgcgggcctcgtgtgagcggcctcggtactcctcatagcggccttctcctccatagtggtggctctggccgtaactgttgctggaactgttgcggcccccgctgtgggcgtcgggcgagcggcctctgtactcctcgtagcagccttcttctccgtagcggtcactccggctgtaaccgttactggaactgctgcggcccccactataggctttgggcgagtggtccctgctgtaggcgtctggcaagacgactggcaaggcctcggacgagcggccttcactgcaggcatcgggcgagttgccctggtactcctcgtagcggcatcctcctccataagatggcggtgtcccccacacaggggcagcgccgcatgggcctccgtagctcttgaggggctctcggtaggagcctttgctgggatgatctgtgtactcatggtcgcgacccctgtagccattttggttgccgtcgcctctcaagggacggtagtccgggacactggagtggccataatagcggcggctgtagtctctgagcgcagggacaaaatccccagggtcgcggcacgggggcagtggctcccggacccgcgggcctgagtagccatcttgcccccacacggccggggccttcccaggcattccactgccgccaatgcgagccaggcttgaccggggcacagccctcttgtggggtgggccggcccagcgccgtggctgcaagcctgagtagccatcttgccccgacacagtcggtgccttcccgcgcattccacagccaacgctgtgagccaggctcgacggcgtggccctcttgtggggtgggctggcccagtgccgcggtggcggcccgcgcttcctgggcatcggggccctgtagggccacaggtcgaaataccccgcgtagccgcggccgtcatcaggcctgccctgagaggggggtcgctgtgggctgctgccacccccacgggttctgtgtgagaaccttgagcgactgccgctgccgggggttggcgggacccatcggctgctcttgaatgccggtttgatggtctgggccaccatgatggccttaccatccaggtacttgccgttcatatctctggcggcagccttggcgtctgcagggctttcgaaggtgacgaacgcgaagcccctcgacttgttggtttttcggtctttcatcaggaacaccttgatgatgtggccatacttgccaaactcggctttgagggctttctcgtcggttttgaggttgaggcccccaatgaaaagcttctctgggcgatccgcttccatcatgtctccctgccgaatggtgggtcagaggaagtgggaagtgatgacgcggcagttcagtcgcggccttcgagcgctctcgtggagggcggctcctaccggttgggggggtggatgtctcaagaaggaaaagagtaccttacgtcatagttcttgggaacaccaacgtctatgatacaggtagaggaaatcctaggaatagaaaataagaagtagccagagaggtaggaagagatcccagaagtgtagtcttctaagccagaggaaaataatctttccagacatatggaatggttattgatatggtggttgttggttacattggtggatgtgagagtggatagaaaccaaattgcagtgggttaagaagtccatggtaagtaagaaatttagttgtgttgtgggtttatgtgagtttggctgtaaaagaagaggcagatggagggggttgtgggatcgtgggaggtatttttgtgtttgcttttaaagatcagagataattcttcgttggtattttaaaagacaaatagcatatttggaatttaggtatactgaagcatatcaaatacatctggttaataaacatgcgttctatgaggtttttttctttttttgagacagagtctcgctctgtcactcaggctggagtgcagtggcgtgatctcagctccctgcaacctccgcctcctgggttcaagcgattctcctgcctcagcctcctgagaagctgggattacaggggcccaccatcacatccggctaatttttgtgtttttagtagacacaggatttcgccatgttggccaggctggtctccaactcctgagctcaaaagatctgcctgctttggcctcccaaagtgctggtattacagatgtgagccaccgcgcccagccgtatgagtgtatttctaaatgatgttttttgccttcaaggtattgatggataatattgtatattttaaagtattttaagtagttgcttagattctaagtgattcagcaagtgtgaaaatagttcttttaattaccatagatataggtatatgtttaatactcactattttcttttcagatctttccagaaatcgttttacagaaattccttctgatgtctggttatttgcaccccttgaaacattaaatttatatcataattgcatcaaaaccattcctgaagccattaaaaatctgcagatgttaacataccttaacattaggtaaggaaacaatttaaaaataaattttggtttttattgttgttctaatccttttttagtcgcaaaggaatatgtttgatttggctgtgtagcttaaatttatctcaacagtatcttatttgtgttttttatatgttcacattattttgtaggcttttgtcttgttcttgagagcagagcttagcaaactttaacacacaggaattacccggggatctgttagaatgcagattctaatttcttaggtctgttatggggcctgcatttctaacaggccccttggcaatgctcatgcctacctgctggtccttagacctcagtttgagtagcaaggctttagaccataaatatttcctgaaattatagcaccacgatacagattttatatgcatccttagatatgtgaaacaaacagtgcttgagttattttttctcacttttgtgacttcttgcttctacttcaaggatggttagagtggggtgagaatgttgaaaggtttggaagtggatgacagttcatgtttatacttagtaagtgcttaccatgtgccaggcagtcagtgttccaaacgctttacccatattaccttatctagttttcatgacagcattttgagataggtaccattgttatccctgcattacagatgaggaaattgggttaagctatttgtccaaattcatagatatattcagcaagtggtagagccaagattaaaatcaaagcagtctggctatagagctctcattcatacatagcttttaccctatatatgtaaaagaatgaacactcagtaagtataagaaaaaaactttccctgccaaatcagtaacattgaatgaaaattgatatattgtgacttaattttagaatttttttctttttttattcagttggaagggataatctcctcattaaccaagttacttgtctaaattcccatatagagaagtagtaaatataattaatatacataaatgataatgttcccttctcactgtgatatatcagttcttttgtatgactcccccagtggtgttacctgacagtacaagctattttaactgaaaccactttacaccttaaaatgtgtgagagaagtttcctggctgggtgcggtggctcacgcctgtaatcccagcactttgggaggccaaggcgggtggatcacgaggttaggagatcgagaccatcctggctaacatggtgaaaccctgtctctactaaaattacaaaaaattagccaggcgtggtggtgggcgcctgtagtcccagctactggggaggctgaggcaggagaatgatgtgaacctgggaggcggagcttgcagtgagccgagatcgcgccactgcactccagcctgggtgacagagtaagactctgtctcaaaaaaaaaaaaaaaaaaaaaaagtgtgagggaagtttccttccaaagatatcaatcatttgggttgctcctttctctaagtaggtataaatctccttggcctggcttaggagaggtttgaggaaagtgaggtatttttaagttttgtctttgtttctgtttcattttgttcttttgcggaaaaagtgattcgccaaaaactgaattacacttctctattaacacatatggtaatcttagttttactaaaactttctctgattctatcctgtcacgatctgtaaaagtcaactttgatctttttttacagtcacaaaaatttttgagcaaactatattgaaataacatttgttctagtgactgaattcttctctaaggcatgtagtaaaatagtgacaattaataatttatttgccggtattaagaaaccagattctggtgaaagatgattgtgttaactcaatgaatatgcatttttttttttttttttagacggagtcttgctctgtctcccagggtggagtggcaccatcttggctcactgcaacctccgcctcccaaattcaaatgtttcacctgcctcagcctcccaagtagttggaagtataggcgcctgtcaccaggcccgactaatttttagtagagacagtgtttcaccacgttggccaggctggtctcaaactcctgacctcaaatgatttgcccgcctcggcctctcaaaagtgctgggattacaggcgtgagccattgtgaccggcctgaatatgctttttaagggaagaaaataaattgatttttaagctatttttggcctgaagatgtattagaatgagtttgccattatttcttccatgtatttatttattttggtgaaaatctcttaataaacttgtaaaataatttttcaactcttctctcttcctatatactacccccctttttcagtagaatcctgtagaaagatccttgtgtgccctggtatgaagggacccagactgaccatttttccaaggagcctgcttcatcctgaaagtatgaaggattatgacaggaccctagcacatttgacattccagcagtctggccattattgcttgttgaggggcattgccatttttttgtttgtttgtttgtgccgtgttattaaagccagtctagtatttctggatgtcctttgccagagaaaagatggggaggagggtctttcaagtcccccttgagtaacactggacttttgttgctgtgtatgttacacgaaatgctaggtataggtctataaatgacactttgaaaaacaggaaaaataatagcttatcgcttaccagtgcttgttagtatgtaaatggaatggaaaaatatacattttgttagtggttcctttgggtcagtcagtctgttttggcatataaatttgaccatagtactttgagggcaaagaccccagagccagattgcctgagtttgaatcctgcctctcccatttaacagctgtgtgactttgagcagtttacttaaactctttgtgactatttcttcatctgcaaaatggggatcactgtgagagttaattcacatgacctgctgcaaaatgaggatcactgtgagagttaattcacatgagctgccctgaacatggcctggcaatagtaggcactcagtaaatgttagttattatatttaaatgtatctacagagataagaatgttttatcaactttgagctgagataaaggtgctaataggctgttaaaccttaaaagggaatgggttagggttactacatgtttttgaagatatagtcctattcactcttttataaacttaaacatagtgcatgcacatttatccctggagactttccctagcatggaagtattgaatataccagaattatatcaaggagcaaagttctgacattattgagctcggaggaatcattctgggtttttgagaactgatggtgtgtggagtagtatcataggtctgcctgcatagggtttgctatgctatggatctctgctgtagttgggcaaatcacttaaccagttttaactttcattttctgatttgtataatggagataataactacttaatcttgtatcattaacatgaggattaaatgagacagtgcatataagaaatttaacactgtgcctgatacaaagtgagcactcagcaagtacttattaagttattacttagtgatagaatattatttacttacaaagtgatttcttcgtttttaatatgtcacattacatacatattctcgtaatgaaactttctcattcttttcagccgaaatcttttatcaacattgccaaaatacctatttgatcttccccttaaagttttggtcgtcagtaataataaactggtatccattccagaagaaattgggaagttaaaagatttaatggaattggtgagtaacttagttgtattaattaatgcaatatgcgtaatatatctacattttggaagattacctatttttaatggaatttaattgtaatttttaaaaaaagtactaacttggtatatgtctaaattcagtaagatttagtaaaatcttgagatactatatgtctgagtttttccagtcacaaaatagcatggttcttccttagtccttgtgacgtcagaaggcttgcttacaaactttaagaaatacttttcaaatgaataagcatttgtttactcattttgtggacagtaaaggtcttagaggaaagctaagggaatttttaaaataaaacttttataggactatgatatatccttaaacaaaggagataaaagaagagagtgtctgcaaacagaattagcaacataactcttcctcactgtttgcttatgtgacgttatgacactttttagactgaaataaatggtaaaaggccattatatgcaattgattgtagaaatacagaataatttaaattaattaccttggacataacattttaggtattaaaggacattgaattctgagagaaacatattcagagcctcgaagctttcagctatttttcatatcttctggttacctccactttacgcagtataccatgcttcatgtttttcttttattttgaatgatgctttcctaataaacaggtatttttaaagttttttttttgtgatagagtctcgctctgttgcccagactggtgtgtagtgacatgatcttggttcactgcaacctccgcctcccaggttcaggctattctcgtgctcagcctcccaagtcgttgggattacagccatgcgccaccacacccaacttatttttgcatttttcgtagagatggggtttcactgtgttgcccaggctggtcttgaactcctggcctcaagtgatccacttgcttcggcctcccaaagtgctggcattacaggtgtcagccactgtgcatggactaaagtcctaaaatattcttatgtatgactttattatgtccggggaggtcaaaagttttcttgaggaacttacctacaatttcataatgagaaattaatattaacagaatgtaatgagcagaaatttcaggaataccttttattcattaaggaatacctgcatgtccaattataatacaaggaaacttccttgaatttcaccttatgttttagaaccatataattttgaagttataaaagatcttagaagtgatcagatacaaccactttctaatgtaggaatccctgatacatctactgtatattttcaatggtggacaactctgtgtgtgtgtgtgtgtgcgtgtgcgtgcgtgtgcatgcgtgactgtcctaattcttctttgcaaaactctatttgttattaatctttcttattttgaaccaaaatacatgcttctatcatttttttccattgggcctgggactaccatgtgaagaaatatagataatgacaacttctctccccttcagatatttgtaatctgttgtgtgtttacactccattttaccaaactctttttttttttttttttttttttgagacgaagttcactctgtcgcccagggtggagtgcagtggtgcgatcttggctcactgcaacctccaccctctgagttcaagcaattctcctgcctcagcctcccgagtagctgggattacaggcacctgccaccgcgcccggctaattttttgtatttttagtagagatggggcttcaccatcttggccaggctgatcttgaactcctgacctcgtgatccacctgcctcggtctcccaaagtgctgggattacaggcgtcagccaccgcgcccagcgtaccaaactcttaagatgtgtttttctatagcttaaacatccttattacctttattcctttttatgactttttacttttagctaattcgatttagaaaatgttccttttagttaaagtctcacttaatgttgtactaaaaaatgaacagagattccagatatgatctaacaagttcataataaaaggtaccattattttgtttgacttgaacactattaatgtttttccagattttataaaggttataatttaagattttatgtctccgtaatttatttgtttttaatttagtttttggccctacgtttttaattacattacatgatgtaatttttagataaatgaaatgtaaaaaataattaggagttttatattaattctagtacagttgtccctctatgggggattggttccaggattcaccccataccaaaatccacgaatgctcaagtctcttatatacaatagtaatatttacatataacctaaatacattctcccatatactttaaatcatttctagattacttataatacctaatacagtgtaaatgctgtgtgagtagttgttacgttgtattatttaaggagtaatgacaagaaaaaaaagttaatatatgttcagtacaggcacaaccatgctttttttttcctgaatatttttgatttgtatttggttgaattcatggatgcagaacccatggatacagaggaccaactgttttttaatttatgtagaaaattctaaaatgtttaacactattattttactaggtactgtaaaattattatgctttaaactcttgaaatcagtaacagtagatgggtagatagcattaggagggctaattgacagttgtaaatcacatattgaattggtggatattccctgtcattggaatattttctcttgatacttttccacatcatgtgataatcaactgcaatgaaattctgtcattagaaacctaggaaatactctctggcttccaatcctttgcagactattttgtagagcacccactggagtgggttcatttcctatgcctgggtttatttctcttgggaaatgacagctatctctcaaatttctatggattttccatatggaaatcataagtatcaaatacctttagaaagaagcaataatgtttaaataacattttcacaaacttctattatccatcgtttgaatagtagtctattctgaacatagcagctaaggtgatcctgtcaaaatataagtcagatcatgtcaatcccatgttcaaaagtttctggatcctgcccacatctctcagaataaaagctaaagtcatatccctccctctattctactctctcccttgcccatttccctctagttacactggattccttgctgttctttgtacctgtcaggtgcgctctgcctgagcgccttcacttttattgttccttctgtctggaatattcctttcttatatattagtatggttcaccttttagctctgacagtactgctcaatatcaccttctctatgagataaagtagtatccctccccactattgcgagcatagccattttcctaccctgttatcttttttaaatagcacttatcaccttctagcatattatataatttactccccttgctagcatgtaaactccatgaggagctatgacagcaggaaattttgttttgccccttgataaatccccagtccctggaacagtacctagcaaatgttaatagtattcaacaaatatttattgttgaatgaagatgccttagatattgtttgaaagaggtatgtaggatatattttcctaatcatctatagcattattatattcttccctacatggttttaatattattttgaaaactgaatgtatgtactattctcctccctccaagctattatcattttcactaaaagttggaaattgggggcagttgcattagaatatgaatttcatttgaagtgtgtctggaatgattactgtctgagaccatgttgtagatttctcttttttttgttgttgatgttattataagaaagaggggagagagcacagttaacttaaactgttcttttttctgttttttttaattatgataataaataaaaacctcaatttgttattatggaaacttgatatcgtttgcctttaaattggggcttggattttaaccacagagatttcctgagagacaccttagataacctgagagatttccaactcagatctcttagaatgtctttgagctatgagatgagtcacaagtgttggggcttgtaacttctcattttgtatccctttggagaaagagatttagttaaatcaatctttatcatagtctgtttcgccagtgcacatttataaatccttgactttcttagcttctgcccagccaagtatctcgagacaactactgtaattgacagattacacaatgtttgagagttgttagtcttttactttacctccacgtgaagagtgctggatcattcttacttctggttttggctggtatgagttggcctttagttgagattttcgagaggttgtagttactaagatataacctcaaatttttgtatgggaagtttctatttactgtactaggtcggcttcatgatgtcgtataaatagaaatctgccagataatccatctttagagcaatgacattagaggataacttttgctagctattaaccatgtgctttaatttaaaaattagaatatatatatataatatatgtatttctcagttagcttgttataattctgttttattgttctccttaggatattagctgcaatgagattcaagtccttccccaacaaatgggaaaattacattcacttagagagctaaatataagaagaaataatcttcatgttttgccagatggtaagatgttcactgtttttactcacatgaataagagagtaactatgtaaaatttaattaattatttttcatttctgaccagaattaggagaccttcccttagtcaagctggatttctcttgtaataaagtgaccgaaattccagtttgttacagaaagctgcatcatttacaagtaataattttggataacaatccattgcaagtaccaccagcacaggtttgtaataaaaatattataatgtttcttctcatttttattcataattttatctgtttatgactggtaaatcaaaaagcacctaaatcaagagccaatttgttgttcaagcactgttgtctaaagtttttctgagcattgccttttgcactttggtaggagttttagcttaggctctaggatagcatttggaaaacccagataataactttctgcttgtgaactgataattctggttgttagttatttacaaaagtgactctgaagtctctctacctatttcccactcaggtatatatctacttgggatttgttgtgggattgattggagtacattcttggcactgagagatggaattataacagaaagaacaaaatacaagtggaaaatattaattatgacttttagtttagtgaggattaaatccatgtggaatcctcttaaatgatagttaaggaataaactatgatataatcccctatggacaaagtatgaaagagaagaaagaggacagtggggaagagatgtcaatagaatttctgaaaatggaaaatagaatagtagaaacaagtacctttacttagattgcccaaaattatttggctgaggagcaagtagcagtgaaatggtactttatgctgtgtgccctggcagagggtttgcagacatccagaagaaaggtcttctttttcttcctacaaaagtacattccactcattctaaaggggttaccttttctaattcaaataaagactggctagagtcctggtggtagcaaccttagcagaatgaagaaagctgaaacttgtgcctgctatgggagaaggcaatcagattcaagttgatttacagcgtcaaacctgggaatggcttgagtattggaggaaacatgtaactctgaatatagggattaagtactgaaaacatgatggtttgtggaatgtctaaggcagtgctgtccagtagaactttctgaatgatggaaatgttttataatcgacactggtccaatactgtaaccacttgtttatgtggctgttgaatgcttggaatatagctagtgcaactaaggaaccaaattttaaattttattttaatttgatttatttaaatttaaattgctgcatgtgactggtagctcccatattaaacaccacggctctaagatttacaccctcagattcttgccctcagccccacagccacagaccattccttacttgcatcagcagaagtccggaatttattctaaggagtaggtagatccttaggttttctccgttagctcagtggccagatgatgactcacttcttgcctcagcagaagactggtgtttactccttagagaagcaccatcccatttgtacttgctgtggtgatgagcatgttctgtatctgcattgtccaatacggtagccatagtggctactgagtacttgaaagtgtatagtgtgacaaaagaactgaatttttattttatttagatttgattaatttacatttaaatacacatgtagaacacaaaaccaaacaccacatgttctcactcataagtgggagttgaacaatgagaacacatggacacagggaggggaatgtcacaaactggggcctgtgggggtgtggggggcaaggggagggagagcattgggacaaatacctaatacatgcggggttgaaaacctagatgatgggttgataggtgcagcaaaccaccatggcacatgtatacctgtgtaacaaacctgcacattttgcacatgtatcccagaacttaaagtaaaataaataaatagacacatgtggctagtggtaccctattggacagtgaagctataaagggattgaaacagagtcaggggctccaggtacagcttatatagcaagagcgagaccgcatactgaaaacagtgaatggttgcatactgaatgttgagacgctccagtttggctcccagaatgcttgcaacctgtcttacatatttcaggcagaattggtggatttcttccttagtaaactgcagcaggagaagagacctatctatatactgaatttttggagtcacctgatgaaatggctagtctgtgtctgatcaccagatagatggaagctcaccatcaggaaacttccccatgcacacagagcttccagtttgttttttattatcccttttggaaattaacagacaggtcggatggtagctcatgcctataatcccagtactttggaactttggtagactgaagtgggaggattgttagaacccagtaggttgaggctgctgtgagccctgatcacaccattgtaccattgtactacagcctagacagcagagtgagactctgtctttaaaaaaaaaaaaaaaaaaaaaaaaaaaggctgggtgcggtggctcacacttgtaattgcagcactttgggaggctgaggcagatggatcgcctgagctcaggagtttgagaccaccctgggcaatatggtgaaaccccgtctctactaaagtacaaaaaattagctgggtgtggtggcacgcgcctgtagtctcagctactggggaggctgaggcacgagaatcgcttgatccttggaggaggaggttgcagtgagccaagatcgtgccactgcactccagcttgggctacagagtgagactctgtctcaaaaaaaaaaaaagaaaaaaaaagaaaaaagaaaatgaacagccagccaagaatcattagacattgcaagagtaatctctaacatgaaagacagagaccaaaacaccaaaggctttcattgaaacgaaagggagcacatttattttttgtgtgtgtgtggatatccagaaatatttgtaaaccatatatctgatgaggggttaatagccaaaatacaaaaaggattcatataactcaatagcaaaaaaaaaaaaaaattgaaaaataggcaaaggacttgaatagacattttttcaaacaagacatacaaatggccaacagctatatgaaaagatattcagcattcctaatcatcagggaaatgtaaatcacaaccacaatgagatatcacttcacacttgttaggatgcctgttatcaaaaagaaaagataaccagtgctggcaaggatatggagaaaagggaaccattgtacactattgatgggaatgtaaaatggtacagccattatggaaaacagtatagtgcttcctcaaaaaattaaaagtagagctaccatataatattacagtcctacctctgggtatacatctgtaagagatagaaaaataaaccaaactattttttctattttaattctcaatacagaatacttcacttctggtcaccaaaatgcgtcagatttcttcccaccaccaagcagttctccagcagacactgactgggtatcctataattcaattcaattctgacactacctggagttaacatcagatcctacaggttaagagctcagtcccacagactgctcacctatacttctgactgaccaactataagttaaggttcccatgaccccctcctcaggttcagttaatttactagagtggttcacagaacttagtgaaacactttacttactattgctaatttattacaaaggatacaaatgaatagccagatggaagagaaggataggacaaggcatatgagaaggggtgctaactgaaggggtggagaggggatgttccctttcctccccatcataagggtcacggctgatacccctataacaaaaaacaagtaaacaagataaaaggataacaactttatttgatcatagttttacgtgacactggagccttcagaataaggacccaaggatatagagaaagttagctgactttatgcttcgattcaattcagactgggacagcagtgtagaaatgtgattggacaaaaaaagcatgagctaatggtaatagatggagtgggaaaacctagcaaggccttttcttggtgtctctgttgtagcgtttgttccttctgggtgtagggtaatacttctctggaatgagggttttaatttgtttatggccagtggttacacagaaaggtaggggaaggttagattaggctttatggctggctttggaaaaaaggggttctagtgcctatgactggccttggggacgataaattcttgtttccatgacttgcctctagtgagaatgaggaggtgagagacaggggaggggcgtctggagaaggtcagagaaaaactttgcttctgaggctttcattttggggtatcattttctgaacctcaatgaagcttttgtgccctctgtgggcacgccaccttccaggcacctccacgtgtttagcaatttgtaagctttccgaaccctgtccttttggtttttatggaggcttcgttgtggaggcacaattggttacatcattggccattggtgatcacctcaactttcagcccttctctggttcctggaggtgagggaggtaggattgaaagtttcaaccgcctaatcccatggttggttttcctggcaatcagtcccttatcctgtggctatccaggagctcccagccaccagtcattcattagcatgcaaagggatacttaccacttaagagatcgtgtaagagttttaggagctgtgtataggaaatgggagcaaaaccaagtatacattccttacaaattacaatatccgaaggaaatgaaatcaccatcttaaagaaataatctgcactcccatgttcattgcaacattattcactacagtcaagatatggaaacaacctgtatgtccatcaacagatgaatggataaagaaaatatagtgtgtgtgtgtgtgtgggggggggggtgtgtttgtgtgtaatgaaatattattcagccttagaaaaagaaggaaatcctgtcatttgcaacaacatggatgaaacttaaggacattatactaattgaaataagcctgacacagaaagataaatgctgtgtgatctcacgtatatgtggaaccttaaaaaaaaaaagttgaactcctggtgacagagagtagaatggtggttaccaggggctggggggtgtggataaaggggagattttaaacggtaccatccttcagttataagatgaataagtactgaggacctaatgtatatcatgctgataatagttaataatattgtatttacttgaaatttgttaagagagttgaactgaagtgttctcactacacacacaaacaaggtaactacatgaggtgatgggcatgttaattagcttgactgtggtaatcatttcacaatgtataatacagttgatccttgaacaacatgagggttaggggcatcgaaccctgcatactgtaaaaaatccatgtataactttggaatcacaaaaaacttagctgctaatagcctactgttgactggaagccttatcaataacaaacagttgactaacacatattttatatgttatatgttatttactgtattcttacaatcaagtaagctacagaaaagaaaatgttattaagaaaatcataaggaagagaaaatatatttaccattcactaagtggaagttgatcatcataaagatcttcatccccatggtcttcacattgaacagggctgaagaggaggaagaggaggggttggtctagctgtctcaggagtggcagaggtggaagaaaatccatgtataatggacctgcacagttcaaacttgtgttgttcaagggtcaactgtatatcaaagcatcacgttgtacaccttaaatttgggagttcagtcagggtggtgggaaaaattatagaagaaaagttatgaagatagttataggaaatagacacaaaccttcttggaaggctgggggggttgcatagcttcagtaaaaagttcagctgaagtcagcctaatcctcttaccttgagttaatagtttaaagtaggtacaaaggaatgtaagggagtttatctaaatagcttgtttactcatgtggccctaagcccaaccttttatcatctgtgagtgcatgattgctctctactcgaggggttggcagtgttaattaccttctagcggtgtttactcgagacctttgtaatttaatcagtactaaataaatgcgaacttccccggcttatcgaggcagatgctgcagactcaggcagcagagccccttagccagactgacaggcaaagtatctgtgtcagtgtacgtctttcatccgtcattgggtcagggtcagcgggatggacatggcacttaaatataaaaaaattttatttgtaactcatactttaataaagctcgaagaaaaaataaagaggaaaaatggagcatattcataggagtgctaatcagcatggctttctagcagcagttgtggaaactggcagatgttggaatgataccttcgaggactaagggagtatttctaacattctacattcaaactgtcatcaaatgtgaggtagaaaaaggtttcaaacatgcaagatcttagaaatttttactcccatgtaccctttcttaggatgctagcagagggtgtactataccaaagtgagggagtaaactaaaaaaaggggaattcttcttgtctgagattgacagatatgcataggcctagtaagcagccagtcagtagtttggagtacaggagttgtctccaaaaaaaaaaaaaaaaaaatagaaagtaagagatgatttgatacgtttgtccacatggagagatgttttatacttctgtcagagtcaagaatgaatttataataggcatatagaaaatttttcaaaagaaaaaatggggccattaattactttaggaaaaacaaaaacttacaggagaaaggaaatgtaatcatattactctgtagagtttatctgtgaatattttcttggtcataataatataaacactagattttgatttagtgaaaaactgtgacatagttataatagcagagatttatatagtatttgctgtgttctagacactgttgaaaatgctttacatatattaactcatttaattcttatgttaaccctgtaaaacaagtactgtcattatcctcattttacatgtaagaaaacagaggcatagaagttaaatgacttgttcaaggtcacattgctagcatgggttagagccaggattcaacctaaggcagtgtgactgcagagtccatgctctttaaccactatgttatacttctgaagagagaagtatgtttatgtgaattgataggaagcggggaggctgggatggtggtggtggtgtgggtaatgtaagaaatccaagtcctcatcttccttagtgatactccaataaatctaccattggaaaatttaaaacaaatagcagtagaagcatgttattaataaatatgagggcaaatagaaattaaactaaaagagtttaaagtgggaatttgatcttagagattgaaataattagaatgggctgggcacggtggttcatgcctgtaatcccagcactttgtgaggccgaggtgggaggatcacttgaacccaggagttcgagaacagcctgggcaacatggtgggaccctgtctctgcaaaatataagaaagattagccgggcatggtggtgtgtgcctgtaatttcatcccagctaatctgggaggatcacttgagcccaggatgtcgagggtgcagtgagccatgtttgtgccactgcactccagcctgggcgacagaatgagacgctgttttccaaaaacaagcaaaaaaaaaacaaaaaaacaaaaaaaaggagaagtagaattgaggattatgtcttgtcagctttgtaattatttttaaatttaaaaactgtgtacatgaagtactatgataaaaagttaaaatttacaagagagtgatttaccagcacttaatttggtaattaagataaatttttgtttagtttggacgtataatagaatactacctcacattttaattttagcacattttagttgatagtatttaatattaataatttataattaatagaaaaatcaatgatatttacaacatttaattggcaatatatttatattctaatagctcaaaagttttaattttccttttaaatgaaatttttcagtggtcaagtcagacctagtatctgttagaattatctaagaaacattcttcctttggacctggaatgataattgctttttaatgttgttgtcttactgttttctttgctgatttttttgcatgtgaggtaagcttatgtgagcccataaaatgttacattttttattagaattttgagaaatatttatttgatgtcacttagtgactgtaattaaccttgataaagctgacttacagttttcttacctctcattttctattgtttttatacagagtatctttgctcacatagtattttattcctcattattcattttctctatggccaacgaaagtaatttcttaggatattattctagttgaattgaccagtgttttcttttattatttcagtctcaccagcctaatatcgtacctttcaaaaaattcatttttcctatatttatattttttatgttagccttctccaggttttatgccaaacatcttagtggttctgatgagattactttaaagaatcacatagattatttgttcttttcttaccattccaatgaatatatatttttcattttttcaaataaaggccacttttatgagttgtaaacttcatattgtttaatagtttgtacattctgcttttgacaagaaaactctagtgaaatatagaaaaattaacttttttcaataagaacagagatggcaatagaattttagttggtatcagtgttgtcagatttttccacctggtgtcagaagtacaaattatttaaatatgcaaagtatcaatcaagattgtgatgtctcaatgtaatttgagactattgaatggtttaaaatgatagatgtcatttatatttggaactatataattaaatctttattttttattgacagatatgtttaaagggtaaggtgcacatatttaagtacttaaatattcaagcatgttgcagaatggataagaaaccagattccctggatcttccatcattgagtaaacgaatgccctcacagcctctcacagacaggtaatgtaacattcttacagtttcatttgatgattgctgtcttctctttttatgaaatatacttattaatcttgagtgttccgaatatatttaggctgattggtccagcactaaaataaataattggctgaagctacatatcaccatcatagaatgaagttctaggatactagaatatttttgacattttctcaatcattaaagttttagtagtaaaaatgtaaatgtttgacattatattacggaaacactaatttctcagcatgtgacaactgttaatttattttgtgatcactgtattgtacatttgtaacaacaagtagaatttgactttgaactgaggttggtggaagagcaagacatttggggagtaccttttccctttcatcatagtctttatgtctggatcaaagatgatatatcataatgacatataatgatatatcatctttgatgaacatctttgatgttctttatgatttcagtgttttgatcctcatgagattttgagatagtagattgaacattctgtttttaattcatcctttcaagatgtagattggtctgaaagattttatgaaagtataaatccatgtaatagtttagaaaataacctagaatggggtgagactacagaaagctagaccatgcccttgcctaaaatatttaaagatttgtcattgcatatatataaattttatattgctttgaatggcaatatagtaagtactattgttaacagcacaagtttgtgaattcccaaataggactttttcttgaatatttttattttgtaagtagaattaagtatctaaacattagattcagtttttaaagattattttgtttaatattatgaacagtattagaccaaacaaggctccaaaaattggaattaaggcattctaatctctattaatctgctttatatttattttaacatgaatttacttttagtaatggcatttactgttttagtcatttattttacaaatatcagttgaatgcctactggtagattcagttatgttttgttgaatgtcatatatgttggtcttggcctcttggtgctcacaatgtagtggagcaggagtcagtgaataaacaaagcaaggaaatacacacacatataaaatttcaaattgtattctgtgctatgaaggaatgtatttcaagagtgtcgtcagggaatgaataaaagccagctctgtgaagagcaaagtaagagcatcttaggcagaaagaatgacattgccatggccttaagttaggaaggaactttgtgtgttcaaacaactgaaaggagaccagcgtggttggagcagagtagctgaagggaaacgtggtacatgttgattttagagaggtagtcagagttcaagtcatgtgggtgctttgtaggatgtggtaagaagtttgaattttacttaaagtacagtgggaagtcattggacagttttaagtgggggaataacatgatttgactcatttttttaaaaaaaactattttggcttataggagaatagattggaagtaagcaaaaatagaagcacagggaccagttggattgttgtagtattgccaagagatcagggggtctagaataaagtaattgcaatacagatgaaaagaaatgggcagaattaagatatattttggagatattctctagcaggaccatccagtaaaaatataatgtgagccacatatataatttttaattttttgttacccattttgaaaaaagtaaaaagaaatacatgttatttgagtatatccaaaatattatcatttcaacatgtaattaatgtgaaaacttggtgagatattttatatgcttatttaatattaaatctttgaaatctggtatgtactttatgtgtatagtgtgtctcgatttggaatggctgtatatggctactggctgcttaccgtattggacagtgcaggtctatagagtgggttgtcagttgtattaatttctcactcacagcctgtattgaactacttagaaaattcttgtatgtgctttccactttcatactcaggctcttggctgtatggttcttactacctagaatgcccttccatgccttgtctgttttgtaaactctttattatacatagataggcactacagtacttacatataatagcttttggagtcagacataatatggctttgaagcccttttatgactcttaataactgtatgtccttgtgtattaatgtctctggtcctcagttttctcatatgtaaaaaagaaaataattacacaggtgctgtcaggattaaatgaagcaatgtatgtagagcacttagtgcaatgccttacccataacatttcctcaacaaatagcttattatcatcattgtcatttactacaaatacatggagtattttgtgcagtgcagtcagatgaattttggctctaatcatggtttaactacttaatttctctgtggccttgtgtaagttatttaacttctctgagcctgtttccatacctaaaatgttaaccatacccacttctacagttgtgagaattaaatgtgtgcctagcaattagttcaataaatgataaacagcaaatgttataatttttccccttgggacgttaacttttgtaagctttatttttttttgtaaaaagataataattataacttcaagactgtaagaattatgtctaaaatatgaggtgcatctaacacagtacataacacagtatagacactcaatgaatgctaacagttattgcctcttcatccacaagactaagctcaaatgccacattcttgagtgatgcctttcctaactttaccgaggagaattagttgaccttttttttttttctcatagcactttgtatttacctttgtcatagtcttcaaaacatttaaacacattcatttttcctctaggctgagagctagctctttggaggcaagttttaaaaatgtattttctcttaagcattcagcatagtacctgatacttggtaggtgattccctaaatgtattcatatacttctgaaaagtacaaaaaaaagtttttttttgttgttgttattgttttttttttttttttttttttttttttagcatgaaactggttttaggagcggaattaaaacatagtgattaccaccagggactttggtgctagataattgagggatcaaatttggactgctggctgcaagttgcgtatccttggataaattgcttaatccattccagtcaaagttttatcatatataaaatgagaaaacaccatcaatttgctacagtttttcacaataaatatgtaatgttttgtcttttaaacatttagcacagttcctcatacataataagtggtcattgtagactgtgtggtaaaattgcaaattaagtgaaaaatactttgcttcctgggtggcatattttgtaaatcagaaatttgcaaggacaaagtgaatttgaaagtattaaagtgcatattcaatactttgtagctttcatttttacatcctctctttattagatgggcattatttatataaataaaacatttttagagccaatgaagagtaaagcatataaattgaagttaaaagatgtttcgaagctctgtgatgaaatttgacaaaccaatgggaaaaacaggtcttccatcaagataatgttctaacaaggcagcctgattttctgaatctctgaggagaaataataggttattgttgacaattgacactatagagtacacgaagggaacaatattgcatgagtggcatgaataaaatgttttgtaggaagagttctgatatttttctcctcatgtccctaattaaggatcttagacatcaaaagtatatattctgtattatctagggaaattttaggtcaaatgtgcattatctatttaagaagaaaatcctaactgctcttaggatttctatttccatagtatggaagatttttatccaaataaaaatcatggccctgactctggaattggaagtgataatggagagaaacgattatccacaacagaagtgagtattttctattgctgatccattctgttttacaattttattagagcattgaaatagagacccttgtgcatacttgagtttattttgcttgaaaatatgatcattatattttatgactaaaactgaaaaaaagggcatgctgatttttaaagctgagcagtaaaccttatgttaattttgggtttgaaaactggagatgtaaagcagacattctgtaattcatatgtaaaattgaagtaacataatccatatcgtaagtttaaaatgcctcatttgtactttttgcttattccttttagccatcagatgatgacacagtcagccttcattctcaagtctcagaatcaaatagagagcagacatcaagaaatgacagtcacataataggaagtaagactgattctcagaaaggtaattcatatggtacctgctatttttgtttcatgtacatagcccacattaaaaatgggctttgaaaaattatattgtctttagcaaactcttacattgagaaaatacacatttttctaaggacagcagtgtcaagcatacagtttactatgtacattttctaataaatattaatctgtacctagaccaggaggtatatgattttgttgaccccaacacagaagatgtagcagttcctgaacagggaaatgcacatattggatcatttgtatcattctttaaggtaaataaaactttgaacaaatattaataacatgttctcttgatcttataaaagtggactatacaatttaaaatgtaactttcttttatataagggaaaagaaaaatgttctgaaaaatctcggaaaaatgaagaattaggagatgaaaaaaggtaagcacatatgaaaatgaaatgttatttataagcccttgagccattcattagatattcctacttgaaagagtacttgaaaaaaatataattttttgttcacttacctcttatgtttagatagttaatttataaatacttcacatctgtctgtattcctcaagtaaacacaaaattatagtaagcgtttgagtgtaggatgtgcactatttttacccctgaagtgtaatgatgacttctattattattattgaggaggactataccgtcatatacattgcttcatttgagctatttaacaaccataacaatagatggtattgacatcactttaccaattaagacactgaaaccaggagttttaaatggctggaactcagatgtattgtctcttgttctactatactttccatttggtcatgctgattatgacttttaagggtacttatgtccatattttattaaaataattgtgctttggatcttttttgaaccattcatcttataaaatgatgaaatatgacctaccacatttttttcagttactccttcaggttgctttatagatgcagaaaggaaagaagaaacatttggtgaatacctaccatataccaggattagtgctatgtgctttcccatgtttctcattttatcttcattaaaatcctgtagggtagatactgacctcattttttcaggtgaggaaggtgaagttcaaagactcttaagttttatgcctaaaaccacttagccagtgtccactagtacctagagtgtgaaagtagctctctttgatttttaaacttttctcttttctctacattatgcttcctccaaatgacttcacagttattagttaatcatctctgatgtcctgtaaggaggtacattgctttgtcttgaactgtttagatttcattcttttactttctcacctcatctaatgaggtcagttgcttaaacttgagaaacacctgtagcatgtacgatgtggtaaagtcacaaagattcatggtttgatactgtttttaaagtgaaatctaaagataaaatgactagagtttggataactattttaaaatttttttgttctcttttataaagatgacatattagtattttcacgcaaatttgccaatcttatttgaacctattttggattttctttatttagacatatacagatttttaaaatcaaaatcaataaactgataaaaacaggatggtgcaattaaatgacaaaattttacaatattttaaatttatgtattaagacaggccatatagaactctgcagtcctttttatactgaaggctggagaatatacatttttagattactattaaccattacacatttcagaaatctaaaaaatggtttatatactttgctattatttgttagtcattaattatattaatacagccagtatgctacatttcataatgagtagagaacacagaagttttccttatttcttattttagcattttaaaagaaggacctaggattttaactttcatatggtgttaaaaacaaaaatggtttctatttctggaagctggcataaaatgtagtctgccttactttttggataaccatgtttgtgtcacctttcagacttgagaaagaacagttactggcagaggaagaggatgatgatttgaaggaagtaactgatttgaggaaaatagctgctcagttattgcagcaagaacagaagaacaggtattcctttcagtaatgagatttgaattggcaaattttataatcattaaattgattatttaaagattatcaaagtatatgaagttttgagtaaacaatagtgccctcttaagatctatctcaagggactaactacagattgagtattcctcattcaaaaatctgaaatcggatcccaagcatttcaaataagggatactcaacctgtactaaaaggcaataggaaatacttaggacgggaatataaaattacatttacaactaacagaatgtactcatatatatagtcactatatttaatattgcctaggtatttcttttttattcctgtgtgtgtgctgaatcataataactgatttatttgttgatattaattttagctcacagtagcattatttacattgtaagcattttttttctaggtacatgtcatgaatataacgtgctttttaaaactcagattccaaacttggcatacgtctaaactccttagaatggagttgaattttgcaagagttgattaaatcagtatgatgatttgagggtcactggctcactttggtctgtttcttggtcaaagaccattttcctcatcttttggctaggctttcttcaagtacatgttgttggcaatgagaagggtactgtgtgaatgagaataaaatcaagacatgtccacttctaatgcaggaaaagttccatatgctgctgagggtcagctgttattgccatcttcatgtactgagaggactacatttatagttttgaaatgataaagatctgaatggtttttttttgctttgagaaaagagaataattttggtgcatttaacatggataagtaaaatattttatttcatttattcaaaataataaatgtttatggttaatatgaccatgttttgggaagtttcaaatttaaatatactggcatttgtttaaatgtacattgaaaaatacaactaaaacttatcaaatgacaaatatatggtttctaggggccactttttaggggcaatctatataatagctaataagctaaattgcctaagtgtcttttttgcacagttgctacatttatagatatacaaaatcatactagaaaatcactaacctttattcctttcatatcaaatgtatcttcatcagcagttcacatttttcttctgctgtaactttcggtctgctttttctgtgatgtttatcttttcaacttttcctgtgattcttttctaatgggccttttaaaaattggctacttatgaggctgtgtttgtttttccccctccaatataatttaagtgttgattgccctgtgatttaaaaggtttgatgaagcaagccaccacctgttctgtggagcttaaaaagtttctgtctcctctacctagcaggtgaaagaattgtatttatcattatgggacgataatattgtttttttaagaacccacagctagctgggtgccatggtttatgcctgtaatcccagtactttgggaggccgaggtgggtggatcgcttgagctcaggagtgcaagaccagcctgggcaacatggcgaaaccccgtctctaccaaaaatacaaaaaattagccgggcatggtggtgtgcacctgtggtcctagccacttgggaggctgaggtgggaagatcgcttgagcctgagaggcagaggttgcagtgagccaagatcatgccactgcactccagcctgggtgacagatctcaaaaaaaaaaaaaaaaaaccgacaggcctatccatttttctcgtggtattaggaatagcatttgagtgcataattatagatttttacattgtcatatacgatatttctgtatttccattttcttattagcatattagtttttcatctatccatgtgacttaaattattctttctagcctaggtacaacattgactgaatagttaatctttcattggttttatttttgtgatagttttgtaatcagtacaaaatagcatctagcactgtgccttatacatagtaaatacataatatttttgattgactgcttgaaaattaaatcaatacatttaaaactagtaggagaaattagttaaaaaattatatgttctccctaaaaaaaacttctgctgttcttcaagatgtatgcaaaagtaatttctttttctaattctcttctttatcatcctttttagatgttagtacatactaatataagaactttttagattaaatattaatatacagtgacattgttgtgataagtatgtctaattttttcagacattaaaatatttataatatgatcataaagtaaagagcacttttttttttgagacagagtcttgctctgttgcccagtctagagtgcagtggtacagtcttggctcactgcagcctctgcctcctgggttcaagtcattctcatccctcggcctcccaagtagctgggattaccagtgtgtgccaccacacccggctattttttttgtattttagtagagacggggtttcgccatgttggctaggctggtctgaaactcctggcctcaggggttccacccgcctcggccttccaaagtgctgggattacaggcgtgagccaccacgcccggccaaagagcacattttacttttaaaatttataacgtatggagaattttagatccctagccaattctgttaatgcctgaacttaaactggatctcagaatttttaaatgctaaatctaatattttttctattaaataatctttcttccttctacaatatgttactattgcttagatcttttagatttagggacttaaaatttttagtttactgtcacaatacttgaatttgaatgagaccaaaaatctaagcgtaatcctatatgagaatatatcctacagtggatttgatataatttataccttctctggttgtggattttccttttcatgctgtattattgtgtcttatattccaaatatattagtgaaggatctgaaatgctatttaaaattgtaggccaggagttgtaacatctctttttaggttttaaaataattattgtaaattttgtttgtttttagtcttgattaaaaataatttaactggattaagattaccctcgcctaccaggaaatatcatccaggactgctactttgactgtatattacttaactgttctttaacttgctactagtagaagacaaatgcaatgttagctctcagctaaatgaagccatgtatcttctcccaaactagaggtaattaaaaaacagcttacattgagttcagtgatgatttccttatggcagttttgccacttgcttagttcatatatatttttaattttttaatttatttttttttaatattttttgagacggagtctcactctgttgcccaggctggagtgcagtggtgcaatctcagctcaccacaacctccacctcccgggttcaagcaattctcctggctcagcctcccaagtagctgggactacaggcatgcgctagcatgcctggctaatttttgtatttttagtagagacagggtttcactgtgttggccaggctggtcttgaactgctgacctcgtgatctgcccgcctcagcctcccaaagtgctgggattacaggtgtgagccaccacgcctggcagttcatattattttttaaaatgtctttgattctttaagaaactttatgccagtacttggtacatgaaactatcctaggggagcagcaagaggatattgtacagaattaatactcaaaaagggtgagaaaagagatcagcaaataaaccatcaaattggtaactcataaggttttaaagtctgaagcctagttgtttagaagactgcctccactttgtctgattaagatgtgtaggttaagctactttatgtttacagtttattgttgaattttttttttttttttttgagacagtctcactctgtcgtccaggctggagtgcagtggcgtgatctcggttcactgcaagctccgcctcctgggttcacgccattctcctgcctcagcctcctgagtagctgggactacaggcgcctgccaccacgcccgactaattgtttgtatttttagtagagacggggtttcaccatgttagccaggatggtctcaatctcctgacgtcgtgatccgcctgccttggcctcccaaagtgctgggattacaggcgtgagccaccgcgccgggcctgaatttttttttttaattgataaacagtctttatcatcccctgtcaaaatattggattattatttctacttgcatctgagtgtattgaagtcactctgaatcaatgactttgactatatttaaatagctattcatcaagttctaattttaccttcactattattttgggaaataaaaacaagtcttgaaaaaaaatcattatcttaaaaataatgttgcatgatgagtaagttctagggatctgctgtacaacattgtgcctataattaacagtacagtattgtatacttaaaaatttgttaaaagagtagatctcttgttaaatgttcttaccaaaataaaataaaattgacaaaagggagcatgttttttagaccaagaaaaatcaaggaaggaactgagaataaaatgatactattagaatattcttaatattaacttgataataaaaaaggaaattctgttgaaaaacaaaaaagttgatatgtattattaattattgagccagttttacaaatttccatgagtcttactcatttatgttagtgttgaaaaggtggctactgctctttttcttatactgattttctttgggggcgtaataagtagatgtttagctggcttcttaaattttgtttagttactattctaaagaaaggattaaaatatatgtgtgattttgcagtaaatagcttcatttaactggttcccattgcatgtttgttcctgctaacttacgctgtagtattttctgttgtgtctttccttttagtaattattttatttgcttttaggtgtgtcttgagagtttttctttattgtggaaagatgtgcttctaattactatgtgatacagctaaataacaaaaagcaattatgaaaagttataattaaagtataattaaggatcatggaaagcaaaactaggtttaggaagtttataattttgttttagaattatagaaattatggacattacctgttttattatgatttttccctgatcatgtgaacatttcaatttgaggagcatcatgttaacctctagcttgttataactaattaggtggatctctcagtccttgaaatctatgtattcttttgtttctgctttctttacaaatgactaccctgtctctccaaaaacatcttctcccatcttttggtttggttgatttatgtgaaatatgaatacagacagaggcctttaagttgtaggagcatcattcagtgataaactcttccagaggaccagagcagcaggacatgaatcaaggtatctagagtttgtggaagccttcaagtattatggggccaggttgacatagctgaattgtatagtcttttacttaaaataagtactagtaactggattagggaagtatgttaataatctagatgtttaattagaatagatgtttgttttgacttttggtatcagagtaaatcataaaataatgaacatagcaaaattttacataggtgaattctcaagtacataaaatatattgtataggtaagtggatctcaacttgtttttctgtttcaatataactcatacacaaccgtaatcacaatgctaatgaatgtgtggtgagaaggagttagaatttactatagtgaaggccattgtagtttgagtcccctcccctgcaataattctgaaatttcccccagggtagtacttactgcggtctcttctttaaaaaaaaatcactcttttaaaatatatttttcctaatagttttagatatttcattaccttaatttttctgtatttaagaatttaaggcaattttaatgcatgcctatacaaagaagaagtgtccttaattctgaaattgtttggcccaaagctacactgattggtgtgtgatacttgtcctttgcatctcattatcactttttcctagtgaggccctactagatccacgctagtgaggaatccagcgtaatggactttggtttctttatgctaaccatatttctgtaattaccaacttatatttaattcattatgtattttattagtcaatatatagcttttatttaaaatccatttctgtattcttttggcagttgacgtctggagattttattttgaataaaaggccgagattttacttatattaaattttaaaagtgaaaattatatttatatatagtaacattaagaactcttaagtatagttccttatgttaaggacagtaattcattacttttgactttgagattaatacttagaattatgtaacattatgtagaaatagttctctcttataatggttcatcattttctttctttggttttctttgaatggttttatttagttattaaaagtttaagaaacttgtgtttttttaaagaattggactggagcgctgattttgcatttagaattaaaatttttcatttggcaaaataactatgtattacataaacatacctcatatcatttgctgtgctgggaaaaataaatcagtcacgatggtacctctgtatctctttatcttctatctcagccaaaagttagatatgcaaagggcaataatagcatgggtagaagatatccaaactttgagaaagggtttataaacgaagatgcatggaaaagttgccgagcttcattttgttataaaatagtacacttatgggcatctgatctaaataatatttaaatattattttctagcaaagatcttcaaggaccagatgcagtttattttagagattttttttatatcatgtgatgtaatattcttaatagatttgggaattaatgtgttgatttacttctaggattcttaatcattcaacttctgtgatgagaaacaagccaaaacaaactgtggaatgtgaaaagaggtataaaaatatcttagtttttacatttaatattttataatgagtattgatcctttgacagtgatgtttttgtatataggctttaattaaataagtgatacagatttaatataactagataatttaaataggaaatgttttagaacatgagttaaatttacttttgatgtaagcaaaataaaaaatgctgatcttttttgctcatagatgcatttttgtcttgatagaatcatttatttgttcattcagtgaacatttattatattgctattcctgccaggaataatgtgtttctttatcattgattgtgtttattctctatgatactgtttatgttttcatttcttttcaattgggtggtactaaattcttctatgtgaatacatgatataaatccacatatatgaattcctgagaactagaagaccttgaaagtttctatttattctttttgatggtttgaatttagattagactcaactcctgagtcaatcctctgagaatgttcaggcccagtctttttctgcttggcttattccagcagtcccaagacatagctcctttttttcaggtttgcctagctttaagtctgtcttctgcacaatggaagagtgataattctgaaacaaatcttacttgtgactcccatttattatcttctaatgactctttacaacttttagaataaaccttaaaatatttaacttaacccataagattgaggtgggtttctgcttaccctgagagcttcatcttgtacattcccccactggcaccatttgcatttaggaacagaacttctttcttcattctcttggggaagttatttagcttactctgagccacatttaccccttctataaaacacaaataataacagtgtctacctcatggttactgtaaggatgaaatgggttaatgtagtaaattgcttatgacggtgattagcacacagaaagtgtcacatatgttattagttgttaaactaagttattactattgtgaactttcttatttttcctttcttttgtatctcagcccttcctttttcaattctaacctccttttttgttcaaaagggaaatagctttgtgggtattctttttctggtattaagaagtattatatgaccttaacttttttttctttttttaaattatactttaagttctgagatacatgtgtagaatcggcaggtttgttactaggtatacatgtgctctgatggtttgctgcacgtatcaaaacacattaaattatgggaatatattttaaattctgtgacttttttcagcagtacgtgggtgagcacaccccaccccttccccacctttagaaaaatctcacatactttctgttaacaaaaatgagatcatactgagtatactatttagtaatatgcagttttcacttaatattatagtgatggttttatatacctactaaatctaaatatacattttgatgaactttatatatcctgtacacttgtattttccttccttccttcctctctttctctttctctctctctctctcttttttttttttttttttttttttgacagagtcttgctctgtcgcccaggctggagtgcagtggcgcggagatgagatttcaccatgttggccaggctggtctcgaactcctgacttcaagtgattcacctgcctcagcctcccaaaatgctgggattacaggtgtgagccaccacacacctggcccacttgtattattttcttaacttaaatgcttaaagatatgttattgatggattaaaacatgagtgtacatttaaagcttttgatatgttgtctccagaagcttttatgtttgcattcccacaagtaacacatggatagctttacttccatacttgttaacactatacattatcaatctatttaatctttgccattctaaaaagaacaaattatatcaaaatgttttatttttcatttcagtgattaaattagtgatgatgagtattatttcaagtttttattgcctatctatattgcttcttttgtaatttgtttgtttgcatctgttgtggtcagaagcactttctattgttgaaatatattgagtatttttatggcccagaatatggcctatcatggtaaaagttctttaggaacttggaaaaaaatgtattctgtggttattggttagagtcttatataatgtcaactatgttaagttggttgatagtattgtttaaatcttcaataccttacctattttctgttttcttgttctatcagttagtaagagaaggttattgaaatctccaacactaattgtagatttatctttctccttgcagttctataatttttccttcatacattctgaagctctattattagatatataaatgtttaggattgtattgtcctcttggtgaatttgtactgtcattctgaaatgacttttctttatattcttgataatattctctgctctgaagtccacttttctgatattaatattgtcagtccagctctcttttgtttagtattagcatgatgcgtgtttctccatccttttatttttaactgatttgtgtctttgtagagaaagcgcatttcttatagttagcatatggtagtatcttcctgctttttattgaatctgacaatctacgttctaattgcaatgttaaaaatcatttatgtttttgtaattaatgatattttgaggtttgctgtatgttttctttctgttctatcctttttattcatttttcctccttctctgttgtcttttgaattatatttaaaaatttttgtttatttcctttgtgggcttatttgctgtaactttttgttatgttaatggtttttttaggggttagagtatgatatttagcttatcacagtctatcttcaagggctattatgccatttcgtgtgtcatgtgagaaccttagaacagtatacttattttttttcctttttagccttggtgtgttgtcatacattttactttttatgtatctgttatgtgtaccataacaagttgttatttatgctttaaacagttatttgttcttaagaacatttagataatcagaataatgtcttttatgtgttcaatcccttagttactatctccagtgccctttattttttgtgtagattcatatttacatgtgcatcactttctttctgcctaaaagagagattttaacataattttactactggtctgctgattgaatgcttttagcttttctatgtctgaaaaagtctttttttaaattttttttttttaaacaggatcttgctctgtcaccgaggctggagtgcagtggcgccatcacagctcactgcagctttgacctcctgcactccagtgatcctcccacctctcagcctcccaagtaactgggaccacaggcatgtgtcatcccacccagccaacttaaacatttttttttttttttttttgtagagacagggtctcactatgttgcccaggctggttttgaactctcggtctcaaggaatcctccttccttggcctcccaacgtgttgggattacaggcatgagctaccatgcctagctcaccttcgtttttgaaagatattttggctcatacacaattctagtttgacattttagttttcttcgagtaccttgaagaggtttctccaccatcctctggattgtactgttttctatgagaatattcttatctttgttttactttgcctaatgtgtccttttttcctctgggtgtctgtaacattttttatcactcgttttaagtaatttgatggtgatatatcttggtgtagttttcttcatgttacttttgtttggagttcattgagcttcttgaatttgtgggtttattttcatgaaatttgaaattttggggcccttatttcttcagatatgttttctatcatttgacctcttctattatggaactccaattaggccacttgaagtttgccatggaacattgatgttctattcattctttaatatttttctgtctgtgttgggttttggcaagtccttctgctttgtctttgtgtttgctagtcatttcttgtgaaatgtctaatctgcagttaattccatccagtttgttttaatttcagatgttgcactttttatttctagaagtttgattatgtctgtacttaacatgttcagtcttttcctttagcttcttgaacattgcttggttgaatttttgattaaatgacagacattgtgtactttacattcttgagtgtggatattgtattattatacatacttttgacttttgttctgggatatggttaaattacttggaaataatttgatattttgggacttggttttataatttatttatgtgggaccagtgcagcatttagtctaggaataaatttgtccccttaatgaggcaagacatttctctactggatgtcctgtgaattatgaggttttccagtttagctggtgggaactggtactactcctggtcctctgagaatctgggaattattccctctaagctttgagggtgattttatccttttgcctagggtattttcctcacatacatgttcaatgatcagtacgctcagatgaaaatttgagggatgcctctgtagatctctttcctttctctgtgcattgcccttttgtttgttactgtgtgctatgaactcactctgcccttttctccctggctccagctctgtctcctgaattctgggcctgctagactctgccttagtttttttctcctgggatgtggactggaaactctttccatgcagcaacttggctcagttatgggatttacctccttactcatctctaaaggataatgtcattttttgcctaatattcaatgtcatggaaggcataattttaaatattttgcccattcttttagttttttcagtcaggatataaatctggtcactgttagcctatcttggccactagcaaagtctagtttttacattttatgtgttcaaatttgttagtatttaattttgattgtttgtcccataggctctctctattccaatatttaaaaaattactgcctgtatttttctgatactttgtgatttcttctttatatttaaatcttttaatttttcattttgatatttggtatgaggtaaggaatctagttttcttcctcccccacctttttctcactgtgtctcctcccccttttttattctttctttcagtgtatattttacacgtgatcaatcaggtgtctctctactacttgttatataagccattactttcacaatgatcttaaatgtcatttttttcagaagttattatactcgtggtcctgtactcctcttccattgaaaaatctgtagattctggagctagtagaaaggagggttgaaaagtcctctttattatataacttttctcttcgtgatcatccattcttccaaattaactttggaactcctttgtcaaatgtttaaaacaaaccaaaaaatacttcttgagttaaaaaaattattattacagttcatttcagttattaattaagttgaaagagaagttatacctgtaatacttatctatccaagaaccttttggttattcaagtctcttactagacatttgtagttttttcatgtaggtcttgtagaagtatagttaagtttcttcctaggtattttatacttttctttccttctatgaatagcatttttttctaatatatcttttaactcattatagttgatatgtaggaaagctattaacttttgtatgtttttctttaactggtaaccttacctcttataataatagattttttgtctttttctcttggataatcatgtgttctataaattttaaaaattggatctttatatccaatttttattttctttttgttattgcactatacagaaattccacaatagtgttaagttatagcagcttcagtggacattttgtttatatattttttccacaggaactccttgttcaaaattgccatctaacaacagcatgcatagtctgccttatctcaacaacaaaaaattagatgaaaataatttccttcatagcccctgttttgttagaatgaacaggttgcatctcataatcagtaattcagtaggcaaaaataactactcgcttgagctctttggcatttagacaaaggaaattattagttttttttagtctttgttaattattttaatataataaatatcctgtctgtcctttgacaatatatctttagatatttcacttattttagcttctgggaattccttagaatagacctatgcatagggcctacatagaataaacccattttgatatttcctgtagagcaacaggttttagaaacttaaatatatttctgtcaactttaagttttatgttgttaggccaaagtgtagacatgggtaaattctttacaatgtttttaaaaagataacatctaaggttcataatatatatttaaggatttattctaaatattttaacgtattaaggcatcttcaattttttagtgtctcagcagatgaagttaattcaccattatcacccctcacctggcaggtaagaagaaattaaattacaattatatctatcattttgttctcttttatttagttaaaataaattgtctcattatagcccttagaaaatcagaaggatcaaatagatgaacaaccgtggccagaatctcaccctataatctggcagagtgaagaaaggaggcggagcaaacagattagaaaagaatatttcaaggtactctatattaagtttttaaatttactttgtaattattagtttttattttgtcagttttgttttgagttaataaggtagactgtaactctctagttaaatgtagtaaatgtgttattttgatttctcacatatatggggtaatacaatctaattatatccataaggtttcagtaattgagaataattgagtagataaatataaattatgatttaccaaatactttgcaagatagacgaatgtttgctgcactgctagttgtagcaatatgtagtatgttttaaaagaattgtccaggaaaagtctttcattggatttgtttcaataaatatttgacacatatttacaattagcatttaactgttcctatgtaaataagtgttgtttatatagttctgaaaatgcttgagggcagatttttccatttttttcttcttgttaccttagtagattgcttgagtgtcttttatcttagctaaaagaaaagctcagatcatccaaattatcccacatttctagttagcagggttttaatgaaattttactgtgtacacatttgtaaatattgtattattgtctatttgtgattggggtctgctgtatttgtagaagccaatcattagaattcagaataatattcaatactagccagaattcattactggatttgactcaaatgaatagtacaaacaagcttctgctccatgaatagcaaattttgttgtctttgtacacgttttatgtttcccaaagcctaattattattagatgataatagtaatttcatctgaaacatagtactagtctacattgtaggttcaagtttatatcactaataaataggattatattctctgtttttctctggtagaaataggtctgtatgcacatttgtttgtttctatatatgggtgtgtaacatacatttggaaatagtatcatgactaaaacaaaactgttatatgtcttagtggatctgtggtaaatttaagccttcaacaaataaatactgagtccttttaatgagtcttacatttcctggtcaatataagagataacaaagaaacagaagacatgaggaaaaagggaaggacattctaagtagaaccctggtcaataatagtgaaagtttatttatcctaaccctttatacatctgtaattgtgtttacattccagcattattttaaagtttccctttttagttcattggaccttgaacaaagcactgaataaaatttgcttgtagataaaacttagtgaatgactgatggtatgggggaaattttagtagtatttcatataataaaagaaatttaatatttatttgctctcctttattgtagtataacaatacaaattcttagtatactaccaatatcgtagtataacaaaaccagttctcctttatcatagtaacaataccaattctgactatttgtcaaaaaacttacatagcacttattaagtgccaggcactgtcctaagacttcacaaagatcaactcatttaatcctcataacaaccttatgaggtaagtacaattatgactatttctgttttacagatgatgaaattaaggcacagagatgcaaagtagtattcttcagttcacttagtaataagtggcagagttgagatttgaacccaaagcctatgctaggctgcctctttatctactgtgtatagcttaatatcatatcagcaaacactttcaaacaaacacagttttactggtttttaatttttttttttaagagacagagtctctctctattgcccagactgcagtgcaatagcgtgatcatagcacacagcagcctcaaatgcctgggctcaggccatcctctgggctcacgtgatcctcttgcttcagcctccccagtagctagaactacaggtatgtcccccagtgccctacaaattttaaaattttttgtagaggtgagatcttattatgttgcccaggctggtctcaaattcctggcttcaagagatcctcccatctaggcccccccaaagtgctgagattactgacatttttggcccacttttagtgtttaaaaaacgttttacagtaacttgagtggacttctcaagatgtcttaatagaggccacattttaaaaatgtgcattttaaaaactgagcattttaaaaacataattctttggtttcatagcatcatttattggtattttattttttataaaataaacatcttctataatattagttatgttataaagttattaaaagagatcaaatgatataatatttgaagtgctcattacataatcatcattcaacaaatgttaatttttttccttaataaattaggtgcaaagataagcttcagtcactgggaaatgttttaaggagatgtgtagttctcctaaattgtcagaagatgtcagtattaggacatagtaaaatgagtatgtcactagttttttttcctaagatgtcaagaaaatataaaactgacatacagtttcctaaattaaatcaacactattattcagaattgtcactattttcatgactaaaacatcagcagcttctaagaggaaatttctcttaatcacctatctcccgataattgaaagtgctattggtaggttgtattattaaagctaatctggatttatagttcattaaacagtaaaatacactacacttgaggtttatatcagattatcactgagtttgttcaatggtggctcttttaggttttgctatgttacgaaatgtacagaacttttgtgcaactttatcttaatacgtataaatgactgaggcacaggatttctttgtttctgtcccatggtaaattatttgtcatggttattcagtgtatttattgaatgtgtgtgtgtgtgtgtgtgtgtgtgtgtgtgtgtgtgtgtgtgtgtgtgtgtatgtatgtaagaaatccaactgtatttcttcttagttttgaaggctaattttggatagtatttttttcaggtaagtccctgaaactaggtaaaactgtttcaacatattggctagattatgtgagcaagaacacaaattgggtcaggttaagttagtaagtaaatcatggtaggaaagttacattgactcttttagattcccaggccgctatcgtatagattattattctagtatataaaatttagtgttcttatagccaaaataaaatcactgtatttcagggaacttcatgatgccaggaagtattttattaaacatctttttttattttaaatttttaatttttggcgttcatattaggtatatatatttatgggatacatgagatattttgaaaggcatacaatgttcaataatcacattatggggaatggggtatctattccttcaaacatttatcatttgtgttatgatcaaattatactcttagttattttgagatgtacaattaaattattattgactatagtcaccccattgcgctatcaaatactaggtcttatttattctattttttatgcccattatccatcttcacctaccctctactcccccactacccttctctagcctctggtaaccatccttctactctctatctttatgagttcaattgtttttacatcctacaaataagtgagaacatgtggtgtttgtctttctgtgcctggcttatttcacttaccataatgacctgcatttcaatccatgttgcaaatgacagactctccttctttatggctgaatagtactccattgtgtatgtgtaccacattttctttatctgttcttctattgatggacacttaggttgcttccaaatcttggctattgtgaatagttttgcaataaatatggaagtgcagatatctctttgatatactgatttcctttctttgggttatatacccagcagtaggattgctggattgtatggtagctgtatttttagttttttgaggagcctccaaactgttctccatattgttcgtactaatttacattcccaccaacagtgtacgagggttcccttttctccacatcctcaccagtatgttattgcctgtcttttggatataagccactttaactggggtaagatgatacatcattgtagttttgatttgcatttctctgatgatcaatgatgttgagcaccttttcgtatgccagtttgccatctgtatgtcttcttttcagaaatgtctattcacatcttttacccatgttttaatctaactattagatactttcctaaagagtcgcttgagctccttaaattctggttattaattccttgtcatatgggtagtttgcagatatttcctcctattccgtgggttgtctcttcactttcttgtttcctttgctgtgcagaagctttttaacttgatgtgatcccatttctccatgtttgctttggttgcctgcgcttatggggtagctcaggaaatttttgcccagacctgtgtcctggagattttcccccatgttttcttatagcagttttatagattgaagtcttagatttaagtccttaatccattttgatttgatttttgtgtacaacaagagataggggcctagtttcattcttctgcatacggatatccagttttcccagcctcatttactgaagagactgtcttttcccccgtgtatgttcttggcagctttgttgaaattgagttcactgtaggtgtgtgaagttgtttctgggttctctgttctgttccattggtctgtgtgtctgtttttatgcaagtaccatgatgttttggttaccataggtctgtagtataatttgaagtcatgtaatgtgattcctccagttttgttccttattcccaggatagctttggccattcttggtcttttgtggtttcatctaaatcttaggcttgatttttctatttctgtgatgaatgccattggtattttgatagggattgcattgaatctatagattgctctgagtagtatggacattttaacaatattgtttcttccaatccatgaatgtggaatatctttccatatttgtgtgtcctcttcaatttcttccagcagtattttatagttttcattgtagagatcttttacttctttggttaatttctaggtgtttaattttgtttgtgagtattgtaaatgggattatttttaaaatttcttttttagattgttcactgttggcatatagaaatcctactgacttttgtatgttgattttgtatcctgcaactttacagaatttatcagttctatttttttttttttggtggagtctaggtttttccaaatacaagattatatcatctgcagacaaggataatttgacttcttcttttccaatttggatgccctttatttctttctcttgtctgattgctctaggtgggactcctagtattgtgttgaataacagtggtgacaatgtgcatccctgtcatcttttagatcttaggggaaaggctatgagttttggcttttattatgttgagatatatttcttctataccccagtttttgagagtgtattagtctatttttatgctgctgataaagacatacctgagactggtcaatttacaaaagaaagaggtttattggactgacagttccacatggctgaggaggcctcacaatcatggtggaaggtgaaaggcacgtcttacatggtggcagacaagagaagagagcttgtgcagggaaactcctgtttttcaaatcatcaggtctcatgagacttattcactatcatgagaacaacacgggaaaaacctgcccccatgatttagttacctcccactggtatctcccatgacacttgtgaatcgtgtgagttacaattcaagatgaggttttggtggggacacaagcaaaccatatcagagggtttttatcatgaaggaatgttggattttagcaaatgcttgtccggcatcaattggaatggtcatatgatttttgtcctttattctgttgttatgatgtatcacaacaattgatttgcatatgttgaaccatgcttgcatccctggaataaatcccacttggtcatgatgaatgaccttttaaatatattgttgaattcggtttgctagtattctattgaagatttttgcatccatatttatccgagattttggcctgtagttttctattttggatgtgtctttgtctggttttagtattaggctaatactggccttgtagaatcagtttgccagtattccctcctcttcaattttttgaatactttgagtaggattggtattaggttttctttaagtttttggtagaattcagcagtgaagccctcaggtcccaggcatttctttcctgggagactatttattacagatttgatctcattacttgttattggcctgttcacattttggatttcttcatgatccaattttggtaggttttatgtgtctaggaatttgtccatctcctctagagtttccaatttatcggcacatagttgttcatagtagctagtagtggcccttcgaatttctgtggtatcagttgtaatgtctcctttttcatctctgattttatttgggtcttctcccctttttatcttaatctgactaaaggtttgtcaattttgtttatcttctcagtaaaccatatttttgtttcattgatcttttttatttttcttcatttcaaatttatttatttctgctctgatctttattatttcttttgtttttgtttgtttgtttgtttgtttaaaccagagtctcactctttctcccaggctgaggtgcagtggtgtcatggctcactgcagccttgacctcccagggtcaagccatcctttcacctttcagccttccaagtagctgggactacaggcaccaccacacccagctaatttttgtattttttgtagagatggggttttgccatgttgcccaggctggtcttgagctccttggctcaagcgatctgcccacctcacgctcccaaagtgttgggattacaggtgtgagccatgacacctgggctgtttcttttcttatactaactttggatttggtttgctcttccttttctggttctttaagatgaatcattatgttatttgtttgaggtttttcttctcttttgatgtaagcacttatagctggaaattttcctgttaatactgtttttgctgtatcccataggttttgctatgttgtatttgtattatcatttgtttcaagaaatttttcgatttccttcttaatttcttcattgacccactggtcattcaggagcatattgtttaatttccatttgtttgtatagttttaaaaattcttcttcttattgatttctggttttatttcattgtggtcagagaagttgcttcatgttatctcagcaacttctttgttgtttgactgttttaagacttattttgtgacctaacatatggtctatccttgagaatgatccatgtgctgaggagaagaacatatattctgtagccactggatgaaatgttcagtaaatatctgttgggtccatttggtctatagtgcagattaagtccaattgttctttgatgattttctgtctgggagatctgtccagtgctgaaagtggggtgttgaagtctccagctattactgtattgagatctatctctcttgagctccaataatatttgctttatatatctgagtgccccagtattgggtgcatatatacttacaaatcactatatcctctgactaagtttacccctttttcattatataatgaccttctttgtctcttgttcatttttatcttgaaatccattttgtctgatataagtatagctacacctgctcttttttggtttccattggcatggaatatctttcttcatccctttattctcagtctatgtgtatcttcgtaagtgaactgtgtttctttttttttcttttttctttttctttctttcttttttttttttttggtggagtcttcctctgtcacccaggctggagtgaaatggcatgatctcggctcactgcagcctctgtctcttgggttcaagcaattttcctgcctcagcctcctgagtagctgggactacaggcatgtaccaccatgcccagctaattttttattttttgtatttttagtagagatggggtttcaccatgttggccaggctggtcttgaactcctgacctcaagtgatccacccccctcggcctcaccccaacattgctaagctaaagggaaaggtcaagctgggaactgcttaggggaaacctgcctccaattctattcaaagtcaccactctgctcactgagataaatgcatatctgattgcctcctttggagaggctaatcagaaacttaagagaatgcagccatttgtctcttacctacctatgacctggaagtcccctggccgcttccagttttcctgcctttctggactgaaatattgtttgtcttacatatgttgattgatgtcttgtgtctccctaaaatgtttaaaaccaaagctgtgctctgaccaccttgggcacaggtcatcaggactgcctgaggctgtgacacaggcactatcctcaaccttggcaaaataagctttctttttttttttttgagacagagtcttgctctgtcacccagtggcgtgatctcggctcactgcaagctccatccccaaggttcacgccattctcccgcctcagcctccagagtagctgggactacaggcacccgccactatgcctggctaattttttttttttgtatttttagtagagacggggtttcaccgtgttagccaggatggtctcgatctcctgacctcgtgatccacccctctcggcctcccaaagtgctggaattacaggcatgagctaccacgcctggcctcaagtgtgtttcttgtaggtagcaggtcattgtgtcttattttttcatctattcagccattctatgtctttttattttaatagtttagttcatttacatttagtgttattattgatgttttattctactgcggccaagatggcactcacaccacaatacaaagtccttgccactcttctttcccctttccacaggtagaggaacctctctcagtggccaccaccaccactggcccatgggaggttctgctagcccgctgctcatgttctgttaaagcccaagggctcttcaatcagcttgtggtgaatgctgccagtcctgggactcaccctgaattctggcttggggcaggtccagaaatgctgcccaagagccgaggcctagattcctgaactccaagagactgcttgttgcttacctcactgtgtctgagtgggttcctaaggtgccaaattcccctttgtttttccctctgcttttctcaaacaggagactctccatgtagccacgacatctggttttgtgctaagtcttaccggacgccagcacatctcagtctctcccaaggtccacagcatactacctgggtatttctgctggttattcagggcccaagggctctttcatcagctggtgatgactcctggcaggactgggtccttcccttcaaggcagtgggttccctttttgcccaggggtatatgtctagtaatgtcatccaggagctggggcctggaatgggggtctcacaactctggccagtgccccatcctactgtggctgagctggtatccaagaggtaagacaaagtcctcctcagtcttccctgtcctgtcctcaagtgaaaggaaggggtctctttctcattgctgcgagctgcactgtctggggttgggggaggagtggtgcaagcactcccttagccacccctgctggtgtctccctaagtcacatgccaccctagtacactggttctaagcttagcacagcactaggagttgcctagaaattgcaatccttgtgccctagactgcctttcaagtttacctagaaccccagagtactttggcctgcgattggtgaggttactgagaaacttaagttcaagctgctggcatgagcgattcccatctggttagggctgatccaaatgctcccgccatgcctgggtgcttgttgagcacagcacaactttgttcccctctgtggcagggcagcactaagttcaatgtaaagccccccagtccctgtgctctccctcccccaagtatacaggctttctctccctgcactgctggctactgtgggtagctggctaatttttgtatttttagtagagaccgtgtttcaccatattgtctaggctggtctcaaactcctgacctcgtgatctgcctgcccaggcctcccaaagtgttgagattacaggcatgagccaccgtgcccggccacaggtgaatttctaaatgcatttaataattgatttctagacaaaacagttaaaaagtattagagtatctgtagccagttagttttaaatattatttgatttatttaagtggcatatatgtcttcaaatgtatctcattactattatgataaaacataataactcataaaatacatattgatttcataaatatagtacactatttttatttaaaggttaaccccctggaaaatattttgacacattttctatgatcattgttcgttttatatgggagtaaagaagccactgggattgtaaaataacctgatttattctgagtcagagtttatgcacaagttattgtctctcttttgaaattattacaagcttctgaggctagtccgaattcaatggtgtttacaacgaattgctcacaattacacatttgtttattttccactcctgctgcttcacttgactagcctcaaaaaatatgtatatgtatatgtatatgtacataaaagcttctgagatggactgacctttctgtttttctggtttttaaactaggcctttattgtaacatttgaatttagatgtaataaaacttcagtaattcagaattcagattaatactagttggggatagccgagttgaattagtaaaaacttggaattagagagtattttcaaatctatgtatatattaggtttggagtttcaagacatttaaatatgtgcagtaatgcaaacttagcatctttctaagttttcatgtataatgagtattttaaattagaattatagttgagtaacagtaatacatttcccattttctaagttcttaagtatatcatcttgtatttctttgcatttcagttatcctcttattcttctatgtctttcctgcctctttacctttcaccttataaatatgctcaaacctctgttatagggaagaaaaagtagtatcttttccctactcgttgcaagaatgatagctgacaccccataacaaaagatggattaacaagagaaaagcataaaaatttactcaagtttttatgtgacacaggatccttcagaaatgaagacccaaagacccagggaaaaccgtatgttcatgctaagtctgatgaaagaaatgaatagttgtggagacacgtgattgaacaaaaaagggtatgatctaatggtaacaaactgggcctgtttgttgagaatcttttctgtgtctctctatgacattccttctccttcggtatgctgcaggaaacctgtcacatgcatcttaaagggagaagggaggaggtcagagagtgacctttctagattgtatggcttgctttgtgagacggggaattctagtttctattacctgccttagggagaggaaggggggcgaagaaaggggggcctggagaaggtcagagagtgaccttgaaggtgccatatcttggggtagtattttctgagccctgacactaccattatccctgactgcccttttagctgttgccttatctctttgctctcttttagggctaaactttcttttttttttctcttgagacggagcctcgctgtgtcacccaggctggggtgcaatggcgtgatctcagctcactgcaacctctgcctgccgggttcaagtgattctcctgcctcagcctcccgagtagctgggattataggcaccctccaccacacccggctgatttttgtatttttagtagagaaggggtttcactttgttggctaggctggtcttgaactcctgaccatggccagggccaaactttctatttctagttctccagtttctgatcattccttaacccactgcaatctggcgttcgcttccatttctccattgaaatagcccctcgctagattttaacatgcacctactaatggcaaaatccagtgtagcatttgacaatgatgaccacatcttccttcttgatactcctgtcttggtttctatctcatttttcttccctgttatcattttgatgtccttctctaacttttcttctgcttgctcttagggtctgatcctcattttattactctaaaaagctctctctggagtgttaatgactctagatgtttcttatattctgctgtgtctaaatttacatcctataactttttttctgttccctaaatctgtgtttctaattgtttggatgccctcattcccatcacctaattggttatcagccctaatatatgcatcgtttctgcaattcatgtctatctctattgcccttgccctttttggaaccctcatactttcttgcccaggcaattgtgataactgattaatggtcctcctttctcagccgttggataattctctggctttaaatttctttattctagtgttcagtagcaccataggttgactatagttaataataatttattatatattttaaaatagctagaagaaaagattgataatgttcccagcacaaagaaatgataaatgtctttgaggtgattaccctgatttgatgattacacattgtatgcatgtatcacaatatcacaagtacctgataaatatgtacaattatgtatcaataaaaaataattatcagacaatgtgagaaaatgcccttaaataaaactgtaaatctgtaaattttctcttaaatctgtaaaactgtaaatcatccaaaaaacttcttactggcttcccattaccaataagataaagtttggatttgttaaaatcttcgtggaccattccttctttccttttctatatttcattacctgccaaaattcactttcctcactagcctcattaaactgctctttgttttctacacaggctgtgctttcttagttctttttgcttttcttcttctgagaatgcccattagcccttttatctctggcaaattcctattaattagtgtttagaaatgggagtatagttgtccctctgtatctgcaggttccacatgcattcagccaaccttgattgaaaatatgtggggaaaaaaggcaaaaaaaaaaggtaaaaataatacaaataaaaaatatagtgtaacaactgtttagatatcatttacattgtattcagtattataagtaatctggagatgatttaaactatacaggaagatgtgagtagcttatatgcaaatactgtgccattttatgtaagggaagggacttgaatatctgtgaattttggcatgggtgaggcgggggtaggggtcttggaaccaatcccttgcagatatcaagagatgattttatggcacagtgcctgggcttatagaatcaaaccacttgtgttccagtccttacttggatacctattaactatgtgactttgtcaagtcatgtaaccttaattaagtttgttttttaaaactttataaatgagtgtaacagtacaggcatacttaagagatattgtgggtttgattccagacaatgccattaaagcaaatatctattcaataaagcaagtcacatgaatatatatcaataaagcaagtcacatgaatattttttggtttcccagtgcataaaagttatgtttacattgttctataatctaagtgtgtaatagtattatgtatgaaaaaatgatataccttaattaaaaatactttattgctaaaaattactcacaattatctgagccttcagtgagtcataatctttttactggtggggggtcttgtgtagatgttgatggtggttgctgaaaattgggtgaatatggcaatttctagtttgccacatcaatggactttcctttcacaacagatttctctgtagcatgcgatgctgttagatagcattttacgtacggtagaacttctttcagaattggagtcaatcctctaaaaccctgccactgctttatcaaataagggtatgtcacattgtaaatcatttgttgtcatttcaacagtgttcacagcttcttcaccaggagtaaattctaccttaaaaatccctaccttttttgcacatccattaaaagcaactccttatttgttaaagttttatcatgagattacagtaattgagtcacaactttaagctctacttctaggccaggcgtggcagctcatgcctgtaatcctagcactttgggaggctgaggtaggtggatcccttgagctcaggagtttgagaccagcttgggccaatggcaaaaccccgtctctacaaaaaatacaaaaaaattagctggtcacggtggcacatgcctgtagtcccctctacttggtcgggggtggctgaggccagaggattcttagagcccaggaggtcaaggctgcagtgagccaagatcacgacactgcactccagccaggtgacaaagtgagaccctgtctcaaaaaaaaaaaaaaaaaagaaagaaaagaaaaggaaataaaaactctacttttagttctcctgctgtttccaccacatctacagttatttcctccactgatgtcttgagcccttcaaaatcgtccatgacgatcagaatgaatttcttccaaactctcgttaatgttgacattttgacctcctctcatgaattataaatgttcttaatggcatctagaatgatgaatcatttgcagaggttttcaatttgctttgcccaggcccatcagaagaatcactatctatggccccaatagctttatgatatgttattacttagtaagacttgaaagttgatattactccttgatccatgcactgcagaatggatgttgtgcatgaaaacattgatgtctttgaacgtcttcatcagaactcttggttgactagactcattgtaaatgagcagtaatattatgaaaggaatctttttttctgagctcgatagtgggcttaacatattcagtaaagcatgctgtaaacagatgtgctgtcatccaggctttgcaggtctatttataaagcacaggcagaatagatttagcataattcttaagggacctaggagttttggaatcgttaaataaacattggcttcaatttagagtcagcagctgcattagcccctaacaagagtcagcctgttctttgaagctttgaagcaggcattgacttctctctatctacagcagtccaatagaaggctattttgtctacatagaaaatttgttgtttagcgtagtcaccttcatcaattgtcttagctagctagatcttctctataacttgcttcagcttctacatcagcacttgctacttcgccttgcacttttgttacgcagtcagcttctttccttcaatcttatgaaccaaccaacctctacagcttccagcttttcttctgcagcttcctcaccttgacttcataggattgaagagagggccttgctctggactaggctttgtcttaagggaatgttgtggttggtttgctattctatccagaccactcaaactttgtccatatcagcaataaggctgtttcactttcttatttttggtgtgttcactggaatgagtagcacttttacttttcttcaacacttattttgcattcacagcttggttaattggagcaagaggcctagcttcaccctatctctgctttctacatgtcttcctcactaagcttaatcatttcaagctttttatttaaagggaaagacatactatttcttttcacttgaacacttaaagaggccattgtgggattattagttggcctaattacaatattattgtgtgtcagggaataggagatagggaacaactggttagtggagcagtcagaacacatgcaacattgatcgattaagttcgctttcttatatgggcgtcgtttgagtcacccctcaaaaattacaatagtaacatcaaagatcaatatcacagatcaccataacagacatgataataatgaaaaagtttgaaatattgtgagaattctcaaaatttgacggacatgaagtgagtacgtgctattggaaaaatgacaccaatagacttgcttgatacagggttgccacaaactttttctgcacattttgaaactttgtatttgcacatttaaaaaattgtgtatcccgataaataaaatcactggaacaaaaaaactgatactctgattaaactgaattttatagcttgcaggacaccttgggccagcttggttttactctagctttcactgtcattccaccctgcttcttccttcaccaacattcaaattcttttccttatctgccagccaggcagatcggagaggcaagagcggtcttcattttcagtagctcttgattctttgatgtgagaggagcagcacagtcgtttaaacttgatccaacctctttgcatcttgcaaagtcaatcagccaaaagaagtaaaatatgaaggcaatgcttgtgcaatgtacagttcgttttcatgatgtatacctcattatgatttgtctgcttgcttctcctgtttggtcatttctttggaaggcagtggatttttttcttgtgttttttgtcttcttcaattttgacttaccaaatttctcaatcccagccatatcgggtttgttggatgtggttgccaaggaagtggagtaaggcgtttgagcaagcagaatctggtctgctcataactattaaattatttaataataaaagtacttagaattacacttgccacagagtaaccacttagtaaatattagcatattcactcaagtatcactgtttcattgacatagattaaaaccaaaaataagtgacttcagtgattgtcttgcctgataaataggattttttcacacgtgccaatttcattcagtggctctctggcacactgggttgaaggcatattgagattctgtgtgagatcacctggaaagaacatgctgctagattagtgatagttgccataggagagacagtggaggaagaatacgttttgtatttattatccctaatatagctcacttcccagtttttggctgagatatcaggttggttatctatttttccaagggttgtggttgagatatcaggttggttatctatttttccaagggttatggaagataatgctgcgtatgtaaaggggaccattaaatagaccaatggaacagaacagagccctcagaaataataccacacatcgacaaccatctgatctttgacaaacctgacaaaaacaagaaatggggaaaggattccctatttaataaatggtgctgggaaaactagctagccatatgtagaaagctgaaactggatctcttccttacaccttatacaaaaattaattcaagatggactaaagacttaaatgttagacctaaaactgtaaaaaccctagaagaaaacctaggcagtacctttcaggacataggcatgggcaaggacttcatgactaaaacaccaaaagcaatggcaacgaaagccaaaattgacaaatgggatctaattaaagagcttctgcacagccaaaaaaactaccgtcagagtgaacaggctacctacagaatgggagaaaatttttacaatctacccacctgacagagggctaatatccagaatctacaaagaactcagacaaatttacaagcaaaaatcaaacaaccccatcaaatagtgggcaaagcagatgaacagacacttctcaaaacagacacatgaaaaaatgctcatcatcactagccatcagagaaatgcaaatcaaagccacaatgagataccatctcacaccagttagaatggcgatcattaaaaagtcaggaaacaacaggtgctggagaggatgtggagaaataggaacacttttacactgttggtgggactgtaaactagttcaaccgttgtggaagacagtgtggcgattcctcgaggttctagaactagaaataccatttgacccagccatcccattactgggtatatacccaaaggattataaatcatgctgctataaagacacatgtacacatatgtttattgcagcactattcacaatagcaaagacttggaaccaacccaaatgcccaacaatgatagactggattaagaaaatgtggcacatatattccatggaatactctgcagccataaaaaaggatgagttcatgtcctttgtagggacatggatgaagctggaaaccatcattctgagcaaactgtcgcaaggacagaaaaccaaacaccgcatgttctcagtcgtaggtgggaattgaacaatgagaacacttggacacagggtggggaacatcacacactagggcctgtcatggtgtggagggggggggagggattgcattaggagatatacctaatgtaaatgacgagttaatgggtgcagcacaccaacatggcacatgtatacatatgtaacctgcacgttgtacacaagtaccctagaacttaaaatataataaaaaaaattgaccacaaatataactatatacaaatgtaaaaataataataatttaaaaaaatttacaaaaaagaaccttgaatgccaggcatagaaatttggacataatctgaaagttagtaggtgttacaacagggcagtcatgagttgtaaacggaaggttaatctgccactgatttgcaggatcatttgcagtgaagaggagtcagaagtaagaattccagtggttgtcatactgtattttcttgactctaagaagcattttttcacatataagcatggttcttatgtagtagggttgttaagaagattaaatgggttaatacatgtaagacatttaaatcagtgcctggcatatagcaagcactagtacaagtgttagctgtcatcattattacagttattgaacaatcaatatatacatttaatgtagtgttttttaacatgaaagcagtaggtttcttaataatgaatgacatcttagaatggtgagattatagaccaggtgtaagataatgagggcctggaaaagggtggtagttgtgagaattccaaagaagtaagtctgagagagattaaaaaaagaatcgacttgatgacatattggatatagtgaattaagaaaaaggaaaattctaagacaaccctcagattgcacacctgaatgaatgggaaatagcttggcttaagaaagaaatgttacttgatctgtataaagtacttataacaatgccttgcacatggaaagcattatttttgttagttattagtagtaggactatttacacctgttatatacttaaatttgttatcaggtaatgtaataaagctaccaaaatatgaaagaaccttgtacataatttactagtagagaatttatatgttcaagggaaaataaattatgtgttttaaatatttttcagtataaatcaatgaggaagagttcaagtggcaatgaaaatgatgaggtgagaaaagataatattaataattatttgaaatgtttacttatcatatgaagttggctcagtgagagtaaaatgtaatccatttttcagtttctttgttattgatttaatgcatggttttttttcaacaataaaaacatatgagcatcatcatacaattattaatttaatcatttaatttccatatgtcctttagaatggaattactaataattcagttttagaattttatcatcattcgtcttagacctgtcatatgtgagtgtgtgttgtctttcacatcttttatctttctaaatcagcctggtcgtcaattgagattttttttaggaactttgtttaggaactccttccacaaattctgcatgctattttaaaatttaaaattcgacttctacagtttgtgcattaccataaacctttctactgcacagtgtaaactatgcagcagcctatcattgttgaaaagatatattctcattaccataaatacttaagttttgtgtatttttgttggagagattggtatttaatttgatgttgggtacttggcagggcttctgaaaatgtcttcagttttaggaaatagaatcacacagggaaaaataatgaatagagccagatgattggtcgtctgccagctcagatgccgatttctctccattggcctctccagtagtatttactgggatgaataaaagtcagttatggctatagctggtcatattttcactgttagtatttatatttaagcctaaattacatgttttgtatgggtatgcttggcaatatttacccatgcatcagcacaatcagttcctgtacacctgcccaagctttccattgcaccaactccacaagatcccagcctaccctttaaatattattcccagggaatggcctactgtgtggtctctagcatgtcttcaccagctgtcaagccttcagtgaataacacctgtgtacctgctgaagcctctcagatttgtctgtagtccagacctctcccctgaggttcaagcccttgcaatattttatccatcttcctacctgcttagaatttctgctggatatatctcataaacccaataggactaaatatgttcaaaactgagtttttaaaaagtttttgcttctaaacccactttttcgctaatatccgacagtttgtgtagtggctctcaactttggctgtacactaaaattaccaggtgagctttagacaatactgtcgcctgggtcacaccccctagatattataatttaattgacatgtggtatgttgtggtatggactgagcaatgaagtttttaacgtttcccatgtgagtttaatgtccagccaaggttgagaactactgagttaatggaatcaccttccatcatctagctggagcaggggctggcaaattatgatccaggggccaaatttgacatgctgtatgggattgtaagtaaagctgtatcagaaaacagccatactcatttgcctatggctactttttcattactgtggcagtgtttgagtatagtagctctccttttttctccatttcactttccaaggtttcagttacctgtggtcaaccacagtctaaaaataggtgagtacagtacaataagacacttagagagagaccacatttacataacttttattacaatacattgttataattgttctattttattattagttattgatgttaatctcatacctgatttataaattaaactttatcataggtatgtatgtataggaaaaaacatagcacatatattataaagggtctggtactatctgtggtttcaggcattcactggggttcttggaacatattcctcatgaattgggggacagttagttgtcacaaagcctaaaatatttgtcatctgcctttgacagaaaacattttcttatccctgcctcctcataccctcttttctcttgcctgcctcaatatctaatcagcagccaagacttactgtttgtttatttgcactaaaatattttgcatacattccccttttatttctactgtttctgctccggcagaggccctcgtccatttcttgcctgttctactgcaataacttccttgcacttctccctttctctagtccattctcactgcagccagagtggtcgtttcaaagaacacagatgcaatcaggccattcccttgcttggaaaccttcagtttccccccataacttagaagataaattctagatcctcctttatcaagcccttgcttgccacatcagccttaattcacaacttgctcttctttcaccttaccctccattcaccttaccctccaacaagacaaaactgctcagaggttttctgcactcatctttacatttgttgcttccatgctttggttcttctcctctcatcttagcatgttgttcccttctttctttttctggtagacactcagttttttactgaatttatactttctcaggaaacttgcctttctctaccatcttcatcatcccccccaagtgccccttatctgtgcctcataatatgccatgcattgttctgtattatactgagaatgttgtattacctgtatacattaatctatttctgtcctcgactgaaaggtccttgaatgggtgatattttactaaatttcagtactctcactgtctagcatagtgtctgacatatagtaggtagccaataatcatttgttgaatgaatacattttctatgtagtgtgcatattcaaagttaaatgtcaaaattttcatatttggttggcagtagaatagtcatttaaaaatcatggaccatttaatgttttattaaattaaattctttgtaattatcaataagcctatattagatacatgtaaattttcagatgaaagttatttggggtgatggagattttgcatgccttcatttacatgtctcagattggtaacacgtccctgctattatatgtagatagtatttttcaaactttactatatttcgaaccacttgagggtcttactgaaatgtagattctgattagttaggtctcgggtgaggcctgagattctgcatttctaaactcccagaggatccctatgctgctggtttacagaccacatgtagagtggcaatgtgctggatggcatatctttagtaggtcttcctttagtagttggtcagaacaatttttattttccttttatatgtttaaatcatcatttgtattgtaatttcatcttccatctttttatttttatgttttagcaagacagtgataatgctaatatgtcaacacaatctccagtatcatctgaggtacaagttctgtttttatttgtcttaaaaatacgttttgtatgttttctgtgttttacataagagtcttccttgccagttctctgtaacctgattttttttgcaatataatttattcactcatattttaaaatccgtggcagattagtttgtacaaaccttctagcctataaaaaattctaagaatgccattttttggtaaaaatattgatactagcacttgtttatttatgattttctgtagtgtctgtagtgtctgtagtgatttttggaagtgtctgtagattgcagaaaagaattcactttatcaaatctatgctttctcattcatccgtattttaaaataaatgatagattttaagaacaactttcaaattttaaatttgaaaaaagtacttcagcattgtgcaatggcctttggtttttcttgtaaccagttaggtctgaaaccaatgcaaaagaaatttcctttttccacgagaaacatccctgcagtgggttgttcctatcgacaggaggttacacgtttttgggagaatgggtatcagaaagttagagtttgtgaaatctcgatcaaatactctggtggcttgaatgactgattcttctaatttatttattcaagtctattgctttacaacaagagataaatttaaaaaattctaaactctatctcttctacttaagattaccttaaagtgtattggcattagtaagtaaatgattacacattcatttgatgaattcaacactttgctcaaagtgttggatggcccaaattcactgtgtaactttggttacatagatgctgctaatatttcattatatgtaggtggtgttgcttttttaataggctaggattctttgttgttgtgggtgatctgcattacaaaacttttgaatggatttggacattaattttataaacatgtttctaaattattcatatgataggtaaaatggtatacacacttttagaaaacaatttaaattaggatatcttaaaattagtctttgtcatatgcttttgtaattcttttactttaagttacaagtataagcatataagtgactactacttatttgtctgcttgatatatgattttatgatctgtgttcacagggaagactattcataccaaatttcccaaataatttacattgatatatatatacgtatatatatacgtgtatatatatatgtatatatatgtatatatatacatatatatatacgtatatatatgtgtatatatatatgtgtgtgtgtatatatatatatatatatatatatatatatatatatatatatatatatatatatatatatatatatatatatatatatatatatatatatatatatatatatatatatatatatatatatatatatatatatatatatatatatatatatatatatatatatatatgacacatgatctcactctgttgcctaggctggagtgcagtggcacgatctcaggtcactgcaacctccacctcccacattcaagcgattcttgtgcctcagcctcccgagtaggtaggactacaggcacatgccaccacacctggctaatttttgtatttttagtagagacagggtttcaccatgttgatcaggctggtcttgaactcctggcctcaagtgatctacctgccttggcctcccaaaatgttgagattacaggtgtgagttttgtaatatattttttatttcatttggatcagtgaaattttcatctaggaattcatattaatttaaccaaaatagtgaagacaaactgggaggcttgtagatttggatagggtggtgagtatgtatgtgctttggtaactcaactgacatttaacctgaactgcatatcacgtgttaacagaagatttaggtaatctacagaattctgattacattaatttcatgtgtgaatggaaaagagtaaaactaattggtgtaatgctttagtattaacaaagtgcttgcctgtatatttgtacctaaaagcagccccataaaataggtatgatcctcatcattttacagctgaagagatgggtaactttccaaactatcttagttaataaatggcagagaagtgactgaagctgagccctactcacttcacagagttgttgcacagattaaataaggtgctgctaagattacattattttatcatcatttagttatctcatttaatcttcacagtaacctcatttgaaagatgaagaaacaatcacagagaaattatatgttgtgctcaaaacatagcctaagctttctaactccatcttcagatttgtttaatgtactacaaatctttccatagcaaaccactgtgtgtgaaagatttgaaaaaatattcattcaaatagaagagatgatatttatcatctatcattctgcagtccctatacaaatatgtttgccttcagattatctactgttaggtgttaagtccatagtagatgctgagtaaatgctaaattcacttaccttttcattgaagcttacttctttttttcggaaacttcagtctgattctttcaaaaagtatgatctattttatacagttcactaatgattttcattttctttctactatgaaagtatttaaagcctatatggttagctcaactagcaaatattagttgacctcttaaaagtgacatgtatcaacttgaattgaaatgcaagttacttttctcttcactaatcataggaaaataagtatttccccaaattggaatggatgtgaataagcaccttgattattttgaaagaaaagaagttttattatttatttatttttaactttttaatttttttttaggaatatgacagaactgatggtttttcacacagtccctttggcttgaagcctagatcaggtaaatagatattctgtaaataaaatttattagttatatatgaaactagtttcccagcttaaatgggattgattccatagtcttaagtacacatagattctttcccctctcctaaaagcaattttctcttaacgatatttgtctttccaattcccattcccatttctttcttcctctttaccttcaagctcctgaaacctcagctttttgccttagatatactgcagtcttatttctactctactgtgactgctgttagaatgaccactctgccagcagaccaaacactgtttgaaattatagcactccattatattgtggttttataaagggatcttttcgcatttggcaagcccaaaagaaaatggatccatgttacttgtcaaggtattgaactatagtttttattcctgaataactgtattgaccttcaagaataatttccttttttaaaagataaaaggctgacatatgttcagtaatcatttttaacctgggccataagtttctaataacgtatgtttgaataagaacatgtataggtggtagaaatcattacacttatcttccctgttgctttcaattatgcacataaatagagttcaaatatattctctaaaaatatttggaatgtattagtgagtaataatattttatgtaattttgtattgattcatcatgcctctttccccatcaatagttgctccttcccattaactttgtaacaagttaggaaatttctgtttttatagcttttagccgctcatctcgccaagaatatggggcagcagatccaggatttacaatgagaagaaagatggaacatttacgggaagagcgagagcaaatacgacaacttcgcaacgtaagtcagattgctctttcagatctgctttgtggaaatgggtttaacttggaaaattaataaggcgtacagatttcattttcaatgctccttaaaatgtttggatatacaacaattagtaatataaacatttaacatgtatgtttagatagagtatctgatttatacctgtttttctatagaatcttgaatccaggttaaaagtaattttgcctgatgacattggagctgcactgatggatggggttgttctttgccatttagccaatcatataaggccacgttctgttgctagtattcatgtaccatcaccagcagtggtaagttttgtttacaatttgttagttctctaaaggaagatatagcttcttaaaattgtctttaaataatatacctcagtgaacttagttttcagttttgattaagttccatagaaaaatgcctaaaagtacattttttccctcttactttacagcccaaactgagcatggcaaaatgtcgaagaaatgtagaaaattttcttgatgcttgtaaaaagttgggtgtctcacaggtaattgttatttatctaacaacgtgatcacttaaatttgaatttattacatgcaaactggggttcttcttagagcaatgaataatgctttctgaacatgaaaatgaatgccttctcttggtaccttctcctaagctccagctttcactgtagcagttatctaatgaatgtttttaagctacctttaaagtaatttataaaatagctacaaatatggaaaatcatgcacatcactgaccaaacataactcggtggccatatttacaacttggttgtgatgtcattgttaccatctttttttccttcttttttttttttttttgctagagaacatttggaccccattgtaattcactggatagattctgattggaagatttgcattcagtgtgaatagctttttaaactttatttaaaatgcaaaattggaaattataccagcatattatgataatacctgtattggacaaactttgaaatttttaggaattgtcttatgtttcatgtaataattgcactactatacaataatcattaaagcagtattgtaaatatgtaaggaagatatataatcacaatattgcttctttgtaaagtgttataaacctaacctcaacatgaatgactatggagagaaatgacattgttatcagagcacaattaagttgtgcttgttaagctgtcttttgaacagtgtcttaataatctggtctacagatcccactttaatctcttccctcaagtaagtaaacataatttaatgtgtagagaatctgaattgttgggtaatttggaaattacataatgttctctaattacctcttgtatatagttgatgtgatggttttgtttttgtttttgcttttgtttttttgagacagagtctcacgctgtcgcccaggctggagtagtgcagtggcacgatctcgtctcactgcaaccgccgcctcccagttcaagcaattttcctgcctcagcctcccaagtagctgggactacaggcacatgccactacacccagataattttttatttttaatagagacggagtttcaccatgttggccaggctggtcttgaactcctgacctcaagtgatccacccgcctcagcctcccaaagtgctgggattacaggcacaagccactgtgcttggctgatgtgatgttttaaatttttaattcttaaaaatgtttgttgtttcttttttctactctcaatctttcagtggggaaatagcaaacttagcaacgttttctgcagccattacattatacagattttcccgttttgccattttttcttttttaaaattaaaaaaacccctttatttatttatttatttatttatttattattatactttaagttttagggcacatgtgcacaatgtgcaggttagttacatatgtatacatgtgccatgctggtgcgctgcacccactaactcgtcatctagcattaggtatatctcccaatgctatccctcccgcctccccccaccccacaacagaccccagagtgggatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggcgtatatgtgccacattttcttagtccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgaacattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagttgaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattaatttttttataaggtgtaaggaagggatccagtttcagctttctacatatggctagctagttttcccagcaccatttattaaatagggaatcctttccccatttcttgtttttctcaggtctgtcaaagatcagacagttgtaggtatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcaggttaaggagattttgggctgagacaatggggttttctagatatacaatcatgtggtctgcaaacagggacaatttgacttcctcttttcctaattgaataccctttatttccttctcctgcctaattgccctggccagaacttccaacactatgttgaataggagtggtgacagagggcatccctgtcttgtgccagttttcaaagggaatgcttccagtttttgcccattcattataatattggctgtgggtttgtcatagatagctcttattattttgagatacgtcccatcaatacctaatttattgagagtttttagcatgaagggttgttgaattttgtcaaagttcttttctgcatctattgcgataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctgaaattctcttttttggttgtgtctctgctcggctttggtatcaggatgatgctggcctcatcaaatgagttagggaggattccctctttttctattgattggaataatttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagggtgtatgtgtagaggaatttatccatttcttctagattttctagtttatttgcgtagaggtgtttgtagtattctctggtggtagttcgtttttctgtgggatcagtggtgatgtcccctttatcattttttattgtgtctatttgattcttctctctttttttctttattagtcttgctagcggtttatcaattttgttgatcctttcaaaaaaccagctcctggattcattaattttttgaagggttaaaaaaaaccctttttttagagatggagtctgactgtgttgcccaggctggactggaactcctgagctctagacttccatttcacaaataactgggattacaagcattcactacctcactaatattatgtcatttttgttttaagggttttatttttagcttcattgcttttctctgaactcagaattggtaatatataataatttttaaattaattttctttgttttaggatgttttccaatttttaacagccttattgagttattaacatacaatatagggcatataaataaagtgtacaatttgatcaattttgacatatgcatacaccatgaaatcatcaccacagtcaaaataatgaacatatctactgccccccaaaatttcctcatgtgtctttgcaatccttctttctccagcaaccactaatctgctttctgtcattgcagattagtttgcactttctagagttttatataaatggaatgatacaatatgtattatatttttctatcttctttcactcagcataattattttatgactcgtcagtgttgttgcatgtatgaatagaccattgctgttcatttctggatagtattttattgtatggatataccacagtttgttaatcccttgacctgctgatggacatttgggttgtttccagttttagcggctgctacaaataaagctgctatgaacatttgtatacaagtctttgtatggatttatacattctttaatttttagtaaatacctagcagtggaataactggaacatatggaagtgcatacttaacattttaagaaactacataactcttccaaagtggttgtactgttttacattcctgtcagcagtatgtgagagttccagttcctccacatcctcactaacattcagtatgatcaatcttctaaaaattttagtcattgtgatatgtatgtactgacttgccagtgcagttttaatttgcattttcctaaagactaatgatgccgatcatcttttcaaggcttatttgccacctgtatatcttctttttgaagtactttgaagtatactttcttttttgaagtacatattctaatctgaggtatattttgtattgggttgtttattttcctatgattgaatttcagatttctttacaagttatggataaagacatttaccagatttataaatattgcatccaaatctttggcttgtcctttcattgtccttagagtgtctttcaaggagcaggatcttcacttattgaagtacaatttattttttaaaatgggctgtgctttttgtgtcaaacctaggaaatcttcgtataatccaaggccacaaagatttctttcctatgtttacttctggaaattttataatcttaggttttgtgttcatgtctatgatcaattttgagttagtttttgtatgtggttaaaaagtatggattgaagttctctttttttaagcctgagattgggcatatacattgatttttttaagaaaatatttttattgagatataattacaatgccatagcattcactgatttaaagtgtacaattaaatggtttttagcataatcacagagttcagcaacagttaacaacaatctgtttaaaatattttcgtcaccccagaaacacagcccttgcccattcgcagtccttcctctgttctttctatggatttgcctactctagacatgacatataatgaaatcatacaatatgtggtctttagtgtctggcttctttgacttagtataatttttccaaggttcatccatttgtagcctaaatcagtacttcatttctttttatggctgaatagtgttctgttctaaatacataccacatgttgtttatccattcatcagttgatagacatttggattgttatcactcattgtttattatgaataatgttgctttgaacatccgtgaataagtttttctttgaacacttgttttcagttctcttggttatacctagcagtgaaattgttaggttatatggtaactctatgtttatattttttaagaaactgacaaaatatgttgcaaagtggctgcactatttttacatttccaccagcaatatatgagggttctaatttcttcacatcatcaccaacaatggctactactgtctacctttttggttgtagctattttagtgtgtatgtgatgtgatatcttattgcggttttgatttgcgtttccctagtagttaatgatgttgagcatcttttcttgtgcttattgatttgtatatgttctttggagtaatgtctattgaaaccctgtgttcatttctgagttagattatttatcttttttttttgagttgtagttccttatgtattctggatacaaattgcctaagagatacatgatttgcaaatattttctcccattctgcaggttgtcttttcactttcttgatggtatcatttacagcacaaaagttactaatttgatgaagtgtagtttatcccattttttcttctgctgcttatgattttgatatcatatctaagaaaacattgtgtaattcagggtcacaaagatttacacctgtgttttcttctaaaagttttatagttttagggcttacctttttgtctgtgatccattttgagatcagttttgtgcatggtatgaggtacggatccaaattcattctttcacatgtggatatccaattttcccagcaccatttgttgataagactcttcttttccccattgaattgtctgtcttagcacctttgtcaaaaatcaggtgaccataaatataaggctttatttctggattctcagttttttttaccactaaattccttattccagtatcacactgtcttgcttactgtaattttgtgatgcattttgaaatcaagaagtgtgagtcttccacatttgttctgtatcaaggttgttttggctatactgagtcccttgcatttccatatcaattttaggattgattagcttgtcaatttctgcaaaaaagccacttgggattttgctgggattaccgaatctaaaatgatttggggaatattgtcatcttcacaatgtttattcctgtgatccattaacatgagacatctttccatttatttatatcttttaatttttattccaacagtgttttgtagttttcagtgtatgagtctttcattagatttgttaaattaaatgcttagtattttattctctttggtactattataaatataattatttctttaattccactgtcaattttttattgctacttcatagaaatagaagtgattttcttttattgatcttgtattctgcaaccttgcagaactcatttattagttctataatagtttttttgtgtgtgtttctgtgccttaggagtttctctttacagaatcatttaattattctttcaaagaattcatccatttcatctaacttgtcaaactattattatgaagttatttataatgtctccttattatcattttggtatttgtagaatatcttgtggtgtcacttcccttatttatgatattggtaatttgtgtattctctctttccttcctgattagcctagcttgaggtttatgaatttttaaaaatcttctaaatgaactaactttgggttgcattgattttttttatctattgttttttgtttttttactttattgttttcctctctcattctcattatttgcaccattcttttgccattggtttaatttgctcttctttttttagtttctagggtggaagctgaagtcattgatttgaagccttccttcttttctagcatacacttcagtggttatttgaataaataagcaaaatattaagagggcaacaaatatagcagtgaagatggagatgaggcaataattttgagaactctttatgggataccatcattagtatttggagaatgggttatgggagtaaggaagaaagaggaagactattatatttcacaggtttgtcaatggagattgaatagtgtattactaagacatggatcgcagaagggcaaattaatttggtaaagtagttctgttgtggacacattgattttgatatgtctgttagatgtccatttggctgtgtccagttgatattgtatttggagatcaatagagagatcttgggaggaaataaaaacttggaagccatcggtatggaaggggtagttaaaactagaaatagatgagaataccaaaagagagggtatagtgtaaaagagaagagagtgaagacagaacccttggaaacatttggaatgttggaagaggatcggtgagggctaattaatgaaagctactgcacaattgctgtcagaaaagttgaagtagaaaagaatggtgtcacacaagacaggggaggagtaaggttcccagaaaggcattaatcaaaggcataatatgactgagcagtcaactagacatgtgcaacatttgacatttaagatggcattggtgatttttactaaaatagttttagtgggcatatgctttagggttagatgtaagatagcagtggttgagtagtgagtgggaaatccaaaagtggtgaccaactcttttataaacattttctttgtagagaaagaggtacaagtgtggaatgacagcatttcaaacaaggccgacttctataatcttttttcttagtataaattaagaatctaaaaacattttagattacaatatttataagagaaaacttagaattatgtagttttcttgacattttatagaaatcatgtttttaaaatcaaattctgacttaattttattacacttctaaaaaatgaatgttcaaatatctcttttttttctccaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagtt

SEQ ID NO: 3641 - DNA, 122942 bp, human
ggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcaggtgacaggacggggggaggggaagctggctgtgaaggaggaggtgcggggagtgggtggctgcgtggctgcgttgttggactctgcgggtctgggcgggtgcgcggggaccgccagactaacaaagtcggggcagcccgttctcctgaacgtgaggggcgaatcaagcaataggggaggggaggaatgctgcctgaaggatgtatagaaactggtaggatgttaggggtgaaagagcatcattgttaaagcaagtttccccagtttgggtgggagggagtcattgacaccttccttaatgcacttctttcaactctcctggatcttcccgtctttcccggaaaaccaaacccaaccaaactaaacgaaacacaaaaatcataatctctacatattccttaaaggcatacgtgcctgaaagaatggcatatcctttttcagagtacagcagcaggattgccatggtttttctgtgtggtttaatcatcctacgatattcttggcttctttcttgtcacgtatgcctttaaagactgagatttttcattttcctggtgttgagaaggtagtggtggttaaattagtatttgctgcagtggtaaattaaatcatcaatcacttacatgtctgcttactagaagaaagctaatccttgttttgagttatcttagagtcttaatttttatagtagaaagccaacaattttaagggtatttttgagaaaaaattatctccattctttatggagttgtggattaaaggtttatcactttgggtgagaaattggctattgtaatgttcttcatatactctctggtagtctttgttgtggctggcattttttgttagggacacactctcttataaaccaatgctggattattttagatatgtcttgatttgatgaaaggtttttttttactttttataatctttaaatttgttatttatttctgttttcatctgctttgctgaaataaatctggacaaaattattttaatagatgtcgtcattttgaaacaatatagtaagtaaattcacccataatgaggagtagtaaaataccacttattttcaaaacaagacaatttcagatgtattcagtttttagatcttaaatcaaggtatttgtgttggaacaaagtggggagaggaggaaaacctaaaattgaagctttccacccagtgattcttttagcaatgatcctaagaactatgaatgtgtaatcgaccactgattttatattttgtaaagcatgttggagtatttactccttcactcagaacagatttcctaaataatatgttcacatattcatgactgttagcaagatattatgcaacttggtgtgttcttcaaaggcttcaagtaaaacagtttcagactgcatcattatagtgatttttttcttttcttcttcttcctcttttttttttttttcttattgttctttctaacctataaaggatccttctacctgcaggacaaagtttaagcatcctagcttggcattcaggactttcattgttgggctccactttattgttgcaaccttattccccaaaatgctcccacatagaatcctctcttccaactaggtcaactctctgtctctcaaatacattttgtgcatttctgcctcatctttgtacaagatcatctgtatgcttgggatttccctcttttctccgtctatttaattttattgaagccccagctcttccaagaaattgtctccaactcccttagtccacaagaatctcctgtttctttgaattcccatggtacttattgtctttaccacttacttggcagtgctggttttattttctttttatgtttctgtcttgctatccctgagaagaaatagagccccttaaaaggcagggtgtaagccatatacttgttcagtcttcttattatatatcccctttattgtatttgataatatttctcataaatatgaatatcatctgatgcagttacagcctttggcttttaagccttcagttggttttctgaggcaagcttcaacacaaagcagaaccatatctgttcatggtaaacattcattcatcataagtttcattttactttttctcttcagttgaatgagcatttcttgtgggaacatttcaaaaatcagagtaaacaagatcttgtgctgctcttttttttcatttaaattagatatctttgggtgactcatttgccatttgtttttgataaaatttagccacgaaatttttaggggcagtattttttaatgtagagagaccactattcattatgtgtaaatgacggcaggtacattggaactgaagaaaaatagagtgtgtttgagattatacatacatatgtacatacatacacacacatacatacaggaacacacatacagtatattctctatttgatgaaaatgatctgtttggtgatcttgttatacttaaaatgactcagtggaatactgtttcagaaccaaaccgattagttagacaagcattccttattgcattaggaagagacaagaggaagggaaaatagctaagaagcggttaatgttaatctaggtgagaggtggtgagaatctgggtgaaacaatattgaataaggagaaattaatacatttcaaaataaatgggggaaggtttttttacattaagatgaaatagacccctggttctccaccctggctgcacattacaattgcaagggagattttttgtttgttttttcaaccctgcctggatcccaccctagaccaattaaatcagaatctcaggggccaaggaacttaaggaaaaaaaatcttcccaggtaattctaatatgcactcagggctgagaaaccctaaaattgtttattttttaagcactcaagaaatatttgttctttgagtgaataagaacattgataaaagtttagttattaaccttaaagccacttgtcaagaaagtcaaaaccaaaactaggaactaaatactcaaaaattgtttcaaattgtttgataaatttacgtgaagaaaatgatgccccctaaacatgtagcagcaaaatcttttctctgctaacaggcttcctatgagggaaaatgtattttaggcagctgtttgcagagtttatctttggtgtctttttacctctctctgcatttctagtgtctgttcttcacttgcctcctccctttgtccccatcacacttttctcctttctctttctctcttcaacctcactcctcttactttattgggatagagctcaggtaaatgattatggcagcctctctaggagattaacatttaaaagggggagtttgctaatttacttgaatctccaattggtgattggagattcatgacctttttgagtagatctcccttccagatactccttgattaaaattttcacccacataaggacataaaacagtgatcagaaagttggtaacccatttcagtaaagtagctgactcttgctgtaatgtcttctccgagatggtctgtagatagatttgacaagatgaagggaaattgcatagaactttttggtccatctggatactatgataatttgttgacttgaaagtgaatttaattgttacccaaacaaatcctgaaaccttgcatagttgactctgtcaccagtgctacaaataagtggatatgtttcagcgtacttgctgctgctccctctgcttctttatacctgtttatgtacatgagcagtaggtctgtgaaacagatttaggaattcttacatcagattctgccgtgtcctggataatcacgtgttttcctgtaaaccaggagtcaactctagtatttcctacatgtgctggttcaccttttcaactgtagggcatggtgcattgtatcaggttgtaaaatggagccagataaacacagcatttgattttgtgaggtgaaggtcctctcagtgcatttagtggaatgagctcatgattgtgattttgtggccttattcaaatatctgccttgcttcatttaataaatgtcttcctgaaaaatcgaatgtgaagcacatttttgacagttgactcatattttaattgctatagattgaatctgaattactgaaccttgtactgatttattcagtgataagttctacagcatacttatcccttaatttctttcatttaaaataaaatgttatctttaattgaagggtacattcatcattaagataataccatttatacagctctttatacatttttaagtactttcatatatattatcctattgtatcctaataataaccctgtgagcttggcagagtacatagtaattgctcgttgtggttgagagacaggttaagtgatttgtccaaagttaaatggtgagtctggcagagtgtgtgggtcagagcctaggtttttcaactccagtgctatcctaatgttatttccagtgtaacacattctctctttataaaaaagcagttattaaacaccatgccaataaataggttatttattctgaaaattcaatgcttatttaacttcgtaggttatatactttttgtttgtggtatggtgtgttttgttttgtgtgtatttgcatagctatcatgcctctcttatggttttagaatagattcattaagcaagcatttattgaactcctactttggaaacatgattatggctaataaaaagagacatggtttttgtacttaaaggatttatacaatagtcaaatgtatacagtaatataacgattagaaaagaatttcactataatatataatagtattcaaaataatatattttaatatactgtacacataagagatctggaactgtggcataaggcttaattttagaggggattaatttagtttgagaaagcttcctgaaaagttaggttaggtatttgttgcatgacaggtataagaacagaagtggttgattgggatgttttaaaattggggttagtggaatacttttgcttaaggtttaaatttaatatttcaatttagattatttgtgatataaattctgaagcatttatttggcatgaaggtagacaagatccagaacctcactgagaacataagaagtaatgctagggacacttactacaaataaagataattgaagacttacaaaattgatttgctgggaggtgccatttgtttaagttcctaggcacacagtgaaactttgcaaaagaggcatcttgttctcccagcccagcctagcagcccactctgtgagatgccttaactgcatgatacacacctccccattctgcagaggctagtgatcatcatgacctagaaagggaaatattttagttttctttttttctctacactttgagtgtatttgggtgcttcttaaaacattgtaatactcttataatcagttatctggaaagtttcagaaagggttgtctgcttctcatttacagaaaaaaaaataccttacacgccagggaaccatttaatgtaattaaagaaaactgtataagccaatttaataacaatgtaagtttatgtttactctcactttcagctagtgcactcaatctgctaaaggtcaaactgtaatgtttaatctttacatttctcttgtttcatgtaaatagatagcattccattaacagaatacctgtcaatggactgtaatggataattcaacagtagatattttctaatgtattttttatatcaaattctttgaggaaaagttttttccaaataggaaagtaagttctttccttttcaggaacacttgattctgtgtagtcttttctaatttgtgacagagaatgttgtcactttatttttagattaattacttgtctcagtagaatattagagattcaaggtgacaagagacaggtataagataactgtgacataaacttttctttgaaccatatggagatgaactgattctagaacatttgtgaatttggatttcactcagaaatggctttttgttaatgattatgttcctaagagaatctagtatgtatagtctagagtttttcacttcttaaaaaaataattgcaatacgtaaatccttagtattttgagctacttggttggggatgtctatgtcaatgggaaataattacatttaaaggtttttgtgaattagaaatagtaaattaaacatagatgactgtgtccttaaactaccttaatgagtatgtaagaatggatttgtcatatagatattttgtaaaggttgtaaagttgctgctttcagtgagttaatgatttcataatggtttaaaataagaactcatatacctattatatcctagatcagtagttctcattgtggggaagggtagggttggagaggttgcctccagaggatatttgacagtatctggagacttttttttttttttttaagagacaaggccttgctatgttgccctggctatgttgcctgggctggaatatagtggctgttcacaggctctaactcgggggctcaagtgatcctcctgtctcagcctgctgagtagcttggactatagtcctgcagcaccacacctggctgaagacatttttgattatcacaatttgggggttgctactgacatctagtgggtagaggcaagggatgctgccaagcatcctacattgaaaaggacagccccatacaacaaagacttaacttgtctaaaatgtccatggtgccaaggttgagaaaccctgggttagagtaagataaatggaaagtgcagcataggttcaaagagggagggataacatttgatttggtcgtttgaacagcagaggggggctttataaagaagttggaggattggcctttagagaggaggcatcagattttatagttattcttagatggaggaaactacatgaatgctgatatctcagagtctcctcaaactcaatatgtcaaataatgaactctcgttattcaccctaggcccccttgtcacccagatctaaaacttgggagttattctccactcttccctttccctcagcctctatatctagtgagggactaaggcctgttggtcataactctttgaatagctttcagatcagtttcattcctttctattctcaatgtcattgttcagattctcctctattccttacctttaactggacctgtcagtagttttctaaatgatctctctgtctcaagttttcttcaacttaaattagttagtcctccacactgtagctaaaccattctttctaatatgcaaatctgattgtcatgtgttactaaaacaatgttactaaaacaccttcaagccagtagccagttttcaagccgtacgtttcaaaatcttatttccttattccttgttttgaacattaaaaaaagtaatacatacactatgttttatttaactgtggtaatttttatattttattagttaaaattaaattgctaagattcatccaaattgttatgtaaaactgtggttcattcttttggatggctgtgttatcttgcatcatgtgaatataccatctttattcactttctcactgatagccattttcattcccccctcctcctttttctcttgggaatagcactactatcattattatacatgtctcttgtacttgtgcaaggatttctcttgtgtatatacttgaaaatggaattgctgggttgtatagtatgtcagtgttcaaaccgatttatcatttctgtttccattgacatgtataggagatcctatgaatctatgtgccctccaaaacagtactgtcaaatttaaaaattttgaccaagtgtgtttaaaaaggtatttcgatgaagtctttcttgatttacattcccctgatcacgaatgatgttaacctttcttcagatgtctgttggtcatatgtctttcctgtactgtgaaatagcttttcatttattttgcccattttctgttggttggttgtccttttttaaaaaatagaattctatgggtttaaaaaaatactccttatactaatcatttgttttgtatattttgaatatcttgtttataacttgcctttttgctctttgaggggtgttttgatggacaaatttgtaaattttaatacagccaaatgtatcaatcttgaattttgtagtcaatgatttctgtgtcctgtttaagaatatgtaaaatatattcatctacattttttactaagagttttagttttgtttttggtattaaagttcttaattcatatggaatcgatttttatgtatagcacgaggtggagttccatgttcctgtttttacatatggattatcttttttcagatccatccttacctatgttggggctcagaaaacaatacccccaaatgaaggcctcagcagcagcctcagaagcagaagttttgcactgactttgtcctgccctcctgtctctctgtcccattctcctccaaggctagccgtagaaactagaatccctcttccccaaggaggatcacagaagccagaaccccttttcctgaaagccagccataagacctaaaaatattactctaatttcccctctgcctttctgtgtaaaaactggacacaaagaaatgatctaacctaccttgtttgactgtaggtcttaagacccccattccagagagggccctgccccacagtcagaaggaaggaatacaggctcagagaggcctagaagaatctatttaataggcagacaggccttgctaggtttccccactcagtctgtcagctttagaatatattctttttggccaatcatatttctgcacagctgggctgtccatactttgttgaacctaagcataaaataggcaattcctcctttgggtcttaattctgaaggctcccatatatatactttaagtaaacttgtatgccttttctgcttttaatcaatctgcctcatttcagtgatttttcagtgaaattgtgaaactttagggaccaagggccttggcttctgtatctacttcttttctccctttcttttttctttttttttttttttgacagagtctcgctgtattgccaaggctggagtacagtggcacaatcacggctcactgcagcctcaacctcccaggctcaagtgatcctcctacctcagcctcccgagtagctgggaccacaggggtgtgctaccatgcacagctaatttttgtatttttttgtagagacagggtttcatcatgttgcccaggctggtcttgaacttctggactcaggtgacccacctgccttggcctcccaaagtgctgggattacaggggtgagccactgcacctggcctacttcttttctttttaacattttattgagagttcacagaccaaaagtggaccaatttaaagtatattgttgattggttgttagctgtgcacccatcactataatttagttttggaatattttcatctccccctgaaagaaatcctgtacaaataaatccctttccattctccctgcctcctccccaaccaatcaaaccctaggcaaccattcatctattttctgtctctatagatttaccccatctgtacattttatgtaaatgacttaattcaggatgtgaccttttatgattggcttctttaacttactatgttttcaaagttcatttatgttgtagcatgtaccagtattatgagaattccaattttttttgcattctcagcagcagttgtttttatctttttgtttatagccatcctagtgggtatgaggcagtatttctttccttcttcttcttcttttttttttttcgagaccgagtttcgttcttgtcgcccaggctggagtgcagtgatgcaatctcggctcactgcaacctccgcctcctgggctcaagcgattctcctgcctcagcctcctgagtagctatgattacaggcgtgtgccaccatgcctggctaatttttgtatttttttttttttccagtagagacggggtttcaccatgttggccaggctggtcttgaactcctgatctcaggtgatccacctgcctcagcttcccagagtgttgggattacaagcgtgagccaccgtgcccagcgtgagtcaggatttcattgtggatttgatttgacttttcctcatgactaatgatgttgaacatcttttcatgtgcttattgactatttgtatattttcataagcaaaatgtctattaggaccctttgtccatttactaattggggtgtcttttcattactgagttgtaagaggtttttttaaaaaaaaaattctatattcaagttttttatcagatatatcacttgcaaatatttctttcctattctgttggttcatctactctgaaacacaaaattaaaacatactgatatcacctattttatctattttcttatgttgcttgtgctttttgtgtcatgtctaaggaagcattgcctaacccagggtcagaacgatttatccttatgtattctgagtttatagttttagctctttcatttttttacatttagctttactgcttatttaagttgatttttgtgtgtcatgtaagatcagggtccaacttcattcttttacatgtgggtatctagttgtcctagcaccattttttgaaaaggtcatttttttcttcatctgattgtcttgtgacccttgtttaaaatcagttgaccataaatgtcaagatttatttctgaactctcaattgtatttcattgatctatatttctgttcttaacccaataccacactgtattgattattgtagctgtgcagtaagtttggtaattgggaagtgtgaattttccgacatttttttcaagatttttggggctattctgggacccttgcatgaatttcaggataagctacacaatttctttggaaaatgcagaatgcaagttgggattttgaaaaggagtgtgttgaatcatcaatttgggggaattttgccatcttatcaatattaagttgtccaatccatgaataggggatgtcttttcatttatttatatctttaatgtcttttaacaattattttgtagtttcctatttttagtttttgatgttgttgtaattggaattttaaaaatttagtttttggattgttcattgctagtgtgtagaaatacaattgatttttataagtgatcatttatccttcaaccttgctgaacttgtttcttctagtagtcttttaaatggattcattagggtgttctatgtcatgtcatctgcaaatagagatagttttacttcttttcaaatctggagccttttatttctgtttcttgcctaattgtccccgttagaacttctagtttcaataatgttaagcagatgctgtgaaagtggacattcttgttttgttcttgaatttagggggaatatattcagtctttaaccattaaatataatgttagctctgtttttttcggtaaatggtctttatcaggtggaagaaattcccttctatacctggcttttcaaatgtttttatcatgaaagggtgttgaattttgtcaaaggctttttctgttctatcgagttaatcatatggtttttgtcctttgttgtattaacatggtatataatattgtttggtttttgaatataagatgaccccactttgcattcctgacctacctgcacttcagtttagtctcatactgcctcggacctctacattccagcctatcaaactataatatgtgctgctcgttgaaagtatcatgctgttcgatgcctcagggtttttctttttttttttttttcctgttaatatccttctttggctttccaccttgtgaactcctattgattctttgtatcccagatcaggcctttatcttttccctttcccctcatcttctacataacagtgattactctatacctctattatagccgctgtgattttgtattgcagtgaatatatttccttcaccctagtatgcaccatcaatttaataacttttctgacaaataaacaccacttcagtaaatgcatacatagatttcaaaaatgttagcattagaagaaaatatgcattgttgaattaaagaaatatgggttatttgtttgcatttccctttttattggttttagagttatttgagtatagtgactttgttgccactccagtagctagtagtacagtgtgtggtacatagtagttgtttagcatattttgttcaattaagcctgcttcttcccatgggtgcctttttgagtccctgcacaatttgtccctttggttttcctctgtgttttccactacttcataaatatataccctgttcttcagggtgtatatctgaacccctcattgttttcctgatttttgtttttattgttttgttatttttaaaaatgaaaaaaattagaaaaaagacatatcttgttattgcttcataagcagatatatgagtattaaactttaacagtttggaaatttgctgtagtttatatatatatatatatatatatatatatatatattttttttttttttttttttttttttttttttgttaagatggagtcttgctctgttgcccagactggagtgcagtggcgtgatctcggcttactgcaagctctgcctcccaggttcacgccattctcctgcctcagcctcccgagtagctgggactacaggtgcccgccaccacgcccagctaattttttttgtatttttagtagagacagggtttcaccatggtctcgatctcctgacctcgtgatccacccgcctcggcctcccaaagtgctgggattacaggcgtgagccactgcgcctggccggtttttatatattcttatactatgccgctagatatgtttttattttagagtagctggccgtttaaaaatatttaggttagcgcttcattaaaattgatttgaaagtactgtttatgatgttaaataagattgacattgaaaatactacattacaaaatgttttgaggattaatatgttcttttaacaaattctattttgaaaatcacgtttgtagatgaagtccaggaaaaatttagagataaatggacatttcatgattaggtttaggagttttctcggtagtatagctctgaattgtttaaaattgtgttttagcatgtcttggtcttactttgtcctcttactgtctgctctcctccattagccatgtgcaaagttaagatcccaggatctgctacctttcagttacgaagtttatcatccttagtaggatcagagcttaaaggcactcacaacagctctctgtattcactgcttcttctcttgcaaaaagcctcatcacttaatgaatgactaaactttctcacatttatcaatataatattgttgccttaaacatctttccattgtagtctattgtatactcttcttctacattgttctttcagaaagttttccttatgccaccattccactgaagaaaaatgtatggatgcaccataacttatttaaccattcctctatcattagatgtttaagttactgtttaatattaataaacaaccaggtgtaattgtgctcctggctttacattgctttctccccagagaaatttaaacttctttaggacagataatgcattctctatataaattctcgacagtgtttggttcaatgctatgactctctgaaatagtttataatagatgcttctcaaatttttaaactttatgggaaagagtgtgacaattttatatactgacttcctatactatttgtgtgtaggacaatgcctctgccatggtgccttggtgatcttgcatgtacccacataggccacataggcaaggctcaaccacaatctgtctcaagtcttgggggaatactctgtgatcctccttgatacatggtaagatagacttgtgaggagctgtcacaaggccatttcctatccacctctgtatcttacaggaggcggcctcaaggcagcttattatctcctattttcattttggtaaggcatgggagtttccttcaggcacagttgtgactataaaatgacatagctgcagtctagaattgactcctcaacaacagagcaacccactgtgtgtgttgtctttcatttagtccctccagtttgggtttctcttgtaggactagggacatggggagctgataccatactgatcatgccttctctgcctgtgttagtaataaaccatctgaatccatttggtcttgtcttactggcagctgccgccgtgctgatgtgtaggggctgcttgaccacttaatgtaaacaaatgggattttttttttttccagtttgtggaatttgtcattactttttaattggtcaatttattgtaaattgcttttaatttcaggattcagtggttagtgctttgctatcaaatagctcaggtaaggatggtccttgctctgtaaatacagtattattttagggggtacagcatgcagctataaaattagtcttaatctgaataaatcaaagataaagcaattagttttgtttagtacagtggcctgcacttggttttcttttttcttcctctcttctcaaggactacttttgttttgcaatctgaagcctgcttaagttgtcctggagagtcagttggatgcagacctttctcgtattatattagactttcctttctcatgcagtagaaaggtactaaggtatcttaacatgcaaataaaatgtatattgtatacacagatctacctgattttcagtggctggttgaccttgacctaggcagaaagatcaaagtcaaactgttgccagtggagggtgtccaggttcttggtgttttgaacaaagaattggacaaaatgcacaaagcaaggaaagaatgaagcagcaaaagctgagatttatcgaaagggaaagtacactctacagggtggcagcaggccgagcagcctctcacagccccgatacagaatgttcttgggtccaaataccctgctagaggattcccattggccactttgtgtttacctcatataaatgaagtgatggcctgcaatcaatctgattggttgcagaaagcgatgaaacagagcctaaagtgaagttacaaagctgcactgctatgttaacgaagacttggcgtgcaatcagtctgattggttgcaaaaaacaaacaatcagaggctgaagttacaaagttatacgcctatgcaaaagtctgattggttacagaaagcaaccaatcagaggtactttctatttcccatctgccatgcagaaatagtgggggtttgccaaggggctagtctctggtccttttgttacttaggtgtggaaagttagggttttcctttcagtttagttctaggaagtcagcgtgaaacggccctgcctccagatcctatactcctgcctcaaaactaattgaacatcatcaattctgatgtactagacatggttaagatacatgttttgccattggttacttcattaatcagaataatcataacaattcagatattaggggttttttttggtttaaaaaatgttacatgaaagcatgattttgttgaattaattaattaattaacttttttattctttgagacgggggctccctctgttgcccaggctggagtgcagtggtccaatcttggctcactgcaaccccatcaaaaactgagcgaaggatatgaacagacacttctcaaaagaagacatttatgcagccaacaaacataagaaaaaaagttcatcatcacaggtcattagagaaatgcaaatcaaaaccacaatgagataccatttcatgccagttagaatggtgatcattaaaaagtcaggaaacagcagatgctggagaggatgtggagaaataggaacacttttacactgttggtgggagtgtaaattagttcaaccattgtggaagacagtgtggcaattcctcaaggatctagaaccagaaataccatttgacccagcaatcccattactgggtatataaccgaagcattataaatcattctactataaagagacatgcacacgtacgtttattgcagcactgttcacaatagcaaagacttggaaccaatccaaatgtccatcagtgatagattggataaagaaaatgtggcacatatataccatggaatactatatagccataaaaaaggatgagttcatgtcctttgcaggaacatggatgaagctggaaaccatcattctcagcaaagtaacacaggaacagaaaaccaaacactgcacgttcccactcataagtgggagttgaacaatgagaacacatggacacagggaggggaacatcacacactggggcctgttgtggggtgggaggccaggggagggatagcattaggagaaatacctaatgtagatgatgggttgatgggtgctgcaaaccaccatggcacttgtatacctatgtaacaaacctgcacgttctgcccatgtatcccagaacttaaagtataataaaaaaattgttatgagtttgggggtacaagtgtagttttgttacatggatatattacatagtgatgaagtctagactattagtgtaaccatcactcgaatagcgtacattatacccattaggtagtttctcacccctcaacccgctcctaccttcctacatttctgagtctcagggttctgcaggtacatagaagttgccaggttttcttgccatcctcgccattcgaaattcagttctgtacatctgcctatattcgttgtgatagtgcttcgctttttcatagataaccttcctccttgccttttgaagtatgttttgggcaaacttctttctcaggcacttgatcttcagttctgtaaaattcctttactttttcttaagggtttctggcacagcaggaaccttcttcatcttctcttctacaccctccatggttccagctggaaaaagaggatgatttcttttcttttgggtagatacctaatagtgggattgccagatggaatggtagttctatttttagttctttgacaaatcgtcatactgttttccccaggggttgtactaatttacattctcactaacaatatataagcgttctcctttctccatatcctcaccaactgttattttttgactttttagtaatagccattctgactggtgtagggtggtacattggctgtctcaaaattttgtctgttttaatttgcatttctctgatgcttagtgatgttgagtatttcttcatttcatatttttcattttttcatatgcttcttggccatttgtatgcatacaacaaaagcggtgcttgcttattgtagaacatttggaaaatagaagcatagggaaaaaaatacaaattgcttctcattccagcaaccttgaataaacattaatattttggtatatttcctttatattcccaacactcatcatcttgcacatacctgtaggtctttataaatttatgtatggtctttaaagaaaactattgctgcacttggtgtatatagttttacattttaaatactctagttattatactgtgagcatatttccatactaaggaatcgagtctataatatgatttttaaaggctacaggatattccatgttaaagatataaaaatttgtttagcctttatcttattgttggacatttaagttgtttctaatttttactattttaaataatcctgaaatatgcatattttttacatatctctattaggtttcaatcaaaaattgctattaattgaattattggatcaattattatgaacagttttaaggaccttgattcactttgccaaattgcacttcagagaagttacctcattttgtattcccaccaatgatgtatggaagtgcctaattcaaaatagccttgccaacaccaagtgatagttttaaaacctttaaatttgattaatgaattatgttttttttttttttttttttttgagatggagtcttgctctgtcacccatgtcacccaggctagagttttgtggtgcgatcttggctcactacaacctctgtctcctgggttcaagtgattctcctgccttagcctcctgggtagctgggactacaggcacacggcacctcacttggctaattttttatttttattttttgtatttttagtagagacggggtttcatcacgttggctagtgtggtcttgaactcctgacctcaagtgatcctccggcattgacctcccaaagtgctgagaatacagacgtgagccactgcacctggccaaattatgttatcataatttttacgtttattttgattacagtgaggttgaagatattttcatatgcgtcttggtcgttgatagttttcattttgaaactgtttatgtccttggcccaggttttatctatgagttgttggtatctttttgctttttgatagactgaagtttttccttctttttatgtaacttaacctagaaatctttcatgtgtgaattctttctttatattaacactttgaaactccttccccattctaatattaggtgactagtcactataatgtttttcttaaagcttcattttcatgtttatctttttcttccatctggattttattttagtaaaagttatgtgataaagcaatagtatttgtcttgaaaatatagttattcaatagccatttaataagtaatactacattgatttgaaatgacaaatttataatacattttataatggttgaagtatagtgccattcttaaatatctctttgatgtttgaatgctgttacagtgattcattagtcattatttcttggtgaaactgaaaaacttactagaatttcctacagataactgcatagagctgcccctccctcttcttttaaataaggtcttgtctttccatgtggcttaattgttgcgagactcacagtcctttccttactgagcatgcacgtatctgccctctggttagcagctgtggtttccccttgcaatatctgtttttgtttgcacctttgcttctcaaggttcctgtgctgaaaatgagcctttcattactggttgcttcaggtcggtgagatctccttgttattgtttatcataattgttaactttgaagcatttttttccttcattttttccaatgtctacaagttgtttttttctctctgctgcacttatggttaaaattttaattcatcatggagtagcttagaaattctgtaatccatacatcttacttgttcaacaaggtctcagtgttatagactgttcattattttgtcctgcacaacacccttctagggaatactgaatcaagaaatcacctgtctttgcagagggcatctgttgaggcagatgccagagccatggggttgtcatttcccatcaggctccatccagtatcagtctctaatacttcaaagacactttccatccttgcatccgacagacagctgtggtgccttctgttttcttgctgcttttgtttctagtcttaacagttcttttagatagaaaaatagatgaggaattgctaacatttgagaacatattaatcagattttacatactgtaattgtgctcaaatttgagtaataatagttaccaaagaacagagaacatttaattttttcattttcatgttaggaaataagtatctgagttggctgattttatgcactctcctgaagacatatttctgctatatattttttatgttacaagaaatgaatataatggtctaatttccatcattttattttctatctttatgaacattacctatcattatgtacaagttgacaattttcccttcatttctattgattatttcttctagggattttaggttgttgcagaatatttagtcattaccaatagctctgaaataggaattaagtgattttggcactatttaataggtagtagtagattcagaaatgcagttcagatcaagtctagtgttcatctcccctcttttttagtcagtaagacttctgtgaactttgagacataccccaaggatgatgctgtattggtctagccccaagagctttatattatagaaactacaattttagtagaactaaatggaggtgattctttttgcattctttcactgaagtgttactatctaagcaggtattatttggtgttggagtggaataagaattgatattacctagagttggtgtctggttgagcttttgatttaccctaacatctcatgcttagtttatagttaatgtttaatggaattttgtcaaatggatgataaaggctgtgagtcaagtcaggatgctacctggcaaatatggagaatgaggcttggaaggtgaggatcagaatttgcttgcctctatcacagactctggaaatgcaggacgacagataatttgatattaagatatttgaatattttaccttgtatgttttccgtggttaggctgcaacttctaagccctgctggaaaaggaatggtactgttcaaagacagttcaccatggcttcatgtttctgcgcatcttacaagtgagacactaactgccctgtgttctgaactttattttcaatgatgttggtacagtgaacagctttgcaagataaacctactgtttgccttcaaaacaaagtgcagactggacgcagtggctcacacctgtaatcccaacactctaggaggccaaggcaggaggattgcttgagcccaggagtttgagaccagcctgggcaacatagcaagaccctgtcctttttttttttatgagacaaggtcttgctctgtctcccaggctggagtgcagtggcacaatcggctcaccacagcctcaacctccccaggctcaggtgatcctcctgcctcagcctccgaagtagctgggactataggtccatgccactacactcggctatttttttgtattttttgtagaaatggggttttgccatgttgcccaggctggtctcaagctcctagactcaagcaatccaccctcctcggcctcccaaagtgttgggattgtagatatgagccactgcccccacccaagaccctgtctcttaaaaaaaatagccaagcttggtggtgcatgcttgtagtcccagctacttaggaggctgaggcaatagcactgctttagcctgggaggtcaaggctgccgtgagctgtgatcacaccactgcactccagcctgggcgacaaagcaagatactgtcttaaaaagcaaacaaagaaaacagaaacaaaccaaagcaaagggcagatttgcttgcatccttggacaaattagatagtatttctctccaaagcaaaagataatcatgcttaatgttgaataaaataaagataatgtctcccttagaataaaaggcaggcatgcttactatgataaaagatttgggttccctcagctcaggttcctttcctataatgtgataatactgcatgtgcatgcatccatctgggcccatcagtgttgcccccatgagattttggggagtacggggaactgacccaaatatactgttcatgccatttgctgtgctgtgagcaataaaggcctctgtctctcacacgggagtctcatgtcttctgctagcatctatacaacagtgttaggctaacatactggcttacaagtagggcaaaatccgacccttcagagttcttgacaggtactcagcacaatgcttttggctataagatgttatcctcctttagacaaaatttgtttgactaattttctttaatccttgtttattgaattggttaaaaatattgaaaagtaataagagcccatctctttaaggggccaagaaagctgtgtgtcatctcagatgaaacaattttgaattggtaaattgggaaaagctgagggctttataatggtgttcattattctctaaaacaaaaattgaacctagaagtaagatttacattctgcctcctattgcaagaagcaatcttgggggggtgtgtggatgttgttagatttagaattcttctgaccctggtgtgtggttgcagtgggacagaatatttgagatgtgggacagaaggccacagtagtgtgttaaaggagtggaaaatcacacatagaacataggctttgaagacacatgagtttggaaccccagtgctgtcagttattactagcttttcattttttttacctttgggaaggcatgtcattcagtctatctttgcttcatatgtgtattagtctgttttcacgctgctgataaagacatacccgagactgggcaatttacaaaagaaagaaatttgttggacttacagttccacgtggctggggaggcttcacaatcatggcagaaggtgaaaggcacttgtcacatggtggcagacaagagaagagagcttgtgcagggaacctcccctttttaaaaccagcagatctaatgagacttactcactatcatgagaacagcacgggaaatacctgcccctatgattcaattatttcccaccagttccctcccacaacacatgggaattcaagatgagatttgagtgagaacacggccaaaccatataattctgcccttgactcctcccaaatctcatgtcctcacatttcaaaaccaatcataccttcccaacagtcacacaaagtcttaactcatttcagcattaactcaaaagtccacagtccaaagtctcacctgagacaaggcaagaccctttcggctatgagcctgtaaaatgaaaagcaagttagttacttcctagatacaatggggatacaggcatcgggtaaatacagccattccaaatgggagaatttggccaaaactaaggggttacaggccttgtgcaagtttgaaatccagtgggggagtcaaatcttaaagctccagaatgatctcctttgactccatgtctcacatccaggtcacgctgatgcaagaggtaggttcctatggtcttgagcagctccgcctttgtggcttagcagggtacagcctccctcctggctgctttcataagctggcactgagtgtctgtggcctttccaggtgcatggtgcaagctgtcggtggatctaccattgtggggtctggaggatggtggccctcttctcacatctccactaggccgtgccccagtggggactttgtgtggggcctctgaccccacatttcctttctgcactgccctagcacaggttgtccatgaggtccctgcccctgcagcaaagttctgcctggacatacaggcatttccatacattctctaaaatctagccagaggttcccaaacctcaattcttgacttctgtgcacctgcaggctcagcaccacatggaagctgccaaggcttggggcttgcaccctctgaagccacggcccaagctgtaccttggccccttatagtcatgcctggagtggctgggacacagggcaacaagtccctagcctgcacaccacacaggggccctgggactggcccacgaaaccattttttcatcctaggccttcagtcctgtgatgggaggggctgctgtgaagacctctgacatgccctggagacattttccccattttcttggggattaacattcgggtcctggatacttatgcaaatttctgtagccagcttgtatttctcctcagaaaatgggattttcttttctatcacattgtcagggtgcaaattttccaaacttttatgctgtttcccttttaaaactgagtgcttttaacggcacctaagtcacctcttgaatgctttgctgcctagaaatttcttccaccagatactctaaatcatctctctcaagttcaaagttccacagatctctagggcaggggcaaaatgccaccagtctctttgctaaaacaaaacaagagtgtcacctttgctccagttcccaacaagttcctcatctccatctgagatcacctcagcctgggtttcattgtccatatcattattagcattttggtcaaaaccattcaacaggtttctagggagttccaaactttcccacattttcctgccttcttctgagccctctgaactgttccaacttctgcctattacccagttccaaagtcacttccacatttttgggtatcttttcagcagtgccccactctactggtaccaatttactgtattagttcattttcatgctacagataaagacatacccaagactgggcaatttacaaaagaaagaggtttattggacttacagttccatgtggctggggaaacctcacagtcatggtggaaggtaaaaggcacatctcacatagtggcagacaagagaatagagcttgtgcagggaacctcccctttttaaaaccatcagatcttgtgagacttattcactatcatgagaaaagcatgggaaagacttgcccctgtgattcaattaactcccaccaggtccctcccacaacacgtgggaattcaagatgagattttggtgaggacacagccagaccatatcagtatgttaaatgagaaacagtaactagcttacaaaattgttaaaaggattagaaataatctatgcaaagtgcacagtactgtgatctagcatatagggtgtatgtgtataatatttgcctcaattccacttaggttattcttgatgtgaatttagagttctgatttcaagttatttctccattaactcccatgttccttcaagcagacaattctatggtgattactctaatgatgaagatgtgttcaaacagcacacttcattattaggaattttatcagaggtaaaaatcacatggccctctccttaatgtgtctgtttaatttccctctgctttcctcttataaggatacacgtgatggcatttttagggccagagataaaagtgtgtcaggctttcaaatattacctaggatttttttaaaaggagagactatggtaatctatattattaaacagcacttaaacttaagtttaacaatttgtgcaaaaaactctctctacccgtttatacactgaataagataagactaagactataattagtatagtataatagtataatttctgaaagtcattttgtatatttggcagaaatggtagccagtgggccaggaatttcaatgggccgcagatagaccaatctgtggctctgtgggtgcagcttgggagacagcagatttccattccatctgactcctctccttcttctctagcttccttgacctctgaagctcaagagtgatacagaacataatttagattgggttacttaagattattgaccaagatctctaatagactgccagcagttttacaaggaatgtcttgaaggaaggcaggaaacaggacacagcaatctgtctactgttgatttactgccaatactggattttatgattaaaaatgagacaagaaaaacagcttagtggttataaaggtgcttatccctttggatgctaattaactgagatatcgatactgcacaagaaaaaaatacacagctatgtaattaaaaaatatttacaatcattctcttattaattccaataaactatcattatggtatatattagtttcttgtgcctgccataacaaattatcacaaacttaatagtttaaaaaaaagaaaattagtctctcacaggtttggagactgaaagttagaaacaaatttaattgagctaaaatcaaggttttggcagggccgcactccctatggggaggctctaggggagaatccattccttgcttcttccagcttctgatggctactggcattgtgtggcacaattattccagtggctgcctccttctccacatggccccctcttcagtctgtctggtttaccctctgctttcctcttataaggatacctgtgatggcatttagggtccacatggatgatgcaggctaatctcatcacaagactcttaattacatctgtaaaacctttagcatataagataacactcacagattccagaattagggtctgatatctttgagggccaccattcagcctacaacaggaagataaatacacattttaatgtccttttttatgtggaaaaggtgaaccatttttataattgtcttttcccaagtgctgtttgttgcctaagaaggtaggctttgaaattgttgtgaagtgaatctcccacggaggaataagtgagcagttttccgatttttatttatttttattttttgaaaaagacagggtctcactgtcacccaggcatgagtgcagtggcatgatcatggctcactgcagcctcaacctcctgggctcaaaccatcctcccacctcttagcctcccgagtagctggaactacaggcatgcaccatgcccagctactttttgtatttttttgtagagatagggtttcgccatattgcccaggctggtctggaacacctgggctcaaatgatcctcccacctgggcctcccaaagtgttgggattacaggcatgagccaccgactgcacccagctgtttttttttcccccgatttttaggtggaatttttatttatttaattttttgctggaactcagttaaaataccagttttgcatgtatttctcaattatttgttcattattagtcatattttatttttctagttgccctagtatacatgttaattgatttttaatgtttaaaaagctcctttattgtatatcacaagataaacattttaaatcagtttaaattttattaattatagctatataaaagttaatcttcacttttttgatggaaaatatgagatgctgttagtgtgagatagttcaagaaattaagatacaaatagttttatgttatttcccatttttctttccaaggttgagtttttttttttttttggcactgttattgtatttacccaatgcttaggatgtttatactgattttaaatctgaaacacctaagaattagattttgctgagaccagctcagttgtggagaccctaacccagcggcgctagaggaattaaagacacacacacagaaatatagagtgtggagtgggaaatcaggggtctcacagccttcagagctgagagtcttgaacagagatttacctgcatatttactgacagcaagccagtgataagcattgtttctatagattatagattaactaaaagtattccttatgggaaacaaagggatgggctgaaataaaggggtgggtctggctagttacctgcgataggagcatctccttcaggcacagatcgctcatgctattgtttgtggttcaggaacacctttaagcggttgtctgccctgggtgggccaggtgttccttgccctcattccggtaaacccacaaccttccagtgtgggcgtcaatgccatcacaaacatgtcacagtgctgcagagattttgtttatggccagttttggggccagttcatggccagatttgggggcctgttcccagcaagatttattattctttatttaactccattaaattagaataataattataattttaagtggtgtttactaaataaatacatgaaatcatccagaaaatagtttatgaatgcacatttaattaaattccctgagggagcttctaatattactttgtaatttaactaaataatcttttatttggaggggaacgaacataaagaagcatgaaaaatgtgtagattagtaatgtcttgatattatttaaatcattaaattattcttgttattaatactgatgttttagtatatttttctgtccctttttggtagtttatttgcctttttatttcatttttttttgcatttttttttgtgagacagagttttgctctttttgcccaggctgaagtgcaatggcgtgatctcggctcactgcaacctccgcctcccaggttcaagtgattttcctgcctcagcctcccaagtagctgggattataggtgcttgccactatgcctggctaattttttgtatttttaatagagacagggtttcaccatgttggccaggatggtctcgatttcttgaccttgtgattcacctgcctcggcctcccaaagtgctgggattacaggcgtgagccaccatgcccagctgactttttatttcatatgttatttttcagaagttttaggtttacaaaaaaattgagcagatagtacaggtaccccatactccttttctccagctcatagttttcctatttttagcatcttacatttttgtaatgtattttttacaattaatgaaccaatatatggtacacttgatgatgatgaaaattgatgaagctatactttattattaaagtctgtacattaggattcagtctttgtgttgtatagttgtatgtgttttgacaaatgcatgtgtcatgtatgcatcatcacagtatcacatagaagagtgtaactgccctgaaaattctgtgatccatgtattaatcactctttgatatggtttagctctgggtccccacccaaatctcatattgaattgtaaccactatgtgtcaggggagggacctggtaggaggtgattggatcatgagggtggtttccccgatgttgttcccatgatagtgagttcttatgagatctgatggtttataagtgtgtagcattctcctcctgccctctgccttgtgaagaaggtgcttgcttcttcttcaccttccaccatgattggtttcctaaggcctccccagccatgtagaattgtgtgtcaattaaacctcttttctttataaattacccagtctcaggtggttttatatagcagtgtgagaatggactaatacagaaaattggtactaaagaagtggggcattgctataaggaaacttgaaaatatggaagcaactttggaactgggtaatgggcagaggttggaacggtttggagggctcagaagaagacaggaatatatgggaaagtttggaactctctagaaacttgttgaatagttatgaccaaaatgtgatagtgatatgaacaacgaaatccaggctgaggtggtctcagatggagatgaggaacttactgggaactgaagtaaaggtcactcttgctatgctttagcaaggagactgatggcattttgctcctgccctagagatctgtggaactttgaacttaagagacatgatttagggtatctggcagaagaaatttctaagtagcaaagcattcaagatgtgacctggctgtttctgaaagtgttcagtcatatgcattcacaaagagatggtctgacattggaacttatgtttaaaaaggaagaaaagcataaaagtttggaaaatctgcagcctatatggtggaaaagaaaaacccatttactgggaagtaattcaagcccgctgcagaaatttgcataagtaaaaaggagccaaatgttaattgccaaaagaatggggaaaatgtcttcagggcatttcagagatcttcatgacagcccttcccatcacaggcctggaggcctaggagggaaaaatggtttcatgggctgggcccagggccctactgctctgtgcagcctcatgacatggttccctgtgtcccagccactccagcttcagctgtggctaaaaggggccaaggcacagctcataatgttgcctcagagggtgcaagcctcaagctttggtggcctccacatggtgttgggcctgtgggtgcttagaagacaagagtggaggtttgggaacctctgcctggatttcagaagctgtatggtaatgcctgaacgtccaggcagaagtctgctgcagggccagagccctcatgggtaacctctactagggcagtgtagaggggaaatgtggggttggagactcacacagagtccccattggggcagtgcctagtgaagctgtgagaagatggccactatcctccatacctctagactgacagtttgtaccgagcacctggaaaagctgcaggctctcaatgccatcccctgaaaccagcgacgggggctataccctgaagagccacaagggtagagctacgcaaggccttgggaacccaccccttccatcagtgtgctctggatgtgaggcatggattgaaagaagattattttggaactttaagctttaatgacttccccattgtattttggacttgcatggggcctgaggccctttgattttggccaatttcccccatttggaacgtgtgtatttacacaatgcctgtacccccattgtatataggaagtaactaacttgattttacaggctcataggcaaaatgggacttgccttgtctcagatgagactttggagttggacttttgacttaatgctggaattagttaagacatttggggactgttgagatggaattttgcaaatgtgttgcagtgtgataaggaaatgagatttgggaagggctgtggcagaatgatatggtttagctctgtgtccccactcaagtctcatattgaattataattgccatgtgtcaggggagggacctggtgagaagtgattggatcatgagagtggtttccctcatgctgctctcatgatagtgagtgagttcttacaagatctgatggtttataagtgtgtggcagttcccctgccctgcctgccatcttgtgaagaaggtgcttgctcttcctttgccttctgccatgattgtaagtttcctgaggcctcccagctatgtggactgtgagtcaattaaacctcttttctttataaattactcagtttctggtagttctttacagcagtgtgaaaatggaccaatactctcttcctcttcccttattccctcttttcctcccaaattatggcaaccattgatctttctactaccaccatagttttacccttcccagaatgatatttactaggaatcctagcatatgtagacatttcagactggcttctttcaagaagcaatatatgttaaggtctctccatttcttttcatggcttgaaagcttgtttcctggaagctattccattgtatggatattccacagtttatccattaacctattgaaagatgcatcttgtttgcttctaaattttgacaattatgaataaggctgctataaatgttagtgtgaagactttgtgtagacattagttttgaacttatttgagtaaatacccaggcttgcaattgctgaattaagaccatatttatctttgtaaaagcataccagactgtcttccagtgtggctgttcttgttttttcactaaaaatttatttatataatttatggcatacaagtgcaaatttattacatgcatagtagtcaagttaggggattcagagaatctgtcacccaaataacatacattgtacccattaagtaatttcttattatatacccctctcccactctctcacccttctgagtctccattgtctatcactctgctctctatatctatgtatacaccattttttagcattcactaaaaaatgagtgagtgacaacatgtgatatttttctttctgtgtctggtttgtttcacttaagataatgaccttcagttctatccatgttgctgcaaaagaccaatgctttggctatttggactcttttttggttctatatgaattttatgattgttttttctaattctgtgaaaaatgatgttggtattttggtagggattgcattgaacctgtagattgctttgggcagtatggtcattttaacaatattaattcttctgatccatgagcatgagatatctttccatttgtttttgtcatcttcaatttctttcatctgtgttttatagttttccttgtagagatctttaacctctttggttaaatttattcctaggtattttattttctggtaggtgtggtaaataggattgacttcttgatttcattctcagtgagatcattattggtatttagaaatgctactgtgttttatatgttaatttttgtatcctgaaactttatcaaatctaagagttttttggtggagtctttaggtttttctagatataagatgatatcgtcagcaatctgcgatactttcacttcctcttttttgatttggatgtgttttatttctttctcttgcccgattgctctggctaggacttccagtactatattcaataacaatggtgaaagtgagcatctttgtcttgttttagatcttagttggaaggccttcagcttttccccattcagtatgatacatgggtttgttgtatatggcctttatttttttcaggtatgttccttctatgcctagtttgttgagggtttttttaccatgaagggaagcttaaccttatcaaatgcattttctgcatctattgagatgatcatatgttttttgtcctaattttgtttatgtgatgtatcacatttattaatttgcatatattcaaccatctttgcatccttggtataaaacccacttgatcatggtgtatgatatggtttggctctgtgtccccacccagatctcatcttatagctcccataattcctatgtgttgtgtaagggatctggtgggagatggttgaatcatgggggtgggtctttcttgtgctgttcttgtgacagtgaatgagtctcatgacatctgatggtttcaaaaacgggaatttccctacacaggctctttgcctgccaccattcatgtaagatgtgacttgctcctgcttgccttccacaatgattgtgaggcctccccagccatttggaactgtaagtccaataaacctctttgttttgtaaattgcctagtcccaggtatgtctttatcagcagcatgaaaatgaactgatacagtgcattatctttttgatgtcctgtattcaatttactagtattttgttgaggattcttgcatgtatgttcatcagggatattggtctgctgttttccttttttggttgttgtgtcctcgtccagttttggtattagggtgatagtggcctcatggaaagaattagggagaatactctcctcttcaattttttggaacagtttcaggaggagcggtattccttctttttatatttgatagaatttggctgtgaatccctcagccaagctccctcaacaatccctgagcttgtctttattgggattttttttttttttactactgattcagttttgctcttcattattggcctgtttagattttctatttcttccttgttcaatcttggtaggttgtatgtttccaggaatttatctctttcctctaggttttcttgtttgttgagtatatagttgttcataatagtttctgatgatctattgtgtttctgtggtatcagttgaaatatttccttttttatttctcattgtgtttatttggttcatctctcttctaggttagtctagctactggtttatcagatttatttatctttttgaagaatcaactctttgtttttttaatactttgtatttctttggtccctatttcatttagttctactgtgatctttgttatttcttctgctagttttgagtgtggtttgttcttgattttctagttttttgagatgcattgttaggttgataatttgtaatctttcttttttttgataataggcatttaatgctacaaatttccctcttaccactgcttttgctatatcccacaggttttggtttgttgtgtttccattttcatttgtttcaaaaaatttttaatcttttgtattaatttcttctttgatccaatgattgttcaggagcttgtgtaatatccatgtgtttgtatcgtttctgaagttcctttttgtattgatttctatttattccactgtgttatgagaaaataattgataggatttcatttttaaacatttgttgatacttgttttatggcctaacgtggtttatcttggagaatgttccatgtgctcatcgaaagagtgtatattctgcagttgttgggcagaatgttctgtaaatttgttaggtccatttggtgtaaagtccaatttatatctaatgtttctttgttggtttcctacctggatgatctgtctaatgccgtgagtggtgcgttgaagtctcccaccattattgtatctgtctatctctctctttaggcctagtgatatttgttttatggatctgggtgctccagtgttgggtgcatatacatttaaaattgttatagcctcttgccagattgatccctttattacagaatgaagttctttgtcttttttaaccgtcttttatttaatatctgatttaattgatgcaagtacagctagtgctgctcacttttggattttgtttgtgtggactgtctttctattcctttacttttggtctatatgtgtctttacaagtaatgtgagtttcttgtaagcatcatatagttggattatgtttttaaaatctattttgccaatctatatcttttaaatggggcatttaattcatttattttcaaggtttatattgatatatgtgagggtttgttcttgtcgtattgttaattgttttctagttttataaattctctgtttctttttcttggaatgtttgcctttggtttggtggaattctgtagtggtgccatttgattcctttttcttcctcctttgtgtgattactttaccagtgagttttatacttttgtgtgtttttatgatgatgaatatcgcttttacttccacgtttaggacttctttgagcatttcttgtagggccagtttagtggcgatgaattcctcagcatttgcttgtctctgaaagacttcatttcttcttatttatgaagcttattgctggatattgagttcttggctggcagtcttggttttttttatttcagcatttttaatatgtcattcccttctcttctggcttttaaggtttctggtgagaagtctcatgttagtctaatggagtttccttatgtaggtgacagggtgcttttctcttgctgattttattttattttattttttctgtgaagctgttctttatttcagggagaggacaggacagggagctcagtctttcatagcagcaactttcctcgtgatggccaggacattgctcagctcctcccgcttcctcttggtgtggatgtgtgtccccacccttttcttgatgaacttgagggcttgtttgtccttggagaccttcagtaactccatggtgcaccgctcgtatggggtgaagccacatacctcttggatcatgccccgcacacacttggtgtgtttggtcgggcgcccaaggctacgactgtgtctgggcttgctcaaattcttggtcaacttgtggcccttgttgaggcccacgaccatagtgtagcacagaaccattgctgctgctctgcaatggtggctgtggtggaatgctgtcttgctgattttagaattctttttactttagacagtctgattataatatgctgtggcaaactcctttttgcattgtgttttcctgggaatcactgagtctcctgtgtctggatgtctaaatcttgctatacttggaaaagtttcgtttcttattttgttaaataggctttctaagccttttaatctctcatatccctcaggaataccaataatttgtaagtttggtcattttatgcagtctcaattggcacatgtatacctatgtaacaaacctgcatgttctgcatgtggatcccagaacttaaagtataataaaaaaataaaataaagcaataagcaagttcaaaaaaaaaaaaaaagaaaaagctttgttcattctttttctttatttttgtctgactggattatttcaaaagacctgtcttcaagttctgaaattctttcttctgcttgatctagtatttcaaatgtattttgtattttcttcaatgaatcctttagtttcggaatgtgtgtgtgtgtgtgtgtgtgtgtgtgtgtgtgtgagagagagagagagagagagagagagagacttgttctgttgcccaggctggagtgtagtagagagcgagagtgagagagagagagagagagaaagagagagagagactttttcttttgcccaggctggagtgtagtggtgtgatcatagctcagtatgacctcaaacttttggactcaagtgatcctcctgcctcagcttcctgagtagttgggattacaagcatgtgccaccacgcctagctaatatttgtatttttagtagagacaggttctctctatgttgcccaagctggtcctaaacacctgggctcaagcagtcctcttacctcggcctcccaaagtgctgagattgtaggtgttagccaccacactcgggctttttatcttttaaagatatttatctccatgttataagtttttatttgtattctgaattgattttctgagttctttgtattggtttttagatttctctggcatctcattgagcttctttaaaatcaatgttttgaattctttatctgggattttgaggatttttttttcttttttggttaggatctactgctggagaattattacattcatttgaggccataatattacttagctttttcatgttttctgtatctttatgttggtttctgctcatctggcttcatagttacatctttttaaaaaaataactttcacgtggatgggggacttttttcttgaagatatgacaatgatgttcgttgggtaaggccttctggctttgcttccaggtgcatgcagtagtgaagactctgtataatttgtatggctatccttattctgttaatgtgttgttcttggtggggcctgtggtgaagttgtgcttgtgactggaatgcctgatgggcccatcatcaggttgtaatggtagcagaggtgtgctaagtatgtctatccttgtgacctgggacagcatatgctggctcctgtgttggcagtttccaggcaggctcatgtttgggcatctgggtggcttcctcagatgccagttttagtagcagtataccaggcagataagcaggctctcaagctcctgagcagttggagtagtgtgggtgatagaggtagcagtggtggtgagatagtctccttgttcccatgcactgtgctcttgtgttggaagtggttgcaacaggctgtgcaaactggcttctaggccagaaggtggtgctttcaggtaagagccagctgagactgtagaagcagggtgtttatgctcagtctctgtccccttggtgctcatgtgcccctggtggtagattgggttgtggaacacccagaacctggcccccacagttcatgttggcatagggttaggagggtgaagctgggtggatccagactgggcaagcttgtactcaacacctcccaatggcaagtgcgtgcatgagccatgatgtgggggtggggcaggcagtgtagtcgtcatgcccctggtgaaatgcttgggtgagaggtgactgctgctgtgctgaggtcctgccatgggtgccagggaggatgagaccactgctgtccctccctcatcccatctgtggcagccaacctggctgttctgttagtatggcagtttgcacccagcccataattcagccatgagccatagaagccagcacccagctcaagaccaagcctctgcagtaactcatcctgctcaggattggagcattgggagcctggttccagtgccagaggctggagcccatgccatgtccgtttcttagttttgattgtgggattccccattgatccccattcctgctcaagcccctgctccacaagatgcaacctgatcttccccaatggccaagactggtgctgcagattcccaggaccactcatagtttgctaagagctaggattaagaatcgcatcttactgtggctacttagttctcaggaattgtgtgggacccagggcatgttgcctccttgaagcagttccttctcacagtctcttggatgctccctaaatcagattcaggatttgggtgggtcagggtgctctgctgtggcctggactgtatgattccccagtgggaaagtggactgcagaaagatactcactcactctctcttagggattcattgccagttcccagccggtcttgaccacgacaggctgtctgcttttcttctcattcccagattttggagtttcctttcactttttctgttgaaccctgtgttccctgttgggtaatgtattcaaagtgtgattgtctacataccactttggtttttctaagtggatgaggtgtgctggaaatgtttttagtcagctatcttggaaaacaaaggtcatcctcctgtcactttttgaacttctttggttactgtgttttctcatgactattattttcagccttctctgcttgctgttttttctctactcactaagtgttggccttcctgatagcccattcttgatctctctaattcaatactctgatattaggtgatgccttccatttctgtgatttaatagaactaaccatattcctacaactttcaatttttttttttttgagatggagtctcactctgtcactcaggctggagtgcagtggcacgatctcggctcactgcaatctctgcctcccgggttcaagcaattctcctgccttggcctcctgagtagctggaattacaggcgtgcgccaccacgtctggctaatttttgtatttttagtaagagacggggtttcaccatattcttcaggctggtcttgaactcctgaccttgtgatccgcccacctcggcctcccaaagtgctgggattataggcatgagccactgtgcctggccacaactttcaattttatatatccatcccagacttcacttaggagatcaagattcatctgtctaatgcccatttaacagcccctctttgagtctctctcagatgtctcggtttatacagatataaacttgaacccttcattgcacctctgtttcaaaaaagcaaaaacctcaccagtagaagaagctacaaaaatcctgttacactcccactgtttattagatattattattttagctgtccaggccagaatcctgggtgccattcttgattctttcctctcatttcttccacatacctagctctttgccatcccctatgagtactaatttcaaaatatatttcaaattttatccattttctcttaaccctattcttgcaatcttaatacaagttactatcgtctaatctctgagaccactatattatttatgagtacttaatactaggtattatacagaataacaaactgggcatgattttgtttttaggatttcaaattacttgtaaacagtaattttgaactcccagaattctgaagttacaagaataagaggtaaaaccctaaatataaagaaacatatcctaaactaaaaacagtgacttcactttcttccccaatagaactgtgtgatgcttgggtatccagaggaggtaagccagaatattgggaaacatttatttctagtttagattttggtttctagtaattctattgtttttttagttattcagaattttatggtgggaggaggaagaatagaaattttcatattatataaacatagctattttttgccagttatacaattttacataaggttaagaatgagaatatatatctctctccttctctatatgtatctctatatattacatatatagtaatgcatatgttaatgttctgaataaggaatttactatattgctaagtgaataggcctcatcccttggaatgaggaagttgagcattactgagaggaggttgtttttatgagggcagaccagatgctaaatgaggtacattgagctaggctggatgctcttcctgacagaggcacaaaattttcttacatttttaactaaataagtatgagctagtgtgagcaaagtaaatttctatgataaggtaactaacttgatagttactcaggtagtttttgggggtttgcacctttggggacattatttgtctgccatgaatagaggttgttgctggcatctagtgggtagatgccagagatgctgctaaatatcctacagtgcccaggatagccccctacaatggttatccagaccaaaaaggtccacagtggtggggttgagcaactctcttctagagtatttatttttcaacccactgctataatgtcctaagtatttttcaaaatttcatttaacaaataaacccttaataggagtaatggttataacgattccatgattttatttttgtgaaaatttaaatgaatggaagtatatttgtgtgtacttgcaataatttaggagaggaatgaatcaaggatgaataccaggtttctggcttgagcaactcaccaggaggatgttgttgacattgagatgagaaaaaaaaaattgtgggaaaagatcttcatttcagatgttatatttgtagaatttgaggtgcctgagagatatcaaggtgaagtcctgaagatcagaacataggcttttagacatatccttaatttgcaattcatcggtatgtaaatataatttggatctaggttggatgaaatcacccagtagagtatcttttttttttccatttacttttcagatttactgagtgaacataatttttcataaacatttgatctaaatcatttttgttgttgttgttgctggttgtttggtttttaatactgggaacacagagattcagtttgaaagataccctaaaatcttaagagtagtatacaccaatccctcccactctccacccacaatctagttggtttaagtgagcagaatgatccatttttccattttaggtgagcagatgtttatgaaagatcttagaactgtttgcctcatttatcaggaacatttacaagggaagaagccattaatcgtatttcaacttgtaaatagaagaagactaagactcaggttcatatcttatacttttaacaagaacttgttgaaagaaacattaacaatttcaaactaattttaagtttttcctcacaaaagcataaaaatggagatcttaacaggaaattcttaaaaggtaaaaacaactcctacttatactagtccttgggtagttaacatagaacaggttcttctttttgtttctttgaaaaggaatttttgggcccaagtctgttcctgcttagtatctgctccggccttcccccctctcgaagcggcctccttgacggcctccgcccctgggcaccctgcagcctgaccggctgtaagaatcatgcaggggagggctgcccgtttccatgggcagagggagcccacgatccggtctgcctacccggtctcgacccctcgagtagcggtcgctccggccgtaactgttgctggatctgtcgtggtcgccgctgtaggcgtcaggcaagctgccctggtactcctcgtagtggcctcctcctccgtagcggtcgctcaggccgtaactcttgatggaactgtcgcggcccccactgtgggcgtcaggcgaggggcctcggtactcctcgtagcggcctcctcctccgtagcggtggctccggccatgactgttgttggaactgttgaggccgcggcccccgccgtaggcattgggcgagcggccttggtattcctcgtagcagcctcctcttccgtaatggtcactccggccatagctgttgctgaaactgtcgcggcccctgctgtaggcttcggtgtagtggtccccgctgtgggcatcgggcgatcggcccctgctgtgggtgtcgtgcgagcggcctcggtactcttcgtagtggcctcctcctccatagcggtggctccggtcgtaactgttgctggaactgtcacggcccccactgtaggcgttgggtgagtggcctccgctgttggcatcgagagagtgacctcggttctcctcgtagcggcctcctcctctgcaggggtcgttccggctggaactgttgtggcccccgctgtaggcattgggtgagcggcctccgctgttggcatcgagcgagcggcctcggtactcctcgtagcggcctcctcctccgtagcggtggctccggctggaactgtcatggcccccactgtaggcgtcaggcaagcggccactgctgttggcatcgagtgagcgacctcctcctccatagtggtcgctctggctggaactgtcgtggccccggctgtaggtgtcaggcgagcggcctccgctgttggcatcaagcgagtggcctcggtactcctcgtagcggccgcctcctccatagcggttgctctggctggaactgtcgtggcccccactgtaggcatcaggcgagcggcctccactgttggcatcgagcaagcggcctcggtactcctcgtagcggcctcctcctccgtagcagttgctctggccagaactgtcgtggcccccactgtaggcatcaggcgagcggcctccactgttggcatcaagggagcggcctcggtactcctcgtagcggcctcctcctccgtagcggtggctccagctggaactgtcgtggcccccgctgtaggcattgggcgagcggcctccactgttggcatcgagggagcggcctcggtactcctcgtagcagcctcctcctccgtagcggttgctctggctggaactgtcgtggcccccactgtaggcgtcggcagagcagcccccactgtgggcgtcatgcgagcggcctcggtactcatagcggccttctcctccatagcggtggctctggccgtaactgttgctggaactgctgtggcccccactgtgggtgtcgggtgaacggcctccgctgttggcatccagagagtggcctcggttctcctcatagtggcctcctactccgtagcggtcgctccagctggaattgtcgtggcccccactgtaggcctcgggcgagcagcctccactgttggcatccagcgagcggccttggtactcctcataacggcctcctcctccgcagcagtcgctccagctggaactgtcatggcccccactgtaggcgtcgtcggaccggcccctgctgtgggcatcagtggagcggcccccgctgcgggcctcgtgtgagcggcctcggtactcctcatagcggccttctcctccatagtggtggctctggccgtaactgttgctggaactgttgcggcccccgctgtgggcgtcgggcgagcggcctctgtactcctcgtagcagccttcttctccgtagcggtcactccggctgtaaccgttactggaactgctgcggcccccactataggctttgggcgagtggtccctgctgtaggcgtctggcaagacgactggcaaggcctcggacgagcggccttcactgcaggcatcgggcgagttgccctggtactcctcgtagcggcatcctcctccataagatggcggtgtcccccacacaggggcagcgccgcatgggcctccgtagctcttgaggggctctcggtaggagcctttgctgggatgatctgtgtactcatggtcgcgacccctgtagccattttggttgccgtcgcctctcaagggacggtagtccgggacactggagtggccataatagcggcggctgtagtctctgagcgcagggacaaaatccccagggtcgcggcacgggggcagtggctcccggacccgcgggcctgagtagccatcttgcccccacacggccggggccttcccaggcattccactgccgccaatgcgagccaggcttgaccggggcacagccctcttgtggggtgggccggcccagcgccgtggctgcaagcctgagtagccatcttgccccgacacagtcggtgccttcccgcgcattccacagccaacgctgtgagccaggctcgacggcgtggccctcttgtggggtgggctggcccagtgccgcggtggcggcccgcgcttcctgggcatcggggccctgtagggccacaggtcgaaataccccgcgtagccgcggccgtcatcaggcctgccctgagaggggggtcgctgtgggctgctgccacccccacgggttctgtgtgagaaccttgagcgactgccgctgccgggggttggcgggacccatcggctgctcttgaatgccggtttgatggtctgggccaccatgatggccttaccatccaggtacttgccgttcatatctctggcggcagccttggcgtctgcagggctttcgaaggtgacgaacgcgaagcccctcgacttgttggtttttcggtctttcatcaggaacaccttgatgatgtggccatacttgccaaactcggctttgagggctttctcgtcggttttgaggttgaggcccccaatgaaaagcttctctgggcgatccgcttccatcatgtctccctgccgaatggtgggtcagaggaagtgggaagtgatgacgcggcagttcagtcgcggccttcgagcgctctcgtggagggcggctcctaccggttgggggggtggatgtctcaagaaggaaaagagtaccttacgtcatagttcttgggaacaccaacgtctatgatacaggtagaggaaatcctaggaatagaaaataagaagtagccagagaggtaggaagagatcccagaagtgtagtcttctaagccagaggaaaataatctttccagacatatggaatggttattgatatggtggttgttggttacattggtggatgtgagagtggatagaaaccaaattgcagtgggttaagaagtccatggtaagtaagaaatttagttgtgttgtgggtttatgtgagtttggctgtaaaagaagaggcagatggagggggttgtgggatcgtgggaggtatttttgtgtttgcttttaaagatcagagataattcttcgttggtattttaaaagacaaatagcatatttggaatttaggtatactgaagcatatcaaatacatctggttaataaacatgcgttctatgaggtttttttctttttttgagacagagtctcgctctgtcactcaggctggagtgcagtggcgtgatctcagctccctgcaacctccgcctcctgggttcaagcgattctcctgcctcagcctcctgagaagctgggattacaggggcccaccatcacatccggctaatttttgtgtttttagtagacacaggatttcgccatgttggccaggctggtctccaactcctgagctcaaaagatctgcctgctttggcctcccaaagtgctggtattacagatgtgagccaccgcgcccagccgtatgagtgtatttctaaatgatgttttttgccttcaaggtattgatggataatattgtatattttaaagtattttaagtagttgcttagattctaagtgattcagcaagtgtgaaaatagttcttttaattaccatagatataggtatatgtttaatactcactattttcttttcagatctttccagaaatcgttttacagaaattccttctgatgtctggttatttgcaccccttgaaacattaaatttatatcataattgcatcaaaaccattcctgaagccattaaaaatctgcagatgttaacataccttaacattaggtaaggaaacaatttaaaaataaattttggtttttattgttgttctaatccttttttagtcgcaaaggaatatgtttgatttggctgtgtagcttaaatttatctcaacagtatcttatttgtgttttttatatgttcacattattttgtaggcttttgtcttgttcttgagagcagagcttagcaaactttaacacacaggaattacccggggatctgttagaatgcagattctaatttcttaggtctgttatggggcctgcatttctaacaggccccttggcaatgctcatgcctacctgctggtccttagacctcagtttgagtagcaaggctttagaccataaatatttcctgaaattatagcaccacgatacagattttatatgcatccttagatatgtgaaacaaacagtgcttgagttattttttctcacttttgtgacttcttgcttctacttcaaggatggttagagtggggtgagaatgttgaaaggtttggaagtggatgacagttcatgtttatacttagtaagtgcttaccatgtgccaggcagtcagtgttccaaacgctttacccatattaccttatctagttttcatgacagcattttgagataggtaccattgttatccctgcattacagatgaggaaattgggttaagctatttgtccaaattcatagatatattcagcaagtggtagagccaagattaaaatcaaagcagtctggctatagagctctcattcatacatagcttttaccctatatatgtaaaagaatgaacactcagtaagtataagaaaaaaactttccctgccaaatcagtaacattgaatgaaaattgatatattgtgacttaattttagaatttttttctttttttattcagttggaagggataatctcctcattaaccaagttacttgtctaaattcccatatagagaagtagtaaatataattaatatacataaatgataatgttcccttctcactgtgatatatcagttcttttgtatgactcccccagtggtgttacctgacagtacaagctattttaactgaaaccactttacaccttaaaatgtgtgagagaagtttcctggctgggtgcggtggctcacgcctgtaatcccagcactttgggaggccaaggcgggtggatcacgaggttaggagatcgagaccatcctggctaacatggtgaaaccctgtctctactaaaattacaaaaaattagccaggcgtggtggtgggcgcctgtagtcccagctactggggaggctgaggcaggagaatgatgtgaacctgggaggcggagcttgcagtgagccgagatcgcgccactgcactccagcctgggtgacagagtaagactctgtctcaaaaaaaaaaaaaaaaaaaaaaagtgtgagggaagtttccttccaaagatatcaatcatttgggttgctcctttctctaagtaggtataaatctccttggcctggcttaggagaggtttgaggaaagtgaggtatttttaagttttgtctttgtttctgtttcattttgttcttttgcggaaaaagtgattcgccaaaaactgaattacacttctctattaacacatatggtaatcttagttttactaaaactttctctgattctatcctgtcacgatctgtaaaagtcaactttgatctttttttacagtcacaaaaatttttgagcaaactatattgaaataacatttgttctagtgactgaattcttctctaaggcatgtagtaaaatagtgacaattaataatttatttgccggtattaagaaaccagattctggtgaaagatgattgtgttaactcaatgaatatgcatttttttttttttttttagacggagtcttgctctgtctcccagggtggagtggcaccatcttggctcactgcaacctccgcctcccaaattcaaatgtttcacctgcctcagcctcccaagtagttggaagtataggcgcctgtcaccaggcccgactaatttttagtagagacagtgtttcaccacgttggccaggctggtctcaaactcctgacctcaaatgatttgcccgcctcggcctctcaaaagtgctgggattacaggcgtgagccattgtgaccggcctgaatatgctttttaagggaagaaaataaattgatttttaagctatttttggcctgaagatgtattagaatgagtttgccattatttcttccatgtatttatttattttggtgaaaatctcttaataaacttgtaaaataatttttcaactcttctctcttcctatatactacccccctttttcagtagaatcctgtagaaagatccttgtgtgccctggtatgaagggacccagactgaccatttttccaaggagcctgcttcatcctgaaagtatgaaggattatgacaggaccctagcacatttgacattccagcagtctggccattattgcttgttgaggggcattgccatttttttgtttgtttgtttgtgccgtgttattaaagccagtctagtatttctggatgtcctttgccagagaaaagatggggaggagggtctttcaagtcccccttgagtaacactggacttttgttgctgtgtatgttacacgaaatgctaggtataggtctataaatgacactttgaaaaacaggaaaaataatagcttatcgcttaccagtgcttgttagtatgtaaatggaatggaaaaatatacattttgttagtggttcctttgggtcagtcagtctgttttggcatataaatttgaccatagtactttgagggcaaagaccccagagccagattgcctgagtttgaatcctgcctctcccatttaacagctgtgtgactttgagcagtttacttaaactctttgtgactatttcttcatctgcaaaatggggatcactgtgagagttaattcacatgacctgctgcaaaatgaggatcactgtgagagttaattcacatgagctgccctgaacatggcctggcaatagtaggcactcagtaaatgttagttattatatttaaatgtatctacagagataagaatgttttatcaactttgagctgagataaaggtgctaataggctgttaaaccttaaaagggaatgggttagggttactacatgtttttgaagatatagtcctattcactcttttataaacttaaacatagtgcatgcacatttatccctggagactttccctagcatggaagtattgaatataccagaattatatcaaggagcaaagttctgacattattgagctcggaggaatcattctgggtttttgagaactgatggtgtgtggagtagtatcataggtctgcctgcatagggtttgctatgctatggatctctgctgtagttgggcaaatcacttaaccagttttaactttcattttctgatttgtataatggagataataactacttaatcttgtatcattaacatgaggattaaatgagacagtgcatataagaaatttaacactgtgcctgatacaaagtgagcactcagcaagtacttattaagttattacttagtgatagaatattatttacttacaaagtgatttcttcgtttttaatatgtcacattacatacatattctcgtaatgaaactttctcattcttttcagccgaaatcttttatcaacattgccaaaatacctatttgatcttccccttaaagttttggtcgtcagtaataataaactggtatccattccagaagaaattgggaagttaaaagatttaatggaattggtgagtaacttagttgtattaattaatgcaatatgcgtaatatatctacattttggaagattacctatttttaatggaatttaattgtaatttttaaaaaaagtactaacttggtatatgtctaaattcagtaagatttagtaaaatcttgagatactatatgtctgagtttttccagtcacaaaatagcatggttcttccttagtccttgtgacgtcagaaggcttgcttacaaactttaagaaatacttttcaaatgaataagcatttgtttactcattttgtggacagtaaaggtcttagaggaaagctaagggaatttttaaaataaaacttttataggactatgatatatccttaaacaaaggagataaaagaagagagtgtctgcaaacagaattagcaacataactcttcctcactgtttgcttatgtgacgttatgacactttttagactgaaataaatggtaaaaggccattatatgcaattgattgtagaaatacagaataatttaaattaattaccttggacataacattttaggtattaaaggacattgaattctgagagaaacatattcagagcctcgaagctttcagctatttttcatatcttctggttacctccactttacgcagtataccatgcttcatgtttttcttttattttgaatgatgctttcctaataaacaggtatttttaaagttttttttttgtgatagagtctcgctctgttgcccagactggtgtgtagtgacatgatcttggttcactgcaacctccgcctcccaggttcaggctattctcgtgctcagcctcccaagtcgttgggattacagccatgcgccaccacacccaacttatttttgcatttttcgtagagatggggtttcactgtgttgcccaggctggtcttgaactcctggcctcaagtgatccacttgcttcggcctcccaaagtgctggcattacaggtgtcagccactgtgcatggactaaagtcctaaaatattcttatgtatgactttattatgtccggggaggtcaaaagttttcttgaggaacttacctacaatttcataatgagaaattaatattaacagaatgtaatgagcagaaatttcaggaataccttttattcattaaggaatacctgcatgtccaattataatacaaggaaacttccttgaatttcaccttatgttttagaaccatataattttgaagttataaaagatcttagaagtgatcagatacaaccactttctaatgtaggaatccctgatacatctactgtatattttcaatggtggacaactctgtgtgtgtgtgtgtgtgcgtgtgcgtgcgtgtgcatgcgtgactgtcctaattcttctttgcaaaactctatttgttattaatctttcttattttgaaccaaaatacatgcttctatcatttttttccattgggcctgggactaccatgtgaagaaatatagataatgacaacttctctccccttcagatatttgtaatctgttgtgtgtttacactccattttaccaaactctttttttttttttttttttttttgagacgaagttcactctgtcgcccagggtggagtgcagtggtgcgatcttggctcactgcaacctccaccctctgagttcaagcaattctcctgcctcagcctcccgagtagctgggattacaggcacctgccaccgcgcccggctaattttttgtatttttagtagagatggggcttcaccatcttggccaggctgatcttgaactcctgacctcgtgatccacctgcctcggtctcccaaagtgctgggattacaggcgtcagccaccgcgcccagcgtaccaaactcttaagatgtgtttttctatagcttaaacatccttattacctttattcctttttatgactttttacttttagctaattcgatttagaaaatgttccttttagttaaagtctcacttaatgttgtactaaaaaatgaacagagattccagatatgatctaacaagttcataataaaaggtaccattattttgtttgacttgaacactattaatgtttttccagattttataaaggttataatttaagattttatgtctccgtaatttatttgtttttaatttagtttttggccctacgtttttaattacattacatgatgtaatttttagataaatgaaatgtaaaaaataattaggagttttatattaattctagtacagttgtccctctatgggggattggttccaggattcaccccataccaaaatccacgaatgctcaagtctcttatatacaatagtaatatttacatataacctaaatacattctcccatatactttaaatcatttctagattacttataatacctaatacagtgtaaatgctgtgtgagtagttgttacgttgtattatttaaggagtaatgacaagaaaaaaaagttaatatatgttcagtacaggcacaaccatgctttttttttcctgaatatttttgatttgtatttggttgaattcatggatgcagaacccatggatacagaggaccaactgttttttaatttatgtagaaaattctaaaatgtttaacactattattttactaggtactgtaaaattattatgctttaaactcttgaaatcagtaacagtagatgggtagatagcattaggagggctaattgacagttgtaaatcacatattgaattggtggatattccctgtcattggaatattttctcttgatacttttccacatcatgtgataatcaactgcaatgaaattctgtcattagaaacctaggaaatactctctggcttccaatcctttgcagactattttgtagagcacccactggagtgggttcatttcctatgcctgggtttatttctcttgggaaatgacagctatctctcaaatttctatggattttccatatggaaatcataagtatcaaatacctttagaaagaagcaataatgtttaaataacattttcacaaacttctattatccatcgtttgaatagtagtctattctgaacatagcagctaaggtgatcctgtcaaaatataagtcagatcatgtcaatcccatgttcaaaagtttctggatcctgcccacatctctcagaataaaagctaaagtcatatccctccctctattctactctctcccttgcccatttccctctagttacactggattccttgctgttctttgtacctgtcaggtgcgctctgcctgagcgccttcacttttattgttccttctgtctggaatattcctttcttatatattagtatggttcaccttttagctctgacagtactgctcaatatcaccttctctatgagataaagtagtatccctccccactattgcgagcatagccattttcctaccctgttatcttttttaaatagcacttatcaccttctagcatattatataatttactccccttgctagcatgtaaactccatgaggagctatgacagcaggaaattttgttttgccccttgataaatccccagtccctggaacagtacctagcaaatgttaatagtattcaacaaatatttattgttgaatgaagatgccttagatattgtttgaaagaggtatgtaggatatattttcctaatcatctatagcattattatattcttccctacatggttttaatattattttgaaaactgaatgtatgtactattctcctccctccaagctattatcattttcactaaaagttggaaattgggggcagttgcattagaatatgaatttcatttgaagtgtgtctggaatgattactgtctgagaccatgttgtagatttctcttttttttgttgttgatgttattataagaaagaggggagagagcacagttaacttaaactgttcttttttctgttttttttaattatgataataaataaaaacctcaatttgttattatggaaacttgatatcgtttgcctttaaattggggcttggattttaaccacagagatttcctgagagacaccttagataacctgagagatttccaactcagatctcttagaatgtctttgagctatgagatgagtcacaagtgttggggcttgtaacttctcattttgtatccctttggagaaagagatttagttaaatcaatctttatcatagtctgtttcgccagtgcacatttataaatccttgactttcttagcttctgcccagccaagtatctcgagacaactactgtaattgacagattacacaatgtttgagagttgttagtcttttactttacctccacgtgaagagtgctggatcattcttacttctggttttggctggtatgagttggcctttagttgagattttcgagaggttgtagttactaagatataacctcaaatttttgtatgggaagtttctatttactgtactaggtcggcttcatgatgtcgtataaatagaaatctgccagataatccatctttagagcaatgacattagaggataacttttgctagctattaaccatgtgctttaatttaaaaattagaatatatatatataatatatgtatttctcagttagcttgttataattctgttttattgttctccttaggatattagctgcaatgagattcaagtccttccccaacaaatgggaaaattacattcacttagagagctaaatataagaagaaataatcttcatgttttgccagatggtaagatgttcactgtttttactcacatgaataagagagtaactatgtaaaatttaattaattatttttcatttctgaccagaattaggagaccttcccttagtcaagctggatttctcttgtaataaagtgaccgaaattccagtttgttacagaaagctgcatcatttacaagtaataattttggataacaatccattgcaagtaccaccagcacaggtttgtaataaaaatattataatgtttcttctcatttttattcataattttatctgtttatgactggtaaatcaaaaagcacctaaatcaagagccaatttgttgttcaagcactgttgtctaaagtttttctgagcattgccttttgcactttggtaggagttttagcttaggctctaggatagcatttggaaaacccagataataactttctgcttgtgaactgataattctggttgttagttatttacaaaagtgactctgaagtctctctacctatttcccactcaggtatatatctacttgggatttgttgtgggattgattggagtacattcttggcactgagagatggaattataacagaaagaacaaaatacaagtggaaaatattaattatgacttttagtttagtgaggattaaatccatgtggaatcctcttaaatgatagttaaggaataaactatgatataatcccctatggacaaagtatgaaagagaagaaagaggacagtggggaagagatgtcaatagaatttctgaaaatggaaaatagaatagtagaaacaagtacctttacttagattgcccaaaattatttggctgaggagcaagtagcagtgaaatggtactttatgctgtgtgccctggcagagggtttgcagacatccagaagaaaggtcttctttttcttcctacaaaagtacattccactcattctaaaggggttaccttttctaattcaaataaagactggctagagtcctggtggtagcaaccttagcagaatgaagaaagctgaaacttgtgcctgctatgggagaaggcaatcagattcaagttgatttacagcgtcaaacctgggaatggcttgagtattggaggaaacatgtaactctgaatatagggattaagtactgaaaacatgatggtttgtggaatgtctaaggcagtgctgtccagtagaactttctgaatgatggaaatgttttataatcgacactggtccaatactgtaaccacttgtttatgtggctgttgaatgcttggaatatagctagtgcaactaaggaaccaaattttaaattttattttaatttgatttatttaaatttaaattgctgcatgtgactggtagctcccatattaaacaccacggctctaagatttacaccctcagattcttgccctcagccccacagccacagaccattccttacttgcatcagcagaagtccggaatttattctaaggagtaggtagatccttaggttttctccgttagctcagtggccagatgatgactcacttcttgcctcagcagaagactggtgtttactccttagagaagcaccatcccatttgtacttgctgtggtgatgagcatgttctgtatctgcattgtccaatacggtagccatagtggctactgagtacttgaaagtgtatagtgtgacaaaagaactgaatttttattttatttagatttgattaatttacatttaaatacacatgtagaacacaaaaccaaacaccacatgttctcactcataagtgggagttgaacaatgagaacacatggacacagggaggggaatgtcacaaactggggcctgtgggggtgtggggggcaaggggagggagagcattgggacaaatacctaatacatgcggggttgaaaacctagatgatgggttgataggtgcagcaaaccaccatggcacatgtatacctgtgtaacaaacctgcacattttgcacatgtatcccagaacttaaagtaaaataaataaatagacacatgtggctagtggtaccctattggacagtgaagctataaagggattgaaacagagtcaggggctccaggtacagcttatatagcaagagcgagaccgcatactgaaaacagtgaatggttgcatactgaatgttgagacgctccagtttggctcccagaatgcttgcaacctgtcttacatatttcaggcagaattggtggatttcttccttagtaaactgcagcaggagaagagacctatctatatactgaatttttggagtcacctgatgaaatggctagtctgtgtctgatcaccagatagatggaagctcaccatcaggaaacttccccatgcacacagagcttccagtttgttttttattatcccttttggaaattaacagacaggtcggatggtagctcatgcctataatcccagtactttggaactttggtagactgaagtgggaggattgttagaacccagtaggttgaggctgctgtgagccctgatcacaccattgtaccattgtactacagcctagacagcagagtgagactctgtctttaaaaaaaaaaaaaaaaaaaaaaaaaaaggctgggtgcggtggctcacacttgtaattgcagcactttgggaggctgaggcagatggatcgcctgagctcaggagtttgagaccaccctgggcaatatggtgaaaccccgtctctactaaagtacaaaaaattagctgggtgtggtggcacgcgcctgtagtctcagctactggggaggctgaggcacgagaatcgcttgatccttggaggaggaggttgcagtgagccaagatcgtgccactgcactccagcttgggctacagagtgagactctgtctcaaaaaaaaaaaaagaaaaaaaaagaaaaaagaaaatgaacagccagccaagaatcattagacattgcaagagtaatctctaacatgaaagacagagaccaaaacaccaaaggctttcattgaaacgaaagggagcacatttattttttgtgtgtgtgtggatatccagaaatatttgtaaaccatatatctgatgaggggttaatagccaaaatacaaaaaggattcatataactcaatagcaaaaaaaaaaaaaaattgaaaaataggcaaaggacttgaatagacattttttcaaacaagacatacaaatggccaacagctatatgaaaagatattcagcattcctaatcatcagggaaatgtaaatcacaaccacaatgagatatcacttcacacttgttaggatgcctgttatcaaaaagaaaagataaccagtgctggcaaggatatggagaaaagggaaccattgtacactattgatgggaatgtaaaatggtacagccattatggaaaacagtatagtgcttcctcaaaaaattaaaagtagagctaccatataatattacagtcctacctctgggtatacatctgtaagagatagaaaaataaaccaaactattttttctattttaattctcaatacagaatacttcacttctggtcaccaaaatgcgtcagatttcttcccaccaccaagcagttctccagcagacactgactgggtatcctataattcaattcaattctgacactacctggagttaacatcagatcctacaggttaagagctcagtcccacagactgctcacctatacttctgactgaccaactataagttaaggttcccatgaccccctcctcaggttcagttaatttactagagtggttcacagaacttagtgaaacactttacttactattgctaatttattacaaaggatacaaatgaatagccagatggaagagaaggataggacaaggcatatgagaaggggtgctaactgaaggggtggagaggggatgttccctttcctccccatcataagggtcacggctgatacccctataacaaaaaacaagtaaacaagataaaaggataacaactttatttgatcatagttttacgtgacactggagccttcagaataaggacccaaggatatagagaaagttagctgactttatgcttcgattcaattcagactgggacagcagtgtagaaatgtgattggacaaaaaaagcatgagctaatggtaatagatggagtgggaaaacctagcaaggccttttcttggtgtctctgttgtagcgtttgttccttctgggtgtagggtaatacttctctggaatgagggttttaatttgtttatggccagtggttacacagaaaggtaggggaaggttagattaggctttatggctggctttggaaaaaaggggttctagtgcctatgactggccttggggacgataaattcttgtttccatgacttgcctctagtgagaatgaggaggtgagagacaggggaggggcgtctggagaaggtcagagaaaaactttgcttctgaggctttcattttggggtatcattttctgaacctcaatgaagcttttgtgccctctgtgggcacgccaccttccaggcacctccacgtgtttagcaatttgtaagctttccgaaccctgtccttttggtttttatggaggcttcgttgtggaggcacaattggttacatcattggccattggtgatcacctcaactttcagcccttctctggttcctggaggtgagggaggtaggattgaaagtttcaaccgcctaatcccatggttggttttcctggcaatcagtcccttatcctgtggctatccaggagctcccagccaccagtcattcattagcatgcaaagggatacttaccacttaagagatcgtgtaagagttttaggagctgtgtataggaaatgggagcaaaaccaagtatacattccttacaaattacaatatccgaaggaaatgaaatcaccatcttaaagaaataatctgcactcccatgttcattgcaacattattcactacagtcaagatatggaaacaacctgtatgtccatcaacagatgaatggataaagaaaatatagtgtgtgtgtgtgtgtgggggggggggtgtgtttgtgtgtaatgaaatattattcagccttagaaaaagaaggaaatcctgtcatttgcaacaacatggatgaaacttaaggacattatactaattgaaataagcctgacacagaaagataaatgctgtgtgatctcacgtatatgtggaaccttaaaaaaaaaaagttgaactcctggtgacagagagtagaatggtggttaccaggggctggggggtgtggataaaggggagattttaaacggtaccatccttcagttataagatgaataagtactgaggacctaatgtatatcatgctgataatagttaataatattgtatttacttgaaatttgttaagagagttgaactgaagtgttctcactacacacacaaacaaggtaactacatgaggtgatgggcatgttaattagcttgactgtggtaatcatttcacaatgtataatacagttgatccttgaacaacatgagggttaggggcatcgaaccctgcatactgtaaaaaatccatgtataactttggaatcacaaaaaacttagctgctaatagcctactgttgactggaagccttatcaataacaaacagttgactaacacatattttatatgttatatgttatttactgtattcttacaatcaagtaagctacagaaaagaaaatgttattaagaaaatcataaggaagagaaaatatatttaccattcactaagtggaagttgatcatcataaagatcttcatccccatggtcttcacattgaacagggctgaagaggaggaagaggaggggttggtctagctgtctcaggagtggcagaggtggaagaaaatccatgtataatggacctgcacagttcaaacttgtgttgttcaagggtcaactgtatatcaaagcatcacgttgtacaccttaaatttgggagttcagtcagggtggtgggaaaaattatagaagaaaagttatgaagatagttataggaaatagacacaaaccttcttggaaggctgggggggttgcatagcttcagtaaaaagttcagctgaagtcagcctaatcctcttaccttgagttaatagtttaaagtaggtacaaaggaatgtaagggagtttatctaaatagcttgtttactcatgtggccctaagcccaaccttttatcatctgtgagtgcatgattgctctctactcgaggggttggcagtgttaattaccttctagcggtgtttactcgagacctttgtaatttaatcagtactaaataaatgcgaacttccccggcttatcgaggcagatgctgcagactcaggcagcagagccccttagccagactgacaggcaaagtatctgtgtcagtgtacgtctttcatccgtcattgggtcagggtcagcgggatggacatggcacttaaatataaaaaaattttatttgtaactcatactttaataaagctcgaagaaaaaataaagaggaaaaatggagcatattcataggagtgctaatcagcatggctttctagcagcagttgtggaaactggcagatgttggaatgataccttcgaggactaagggagtatttctaacattctacattcaaactgtcatcaaatgtgaggtagaaaaaggtttcaaacatgcaagatcttagaaatttttactcccatgtaccctttcttaggatgctagcagagggtgtactataccaaagtgagggagtaaactaaaaaaaggggaattcttcttgtctgagattgacagatatgcataggcctagtaagcagccagtcagtagtttggagtacaggagttgtctccaaaaaaaaaaaaaaaaaaatagaaagtaagagatgatttgatacgtttgtccacatggagagatgttttatacttctgtcagagtcaagaatgaatttataataggcatatagaaaatttttcaaaagaaaaaatggggccattaattactttaggaaaaacaaaaacttacaggagaaaggaaatgtaatcatattactctgtagagtttatctgtgaatattttcttggtcataataatataaacactagattttgatttagtgaaaaactgtgacatagttataatagcagagatttatatagtatttgctgtgttctagacactgttgaaaatgctttacatatattaactcatttaattcttatgttaaccctgtaaaacaagtactgtcattatcctcattttacatgtaagaaaacagaggcatagaagttaaatgacttgttcaaggtcacattgctagcatgggttagagccaggattcaacctaaggcagtgtgactgcagagtccatgctctttaaccactatgttatacttctgaagagagaagtatgtttatgtgaattgataggaagcggggaggctgggatggtggtggtggtgtgggtaatgtaagaaatccaagtcctcatcttccttagtgatactccaataaatctaccattggaaaatttaaaacaaatagcagtagaagcatgttattaataaatatgagggcaaatagaaattaaactaaaagagtttaaagtgggaatttgatcttagagattgaaataattagaatgggctgggcacggtggttcatgcctgtaatcccagcactttgtgaggccgaggtgggaggatcacttgaacccaggagttcgagaacagcctgggcaacatggtgggaccctgtctctgcaaaatataagaaagattagccgggcatggtggtgtgtgcctgtaatttcatcccagctaatctgggaggatcacttgagcccaggatgtcgagggtgcagtgagccatgtttgtgccactgcactccagcctgggcgacagaatgagacgctgttttccaaaaacaagcaaaaaaaaaacaaaaaaacaaaaaaaaggagaagtagaattgaggattatgtcttgtcagctttgtaattatttttaaatttaaaaactgtgtacatgaagtactatgataaaaagttaaaatttacaagagagtgatttaccagcacttaatttggtaattaagataaatttttgtttagtttggacgtataatagaatactacctcacattttaattttagcacattttagttgatagtatttaatattaataatttataattaatagaaaaatcaatgatatttacaacatttaattggcaatatatttatattctaatagctcaaaagttttaattttccttttaaatgaaatttttcagtggtcaagtcagacctagtatctgttagaattatctaagaaacattcttcctttggacctggaatgataattgctttttaatgttgttgtcttactgttttctttgctgatttttttgcatgtgaggtaagcttatgtgagcccataaaatgttacattttttattagaattttgagaaatatttatttgatgtcacttagtgactgtaattaaccttgataaagctgacttacagttttcttacctctcattttctattgtttttatacagagtatctttgctcacatagtattttattcctcattattcattttctctatggccaacgaaagtaatttcttaggatattattctagttgaattgaccagtgttttcttttattatttcagtctcaccagcctaatatcgtacctttcaaaaaattcatttttcctatatttatattttttatgttagccttctccaggttttatgccaaacatcttagtggttctgatgagattactttaaagaatcacatagattatttgttcttttcttaccattccaatgaatatatatttttcattttttcaaataaaggccacttttatgagttgtaaacttcatattgtttaatagtttgtacattctgcttttgacaagaaaactctagtgaaatatagaaaaattaacttttttcaataagaacagagatggcaatagaattttagttggtatcagtgttgtcagatttttccacctggtgtcagaagtacaaattatttaaatatgcaaagtatcaatcaagattgtgatgtctcaatgtaatttgagactattgaatggtttaaaatgatagatgtcatttatatttggaactatataattaaatctttattttttattgacagatatgtttaaagggtaaggtgcacatatttaagtacttaaatattcaagcatgttgcagaatggataagaaaccagattccctggatcttccatcattgagtaaacgaatgccctcacagcctctcacagacaggtaatgtaacattcttacagtttcatttgatgattgctgtcttctctttttatgaaatatacttattaatcttgagtgttccgaatatatttaggctgattggtccagcactaaaataaataattggctgaagctacatatcaccatcatagaatgaagttctaggatactagaatatttttgacattttctcaatcattaaagttttagtagtaaaaatgtaaatgtttgacattatattacggaaacactaatttctcagcatgtgacaactgttaatttattttgtgatcactgtattgtacatttgtaacaacaagtagaatttgactttgaactgaggttggtggaagagcaagacatttggggagtaccttttccctttcatcatagtctttatgtctggatcaaagatgatatatcataatgacatataatgatatatcatctttgatgaacatctttgatgttctttatgatttcagtgttttgatcctcatgagattttgagatagtagattgaacattctgtttttaattcatcctttcaagatgtagattggtctgaaagattttatgaaagtataaatccatgtaatagtttagaaaataacctagaatggggtgagactacagaaagctagaccatgcccttgcctaaaatatttaaagatttgtcattgcatatatataaattttatattgctttgaatggcaatatagtaagtactattgttaacagcacaagtttgtgaattcccaaataggactttttcttgaatatttttattttgtaagtagaattaagtatctaaacattagattcagtttttaaagattattttgtttaatattatgaacagtattagaccaaacaaggctccaaaaattggaattaaggcattctaatctctattaatctgctttatatttattttaacatgaatttacttttagtaatggcatttactgttttagtcatttattttacaaatatcagttgaatgcctactggtagattcagttatgttttgttgaatgtcatatatgttggtcttggcctcttggtgctcacaatgtagtggagcaggagtcagtgaataaacaaagcaaggaaatacacacacatataaaatttcaaattgtattctgtgctatgaaggaatgtatttcaagagtgtcgtcagggaatgaataaaagccagctctgtgaagagcaaagtaagagcatcttaggcagaaagaatgacattgccatggccttaagttaggaaggaactttgtgtgttcaaacaactgaaaggagaccagcgtggttggagcagagtagctgaagggaaacgtggtacatgttgattttagagaggtagtcagagttcaagtcatgtgggtgctttgtaggatgtggtaagaagtttgaattttacttaaagtacagtgggaagtcattggacagttttaagtgggggaataacatgatttgactcatttttttaaaaaaaactattttggcttataggagaatagattggaagtaagcaaaaatagaagcacagggaccagttggattgttgtagtattgccaagagatcagggggtctagaataaagtaattgcaatacagatgaaaagaaatgggcagaattaagatatattttggagatattctctagcaggaccatccagtaaaaatataatgtgagccacatatataatttttaattttttgttacccattttgaaaaaagtaaaaagaaatacatgttatttgagtatatccaaaatattatcatttcaacatgtaattaatgtgaaaacttggtgagatattttatatgcttatttaatattaaatctttgaaatctggtatgtactttatgtgtatagtgtgtctcgatttggaatggctgtatatggctactggctgcttaccgtattggacagtgcaggtctatagagtgggttgtcagttgtattaatttctcactcacagcctgtattgaactacttagaaaattcttgtatgtgctttccactttcatactcaggctcttggctgtatggttcttactacctagaatgcccttccatgccttgtctgttttgtaaactctttattatacatagataggcactacagtacttacatataatagcttttggagtcagacataatatggctttgaagcccttttatgactcttaataactgtatgtccttgtgtattaatgtctctggtcctcagttttctcatatgtaaaaaagaaaataattacacaggtgctgtcaggattaaatgaagcaatgtatgtagagcacttagtgcaatgccttacccataacatttcctcaacaaatagcttattatcatcattgtcatttactacaaatacatggagtattttgtgcagtgcagtcagatgaattttggctctaatcatggtttaactacttaatttctctgtggccttgtgtaagttatttaacttctctgagcctgtttccatacctaaaatgttaaccatacccacttctacagttgtgagaattaaatgtgtgcctagcaattagttcaataaatgataaacagcaaatgttataatttttccccttgggacgttaacttttgtaagctttatttttttttgtaaaaagataataattataacttcaagactgtaagaattatgtctaaaatatgaggtgcatctaacacagtacataacacagtatagacactcaatgaatgctaacagttattgcctcttcatccacaagactaagctcaaatgccacattcttgagtgatgcctttcctaactttaccgaggagaattagttgaccttttttttttttctcatagcactttgtatttacctttgtcatagtcttcaaaacatttaaacacattcatttttcctctaggctgagagctagctctttggaggcaagttttaaaaatgtattttctcttaagcattcagcatagtacctgatacttggtaggtgattccctaaatgtattcatatacttctgaaaagtacaaaaaaaagtttttttttgttgttgttattgttttttttttttttttttttttttttttagcatgaaactggttttaggagcggaattaaaacatagtgattaccaccagggactttggtgctagataattgagggatcaaatttggactgctggctgcaagttgcgtatccttggataaattgcttaatccattccagtcaaagttttatcatatataaaatgagaaaacaccatcaatttgctacagtttttcacaataaatatgtaatgttttgtcttttaaacatttagcacagttcctcatacataataagtggtcattgtagactgtgtggtaaaattgcaaattaagtgaaaaatactttgcttcctgggtggcatattttgtaaatcagaaatttgcaaggacaaagtgaatttgaaagtattaaagtgcatattcaatactttgtagctttcatttttacatcctctctttattagatgggcattatttatataaataaaacatttttagagccaatgaagagtaaagcatataaattgaagttaaaagatgtttcgaagctctgtgatgaaatttgacaaaccaatgggaaaaacaggtcttccatcaagataatgttctaacaaggcagcctgattttctgaatctctgaggagaaataataggttattgttgacaattgacactatagagtacacgaagggaacaatattgcatgagtggcatgaataaaatgttttgtaggaagagttctgatatttttctcctcatgtccctaattaaggatcttagacatcaaaagtatatattctgtattatctagggaaattttaggtcaaatgtgcattatctatttaagaagaaaatcctaactgctcttaggatttctatttccatagtatggaagatttttatccaaataaaaatcatggccctgactctggaattggaagtgataatggagagaaacgattatccacaacagaagtgagtattttctattgctgatccattctgttttacaattttattagagcattgaaatagagacccttgtgcatacttgagtttattttgcttgaaaatatgatcattatattttatgactaaaactgaaaaaaagggcatgctgatttttaaagctgagcagtaaaccttatgttaattttgggtttgaaaactggagatgtaaagcagacattctgtaattcatatgtaaaattgaagtaacataatccatatcgtaagtttaaaatgcctcatttgtactttttgcttattccttttagccatcagatgatgacacagtcagccttcattctcaagtctcagaatcaaatagagagcagacatcaagaaatgacagtcacataataggaagtaagactgattctcagaaaggtaattcatatggtacctgctatttttgtttcatgtacatagcccacattaaaaatgggctttgaaaaattatattgtctttagcaaactcttacattgagaaaatacacatttttctaaggacagcagtgtcaagcatacagtttactatgtacattttctaataaatattaatctgtacctagaccaggaggtatatgattttgttgaccccaacacagaagatgtagcagttcctgaacagggaaatgcacatattggatcatttgtatcattctttaaggtaaataaaactttgaacaaatattaataacatgttctcttgatcttataaaagtggactatacaatttaaaatgtaactttcttttatataagggaaaagaaaaatgttctgaaaaatctcggaaaaatgaagaattaggagatgaaaaaaggtaagcacatatgaaaatgaaatgttatttataagcccttgagccattcattagatattcctacttgaaagagtacttgaaaaaaatataattttttgttcacttacctcttatgtttagatagttaatttataaatacttcacatctgtctgtattcctcaagtaaacacaaaattatagtaagcgtttgagtgtaggatgtgcactatttttacccctgaagtgtaatgatgacttctattattattattgaggaggactataccgtcatatacattgcttcatttgagctatttaacaaccataacaatagatggtattgacatcactttaccaattaagacactgaaaccaggagttttaaatggctggaactcagatgtattgtctcttgttctactatactttccatttggtcatgctgattatgacttttaagggtacttatgtccatattttattaaaataattgtgctttggatcttttttgaaccattcatcttataaaatgatgaaatatgacctaccacatttttttcagttactccttcaggttgctttatagatgcagaaaggaaagaagaaacatttggtgaatacctaccatataccaggattagtgctatgtgctttcccatgtttctcattttatcttcattaaaatcctgtagggtagatactgacctcattttttcaggtgaggaaggtgaagttcaaagactcttaagttttatgcctaaaaccacttagccagtgtccactagtacctagagtgtgaaagtagctctctttgatttttaaacttttctcttttctctacattatgcttcctccaaatgacttcacagttattagttaatcatctctgatgtcctgtaaggaggtacattgctttgtcttgaactgtttagatttcattcttttactttctcacctcatctaatgaggtcagttgcttaaacttgagaaacacctgtagcatgtacgatgtggtaaagtcacaaagattcatggtttgatactgtttttaaagtgaaatctaaagataaaatgactagagtttggataactattttaaaatttttttgttctcttttataaagatgacatattagtattttcacgcaaatttgccaatcttatttgaacctattttggattttctttatttagacatatacagatttttaaaatcaaaatcaataaactgataaaaacaggatggtgcaattaaatgacaaaattttacaatattttaaatttatgtattaagacaggccatatagaactctgcagtcctttttatactgaaggctggagaatatacatttttagattactattaaccattacacatttcagaaatctaaaaaatggtttatatactttgctattatttgttagtcattaattatattaatacagccagtatgctacatttcataatgagtagagaacacagaagttttccttatttcttattttagcattttaaaagaaggacctaggattttaactttcatatggtgttaaaaacaaaaatggtttctatttctggaagctggcataaaatgtagtctgccttactttttggataaccatgtttgtgtcacctttcagacttgagaaagaacagttactggcagaggaagaggatgatgatttgaaggaagtaactgatttgaggaaaatagctgctcagttattgcagcaagaacagaagaacaggtattcctttcagtaatgagatttgaattggcaaattttataatcattaaattgattatttaaagattatcaaagtatatgaagttttgagtaaacaatagtgccctcttaagatctatctcaagggactaactacagattgagtattcctcattcaaaaatctgaaatcggatcccaagcatttcaaataagggatactcaacctgtactaaaaggcaataggaaatacttaggacgggaatataaaattacatttacaactaacagaatgtactcatatatatagtcactatatttaatattgcctaggtatttcttttttattcctgtgtgtgtgctgaatcataataactgatttatttgttgatattaattttagctcacagtagcattatttacattgtaagcattttttttctaggtacatgtcatgaatataacgtgctttttaaaactcagattccaaacttggcatacgtctaaactccttagaatggagttgaattttgcaagagttgattaaatcagtatgatgatttgagggtcactggctcactttggtctgtttcttggtcaaagaccattttcctcatcttttggctaggctttcttcaagtacatgttgttggcaatgagaagggtactgtgtgaatgagaataaaatcaagacatgtccacttctaatgcaggaaaagttccatatgctgctgagggtcagctgttattgccatcttcatgtactgagaggactacatttatagttttgaaatgataaagatctgaatggtttttttttgctttgagaaaagagaataattttggtgcatttaacatggataagtaaaatattttatttcatttattcaaaataataaatgtttatggttaatatgaccatgttttgggaagtttcaaatttaaatatactggcatttgtttaaatgtacattgaaaaatacaactaaaacttatcaaatgacaaatatatggtttctaggggccactttttaggggcaatctatataatagctaataagctaaattgcctaagtgtcttttttgcacagttgctacatttatagatatacaaaatcatactagaaaatcactaacctttattcctttcatatcaaatgtatcttcatcagcagttcacatttttcttctgctgtaactttcggtctgctttttctgtgatgtttatcttttcaacttttcctgtgattcttttctaatgggccttttaaaaattggctacttatgaggctgtgtttgtttttccccctccaatataatttaagtgttgattgccctgtgatttaaaaggtttgatgaagcaagccaccacctgttctgtggagcttaaaaagtttctgtctcctctacctagcaggtgaaagaattgtatttatcattatgggacgataatattgtttttttaagaacccacagctagctgggtgccatggtttatgcctgtaatcccagtactttgggaggccgaggtgggtggatcgcttgagctcaggagtgcaagaccagcctgggcaacatggcgaaaccccgtctctaccaaaaatacaaaaaattagccgggcatggtggtgtgcacctgtggtcctagccacttgggaggctgaggtgggaagatcgcttgagcctgagaggcagaggttgcagtgagccaagatcatgccactgcactccagcctgggtgacagatctcaaaaaaaaaaaaaaaaaaccgacaggcctatccatttttctcgtggtattaggaatagcatttgagtgcataattatagatttttacattgtcatatacgatatttctgtatttccattttcttattagcatattagtttttcatctatccatgtgacttaaattattctttctagcctaggtacaacattgactgaatagttaatctttcattggttttatttttgtgatagttttgtaatcagtacaaaatagcatctagcactgtgccttatacatagtaaatacataatatttttgattgactgcttgaaaattaaatcaatacatttaaaactagtaggagaaattagttaaaaaattatatgttctccctaaaaaaaacttctgctgttcttcaagatgtatgcaaaagtaatttctttttctaattctcttctttatcatcctttttagatgttagtacatactaatataagaactttttagattaaatattaatatacagtgacattgttgtgataagtatgtctaattttttcagacattaaaatatttataatatgatcataaagtaaagagcacttttttttttgagacagagtcttgctctgttgcccagtctagagtgcagtggtacagtcttggctcactgcagcctctgcctcctgggttcaagtcattctcatccctcggcctcccaagtagctgggattaccagtgtgtgccaccacacccggctattttttttgtattttagtagagacggggtttcgccatgttggctaggctggtctgaaactcctggcctcaggggttccacccgcctcggccttccaaagtgctgggattacaggcgtgagccaccacgcccggccaaagagcacattttacttttaaaatttataacgtatggagaattttagatccctagccaattctgttaatgcctgaacttaaactggatctcagaatttttaaatgctaaatctaatattttttctattaaataatctttcttccttctacaatatgttactattgcttagatcttttagatttagggacttaaaatttttagtttactgtcacaatacttgaatttgaatgagaccaaaaatctaagcgtaatcctatatgagaatatatcctacagtggatttgatataatttataccttctctggttgtggattttccttttcatgctgtattattgtgtcttatattccaaatatattagtgaaggatctgaaatgctatttaaaattgtaggccaggagttgtaacatctctttttaggttttaaaataattattgtaaattttgtttgtttttagtcttgattaaaaataatttaactggattaagattaccctcgcctaccaggaaatatcatccaggactgctactttgactgtatattacttaactgttctttaacttgctactagtagaagacaaatgcaatgttagctctcagctaaatgaagccatgtatcttctcccaaactagaggtaattaaaaaacagcttacattgagttcagtgatgatttccttatggcagttttgccacttgcttagttcatatatatttttaattttttaatttatttttttttaatattttttgagacggagtctcactctgttgcccaggctggagtgcagtggtgcaatctcagctcaccacaacctccacctcccgggttcaagcaattctcctggctcagcctcccaagtagctgggactacaggcatgcgctagcatgcctggctaatttttgtatttttagtagagacagggtttcactgtgttggccaggctggtcttgaactgctgacctcgtgatctgcccgcctcagcctcccaaagtgctgggattacaggtgtgagccaccacgcctggcagttcatattattttttaaaatgtctttgattctttaagaaactttatgccagtacttggtacatgaaactatcctaggggagcagcaagaggatattgtacagaattaatactcaaaaagggtgagaaaagagatcagcaaataaaccatcaaattggtaactcataaggttttaaagtctgaagcctagttgtttagaagactgcctccactttgtctgattaagatgtgtaggttaagctactttatgtttacagtttattgttgaattttttttttttttttttgagacagtctcactctgtcgtccaggctggagtgcagtggcgtgatctcggttcactgcaagctccgcctcctgggttcacgccattctcctgcctcagcctcctgagtagctgggactacaggcgcctgccaccacgcccgactaattgtttgtatttttagtagagacggggtttcaccatgttagccaggatggtctcaatctcctgacgtcgtgatccgcctgccttggcctcccaaagtgctgggattacaggcgtgagccaccgcgccgggcctgaatttttttttttaattgataaacagtctttatcatcccctgtcaaaatattggattattatttctacttgcatctgagtgtattgaagtcactctgaatcaatgactttgactatatttaaatagctattcatcaagttctaattttaccttcactattattttgggaaataaaaacaagtcttgaaaaaaaatcattatcttaaaaataatgttgcatgatgagtaagttctagggatctgctgtacaacattgtgcctataattaacagtacagtattgtatacttaaaaatttgttaaaagagtagatctcttgttaaatgttcttaccaaaataaaataaaattgacaaaagggagcatgttttttagaccaagaaaaatcaaggaaggaactgagaataaaatgatactattagaatattcttaatattaacttgataataaaaaaggaaattctgttgaaaaacaaaaaagttgatatgtattattaattattgagccagttttacaaatttccatgagtcttactcatttatgttagtgttgaaaaggtggctactgctctttttcttatactgattttctttgggggcgtaataagtagatgtttagctggcttcttaaattttgtttagttactattctaaagaaaggattaaaatatatgtgtgattttgcagtaaatagcttcatttaactggttcccattgcatgtttgttcctgctaacttacgctgtagtattttctgttgtgtctttccttttagtaattattttatttgcttttaggtgtgtcttgagagtttttctttattgtggaaagatgtgcttctaattactatgtgatacagctaaataacaaaaagcaattatgaaaagttataattaaagtataattaaggatcatggaaagcaaaactaggtttaggaagtttataattttgttttagaattatagaaattatggacattacctgttttattatgatttttccctgatcatgtgaacatttcaatttgaggagcatcatgttaacctctagcttgttataactaattaggtggatctctcagtccttgaaatctatgtattcttttgtttctgctttctttacaaatgactaccctgtctctccaaaaacatcttctcccatcttttggtttggttgatttatgtgaaatatgaatacagacagaggcctttaagttgtaggagcatcattcagtgataaactcttccagaggaccagagcagcaggacatgaatcaaggtatctagagtttgtggaagccttcaagtattatggggccaggttgacatagctgaattgtatagtcttttacttaaaataagtactagtaactggattagggaagtatgttaataatctagatgtttaattagaatagatgtttgttttgacttttggtatcagagtaaatcataaaataatgaacatagcaaaattttacataggtgaattctcaagtacataaaatatattgtataggtaagtggatctcaacttgtttttctgtttcaatataactcatacacaaccgtaatcacaatgctaatgaatgtgtggtgagaaggagttagaatttactatagtgaaggccattgtagtttgagtcccctcccctgcaataattctgaaatttcccccagggtagtacttactgcggtctcttctttaaaaaaaaatcactcttttaaaatatatttttcctaatagttttagatatttcattaccttaatttttctgtatttaagaatttaaggcaattttaatgcatgcctatacaaagaagaagtgtccttaattctgaaattgtttggcccaaagctacactgattggtgtgtgatacttgtcctttgcatctcattatcactttttcctagtgaggccctactagatccacgctagtgaggaatccagcgtaatggactttggtttctttatgctaaccatatttctgtaattaccaacttatatttaattcattatgtattttattagtcaatatatagcttttatttaaaatccatttctgtattcttttggcagttgacgtctggagattttattttgaataaaaggccgagattttacttatattaaattttaaaagtgaaaattatatttatatatagtaacattaagaactcttaagtatagttccttatgttaaggacagtaattcattacttttgactttgagattaatacttagaattatgtaacattatgtagaaatagttctctcttataatggttcatcattttctttctttggttttctttgaatggttttatttagttattaaaagtttaagaaacttgtgtttttttaaagaattggactggagcgctgattttgcatttagaattaaaatttttcatttggcaaaataactatgtattacataaacatacctcatatcatttgctgtgctgggaaaaataaatcagtcacgatggtacctctgtatctctttatcttctatctcagccaaaagttagatatgcaaagggcaataatagcatgggtagaagatatccaaactttgagaaagggtttataaacgaagatgcatggaaaagttgccgagcttcattttgttataaaatagtacacttatgggcatctgatctaaataatatttaaatattattttctagcaaagatcttcaaggaccagatgcagtttattttagagattttttttatatcatgtgatgtaatattcttaatagatttgggaattaatgtgttgatttacttctaggattcttaatcattcaacttctgtgatgagaaacaagccaaaacaaactgtggaatgtgaaaagaggtataaaaatatcttagtttttacatttaatattttataatgagtattgatcctttgacagtgatgtttttgtatataggctttaattaaataagtgatacagatttaatataactagataatttaaataggaaatgttttagaacatgagttaaatttacttttgatgtaagcaaaataaaaaatgctgatcttttttgctcatagatgcatttttgtcttgatagaatcatttatttgttcattcagtgaacatttattatattgctattcctgccaggaataatgtgtttctttatcattgattgtgtttattctctatgatactgtttatgttttcatttcttttcaattgggtggtactaaattcttctatgtgaatacatgatataaatccacatatatgaattcctgagaactagaagaccttgaaagtttctatttattctttttgatggtttgaatttagattagactcaactcctgagtcaatcctctgagaatgttcaggcccagtctttttctgcttggcttattccagcagtcccaagacatagctcctttttttcaggtttgcctagctttaagtctgtcttctgcacaatggaagagtgataattctgaaacaaatcttacttgtgactcccatttattatcttctaatgactctttacaacttttagaataaaccttaaaatatttaacttaacccataagattgaggtgggtttctgcttaccctgagagcttcatcttgtacattcccccactggcaccatttgcatttaggaacagaacttctttcttcattctcttggggaagttatttagcttactctgagccacatttaccccttctataaaacacaaataataacagtgtctacctcatggttactgtaaggatgaaatgggttaatgtagtaaattgcttatgacggtgattagcacacagaaagtgtcacatatgttattagttgttaaactaagttattactattgtgaactttcttatttttcctttcttttgtatctcagcccttcctttttcaattctaacctccttttttgttcaaaagggaaatagctttgtgggtattctttttctggtattaagaagtattatatgaccttaacttttttttctttttttaaattatactttaagttctgagatacatgtgtagaatcggcaggtttgttactaggtatacatgtgctctgatggtttgctgcacgtatcaaaacacattaaattatgggaatatattttaaattctgtgacttttttcagcagtacgtgggtgagcacaccccaccccttccccacctttagaaaaatctcacatactttctgttaacaaaaatgagatcatactgagtatactatttagtaatatgcagttttcacttaatattatagtgatggttttatatacctactaaatctaaatatacattttgatgaactttatatatcctgtacacttgtattttccttccttccttcctctctttctctttctctctctctctctcttttttttttttttttttttttttgacagagtcttgctctgtcgcccaggctggagtgcagtggcgcggagatgagatttcaccatgttggccaggctggtctcgaactcctgacttcaagtgattcacctgcctcagcctcccaaaatgctgggattacaggtgtgagccaccacacacctggcccacttgtattattttcttaacttaaatgcttaaagatatgttattgatggattaaaacatgagtgtacatttaaagcttttgatatgttgtctccagaagcttttatgtttgcattcccacaagtaacacatggatagctttacttccatacttgttaacactatacattatcaatctatttaatctttgccattctaaaaagaacaaattatatcaaaatgttttatttttcatttcagtgattaaattagtgatgatgagtattatttcaagtttttattgcctatctatattgcttcttttgtaatttgtttgtttgcatctgttgtggtcagaagcactttctattgttgaaatatattgagtatttttatggcccagaatatggcctatcatggtaaaagttctttaggaacttggaaaaaaatgtattctgtggttattggttagagtcttatataatgtcaactatgttaagttggttgatagtattgtttaaatcttcaataccttacctattttctgttttcttgttctatcagttagtaagagaaggttattgaaatctccaacactaattgtagatttatctttctccttgcagttctataatttttccttcatacattctgaagctctattattagatatataaatgtttaggattgtattgtcctcttggtgaatttgtactgtcattctgaaatgacttttctttatattcttgataatattctctgctctgaagtccacttttctgatattaatattgtcagtccagctctcttttgtttagtattagcatgatgcgtgtttctccatccttttatttttaactgatttgtgtctttgtagagaaagcgcatttcttatagttagcatatggtagtatcttcctgctttttattgaatctgacaatctacgttctaattgcaatgttaaaaatcatttatgtttttgtaattaatgatattttgaggtttgctgtatgttttctttctgttctatcctttttattcatttttcctccttctctgttgtcttttgaattatatttaaaaatttttgtttatttcctttgtgggcttatttgctgtaactttttgttatgttaatggtttttttaggggttagagtatgatatttagcttatcacagtctatcttcaagggctattatgccatttcgtgtgtcatgtgagaaccttagaacagtatacttattttttttcctttttagccttggtgtgttgtcatacattttactttttatgtatctgttatgtgtaccataacaagttgttatttatgctttaaacagttatttgttcttaagaacatttagataatcagaataatgtcttttatgtgttcaatcccttagttactatctccagtgccctttattttttgtgtagattcatatttacatgtgcatcactttctttctgcctaaaagagagattttaacataattttactactggtctgctgattgaatgcttttagcttttctatgtctgaaaaagtctttttttaaattttttttttttaaacaggatcttgctctgtcaccgaggctggagtgcagtggcgccatcacagctcactgcagctttgacctcctgcactccagtgatcctcccacctctcagcctcccaagtaactgggaccacaggcatgtgtcatcccacccagccaacttaaacatttttttttttttttttttgtagagacagggtctcactatgttgcccaggctggttttgaactctcggtctcaaggaatcctccttccttggcctcccaacgtgttgggattacaggcatgagctaccatgcctagctcaccttcgtttttgaaagatattttggctcatacacaattctagtttgacattttagttttcttcgagtaccttgaagaggtttctccaccatcctctggattgtactgttttctatgagaatattcttatctttgttttactttgcctaatgtgtccttttttcctctgggtgtctgtaacattttttatcactcgttttaagtaatttgatggtgatatatcttggtgtagttttcttcatgttacttttgtttggagttcattgagcttcttgaatttgtgggtttattttcatgaaatttgaaattttggggcccttatttcttcagatatgttttctatcatttgacctcttctattatggaactccaattaggccacttgaagtttgccatggaacattgatgttctattcattctttaatatttttctgtctgtgttgggttttggcaagtccttctgctttgtctttgtgtttgctagtcatttcttgtgaaatgtctaatctgcagttaattccatccagtttgttttaatttcagatgttgcactttttatttctagaagtttgattatgtctgtacttaacatgttcagtcttttcctttagcttcttgaacattgcttggttgaatttttgattaaatgacagacattgtgtactttacattcttgagtgtggatattgtattattatacatacttttgacttttgttctgggatatggttaaattacttggaaataatttgatattttgggacttggttttataatttatttatgtgggaccagtgcagcatttagtctaggaataaatttgtccccttaatgaggcaagacatttctctactggatgtcctgtgaattatgaggttttccagtttagctggtgggaactggtactactcctggtcctctgagaatctgggaattattccctctaagctttgagggtgattttatccttttgcctagggtattttcctcacatacatgttcaatgatcagtacgctcagatgaaaatttgagggatgcctctgtagatctctttcctttctctgtgcattgcccttttgtttgttactgtgtgctatgaactcactctgcccttttctccctggctccagctctgtctcctgaattctgggcctgctagactctgccttagtttttttctcctgggatgtggactggaaactctttccatgcagcaacttggctcagttatgggatttacctccttactcatctctaaaggataatgtcattttttgcctaatattcaatgtcatggaaggcataattttaaatattttgcccattcttttagttttttcagtcaggatataaatctggtcactgttagcctatcttggccactagcaaagtctagtttttacattttatgtgttcaaatttgttagtatttaattttgattgtttgtcccataggctctctctattccaatatttaaaaaattactgcctgtatttttctgatactttgtgatttcttctttatatttaaatcttttaatttttcattttgatatttggtatgaggtaaggaatctagttttcttcctcccccacctttttctcactgtgtctcctcccccttttttattctttctttcagtgtatattttacacgtgatcaatcaggtgtctctctactacttgttatataagccattactttcacaatgatcttaaatgtcatttttttcagaagttattatactcgtggtcctgtactcctcttccattgaaaaatctgtagattctggagctagtagaaaggagggttgaaaagtcctctttattatataacttttctcttcgtgatcatccattcttccaaattaactttggaactcctttgtcaaatgtttaaaacaaaccaaaaaatacttcttgagttaaaaaaattattattacagttcatttcagttattaattaagttgaaagagaagttatacctgtaatacttatctatccaagaaccttttggttattcaagtctcttactagacatttgtagttttttcatgtaggtcttgtagaagtatagttaagtttcttcctaggtattttatacttttctttccttctatgaatagcatttttttctaatatatcttttaactcattatagttgatatgtaggaaagctattaacttttgtatgtttttctttaactggtaaccttacctcttataataatagattttttgtctttttctcttggataatcatgtgttctataaattttaaaaattggatctttatatccaatttttattttctttttgttattgcactatacagaaattccacaatagtgttaagttatagcagcttcagtggacattttgtttatatattttttccacaggaactccttgttcaaaattgccatctaacaacagcatgcatagtctgccttatctcaacaacaaaaaattagatgaaaataatttccttcatagcccctgttttgttagaatgaacaggttgcatctcataatcagtaattcagtaggcaaaaataactactcgcttgagctctttggcatttagacaaaggaaattattagttttttttagtctttgttaattattttaatataataaatatcctgtctgtcctttgacaatatatctttagatatttcacttattttagcttctgggaattccttagaatagacctatgcatagggcctacatagaataaacccattttgatatttcctgtagagcaacaggttttagaaacttaaatatatttctgtcaactttaagttttatgttgttaggccaaagtgtagacatgggtaaattctttacaatgtttttaaaaagataacatctaaggttcataatatatatttaaggatttattctaaatattttaacgtattaaggcatcttcaattttttagtgtctcagcagatgaagttaattcaccattatcacccctcacctggcaggtaagaagaaattaaattacaattatatctatcattttgttctcttttatttagttaaaataaattgtctcattatagcccttagaaaatcagaaggatcaaatagatgaacaaccgtggccagaatctcaccctataatctggcagagtgaagaaaggaggcggagcaaacagattagaaaagaatatttcaaggtactctatattaagtttttaaatttactttgtaattattagtttttattttgtcagttttgttttgagttaataaggtagactgtaactctctagttaaatgtagtaaatgtgttattttgatttctcacatatatggggtaatacaatctaattatatccataaggtttcagtaattgagaataattgagtagataaatataaattatgatttaccaaatactttgcaagatagacgaatgtttgctgcactgctagttgtagcaatatgtagtatgttttaaaagaattgtccaggaaaagtctttcattggatttgtttcaataaatatttgacacatatttacaattagcatttaactgttcctatgtaaataagtgttgtttatatagttctgaaaatgcttgagggcagatttttccatttttttcttcttgttaccttagtagattgcttgagtgtcttttatcttagctaaaagaaaagctcagatcatccaaattatcccacatttctagttagcagggttttaatgaaattttactgtgtacacatttgtaaatattgtattattgtctatttgtgattggggtctgctgtatttgtagaagccaatcattagaattcagaataatattcaatactagccagaattcattactggatttgactcaaatgaatagtacaaacaagcttctgctccatgaatagcaaattttgttgtctttgtacacgttttatgtttcccaaagcctaattattattagatgataatagtaatttcatctgaaacatagtactagtctacattgtaggttcaagtttatatcactaataaataggattatattctctgtttttctctggtagaaataggtctgtatgcacatttgtttgtttctatatatgggtgtgtaacatacatttggaaatagtatcatgactaaaacaaaactgttatatgtcttagtggatctgtggtaaatttaagccttcaacaaataaatactgagtccttttaatgagtcttacatttcctggtcaatataagagataacaaagaaacagaagacatgaggaaaaagggaaggacattctaagtagaaccctggtcaataatagtgaaagtttatttatcctaaccctttatacatctgtaattgtgtttacattccagcattattttaaagtttccctttttagttcattggaccttgaacaaagcactgaataaaatttgcttgtagataaaacttagtgaatgactgatggtatgggggaaattttagtagtatttcatataataaaagaaatttaatatttatttgctctcctttattgtagtataacaatacaaattcttagtatactaccaatatcgtagtataacaaaaccagttctcctttatcatagtaacaataccaattctgactatttgtcaaaaaacttacatagcacttattaagtgccaggcactgtcctaagacttcacaaagatcaactcatttaatcctcataacaaccttatgaggtaagtacaattatgactatttctgttttacagatgatgaaattaaggcacagagatgcaaagtagtattcttcagttcacttagtaataagtggcagagttgagatttgaacccaaagcctatgctaggctgcctctttatctactgtgtatagcttaatatcatatcagcaaacactttcaaacaaacacagttttactggtttttaatttttttttttaagagacagagtctctctctattgcccagactgcagtgcaatagcgtgatcatagcacacagcagcctcaaatgcctgggctcaggccatcctctgggctcacgtgatcctcttgcttcagcctccccagtagctagaactacaggtatgtcccccagtgccctacaaattttaaaattttttgtagaggtgagatcttattatgttgcccaggctggtctcaaattcctggcttcaagagatcctcccatctaggcccccccaaagtgctgagattactgacatttttggcccacttttagtgtttaaaaaacgttttacagtaacttgagtggacttctcaagatgtcttaatagaggccacattttaaaaatgtgcattttaaaaactgagcattttaaaaacataattctttggtttcatagcatcatttattggtattttattttttataaaataaacatcttctataatattagttatgttataaagttattaaaagagatcaaatgatataatatttgaagtgctcattacataatcatcattcaacaaatgttaatttttttccttaataaattaggtgcaaagataagcttcagtcactgggaaatgttttaaggagatgtgtagttctcctaaattgtcagaagatgtcagtattaggacatagtaaaatgagtatgtcactagttttttttcctaagatgtcaagaaaatataaaactgacatacagtttcctaaattaaatcaacactattattcagaattgtcactattttcatgactaaaacatcagcagcttctaagaggaaatttctcttaatcacctatctcccgataattgaaagtgctattggtaggttgtattattaaagctaatctggatttatagttcattaaacagtaaaatacactacacttgaggtttatatcagattatcactgagtttgttcaatggtggctcttttaggttttgctatgttacgaaatgtacagaacttttgtgcaactttatcttaatacgtataaatgactgaggcacaggatttctttgtttctgtcccatggtaaattatttgtcatggttattcagtgtatttattgaatgtgtgtgtgtgtgtgtgtgtgtgtgtgtgtgtgtgtgtgtgtgtgtgtgtgtatgtatgtaagaaatccaactgtatttcttcttagttttgaaggctaattttggatagtatttttttcaggtaagtccctgaaactaggtaaaactgtttcaacatattggctagattatgtgagcaagaacacaaattgggtcaggttaagttagtaagtaaatcatggtaggaaagttacattgactcttttagattcccaggccgctatcgtatagattattattctagtatataaaatttagtgttcttatagccaaaataaaatcactgtatttcagggaacttcatgatgccaggaagtattttattaaacatctttttttattttaaatttttaatttttggcgttcatattaggtatatatatttatgggatacatgagatattttgaaaggcatacaatgttcaataatcacattatggggaatggggtatctattccttcaaacatttatcatttgtgttatgatcaaattatactcttagttattttgagatgtacaattaaattattattgactatagtcaccccattgcgctatcaaatactaggtcttatttattctattttttatgcccattatccatcttcacctaccctctactcccccactacccttctctagcctctggtaaccatccttctactctctatctttatgagttcaattgtttttacatcctacaaataagtgagaacatgtggtgtttgtctttctgtgcctggcttatttcacttaccataatgacctgcatttcaatccatgttgcaaatgacagactctccttctttatggctgaatagtactccattgtgtatgtgtaccacattttctttatctgttcttctattgatggacacttaggttgcttccaaatcttggctattgtgaatagttttgcaataaatatggaagtgcagatatctctttgatatactgatttcctttctttgggttatatacccagcagtaggattgctggattgtatggtagctgtatttttagttttttgaggagcctccaaactgttctccatattgttcgtactaatttacattcccaccaacagtgtacgagggttcccttttctccacatcctcaccagtatgttattgcctgtcttttggatataagccactttaactggggtaagatgatacatcattgtagttttgatttgcatttctctgatgatcaatgatgttgagcaccttttcgtatgccagtttgccatctgtatgtcttcttttcagaaatgtctattcacatcttttacccatgttttaatctaactattagatactttcctaaagagtcgcttgagctccttaaattctggttattaattccttgtcatatgggtagtttgcagatatttcctcctattccgtgggttgtctcttcactttcttgtttcctttgctgtgcagaagctttttaacttgatgtgatcccatttctccatgtttgctttggttgcctgcgcttatggggtagctcaggaaatttttgcccagacctgtgtcctggagattttcccccatgttttcttatagcagttttatagattgaagtcttagatttaagtccttaatccattttgatttgatttttgtgtacaacaagagataggggcctagtttcattcttctgcatacggatatccagttttcccagcctcatttactgaagagactgtcttttcccccgtgtatgttcttggcagctttgttgaaattgagttcactgtaggtgtgtgaagttgtttctgggttctctgttctgttccattggtctgtgtgtctgtttttatgcaagtaccatgatgttttggttaccataggtctgtagtataatttgaagtcatgtaatgtgattcctccagttttgttccttattcccaggatagctttggccattcttggtcttttgtggtttcatctaaatcttaggcttgatttttctatttctgtgatgaatgccattggtattttgatagggattgcattgaatctatagattgctctgagtagtatggacattttaacaatattgtttcttccaatccatgaatgtggaatatctttccatatttgtgtgtcctcttcaatttcttccagcagtattttatagttttcattgtagagatcttttacttctttggttaatttctaggtgtttaattttgtttgtgagtattgtaaatgggattatttttaaaatttcttttttagattgttcactgttggcatatagaaatcctactgacttttgtatgttgattttgtatcctgcaactttacagaatttatcagttctatttttttttttttggtggagtctaggtttttccaaatacaagattatatcatctgcagacaaggataatttgacttcttcttttccaatttggatgccctttatttctttctcttgtctgattgctctaggtgggactcctagtattgtgttgaataacagtggtgacaatgtgcatccctgtcatcttttagatcttaggggaaaggctatgagttttggcttttattatgttgagatatatttcttctataccccagtttttgagagtgtattagtctatttttatgctgctgataaagacatacctgagactggtcaatttacaaaagaaagaggtttattggactgacagttccacatggctgaggaggcctcacaatcatggtggaaggtgaaaggcacgtcttacatggtggcagacaagagaagagagcttgtgcagggaaactcctgtttttcaaatcatcaggtctcatgagacttattcactatcatgagaacaacacgggaaaaacctgcccccatgatttagttacctcccactggtatctcccatgacacttgtgaatcgtgtgagttacaattcaagatgaggttttggtggggacacaagcaaaccatatcagagggtttttatcatgaaggaatgttggattttagcaaatgcttgtccggcatcaattggaatggtcatatgatttttgtcctttattctgttgttatgatgtatcacaacaattgatttgcatatgttgaaccatgcttgcatccctggaataaatcccacttggtcatgatgaatgaccttttaaatatattgttgaattcggtttgctagtattctattgaagatttttgcatccatatttatccgagattttggcctgtagttttctattttggatgtgtctttgtctggttttagtattaggctaatactggccttgtagaatcagtttgccagtattccctcctcttcaattttttgaatactttgagtaggattggtattaggttttctttaagtttttggtagaattcagcagtgaagccctcaggtcccaggcatttctttcctgggagactatttattacagatttgatctcattacttgttattggcctgttcacattttggatttcttcatgatccaattttggtaggttttatgtgtctaggaatttgtccatctcctctagagtttccaatttatcggcacatagttgttcatagtagctagtagtggcccttcgaatttctgtggtatcagttgtaatgtctcctttttcatctctgattttatttgggtcttctcccctttttatcttaatctgactaaaggtttgtcaattttgtttatcttctcagtaaaccatatttttgtttcattgatcttttttatttttcttcatttcaaatttatttatttctgctctgatctttattatttcttttgtttttgtttgtttgtttgtttgtttaaaccagagtctcactctttctcccaggctgaggtgcagtggtgtcatggctcactgcagccttgacctcccagggtcaagccatcctttcacctttcagccttccaagtagctgggactacaggcaccaccacacccagctaatttttgtattttttgtagagatggggttttgccatgttgcccaggctggtcttgagctccttggctcaagcgatctgcccacctcacgctcccaaagtgttgggattacaggtgtgagccatgacacctgggctgtttcttttcttatactaactttggatttggtttgctcttccttttctggttctttaagatgaatcattatgttatttgtttgaggtttttcttctcttttgatgtaagcacttatagctggaaattttcctgttaatactgtttttgctgtatcccataggttttgctatgttgtatttgtattatcatttgtttcaagaaatttttcgatttccttcttaatttcttcattgacccactggtcattcaggagcatattgtttaatttccatttgtttgtatagttttaaaaattcttcttcttattgatttctggttttatttcattgtggtcagagaagttgcttcatgttatctcagcaacttctttgttgtttgactgttttaagacttattttgtgacctaacatatggtctatccttgagaatgatccatgtgctgaggagaagaacatatattctgtagccactggatgaaatgttcagtaaatatctgttgggtccatttggtctatagtgcagattaagtccaattgttctttgatgattttctgtctgggagatctgtccagtgctgaaagtggggtgttgaagtctccagctattactgtattgagatctatctctcttgagctccaataatatttgctttatatatctgagtgccccagtattgggtgcatatatacttacaaatcactatatcctctgactaagtttacccctttttcattatataatgaccttctttgtctcttgttcatttttatcttgaaatccattttgtctgatataagtatagctacacctgctcttttttggtttccattggcatggaatatctttcttcatccctttattctcagtctatgtgtatcttcgtaagtgaactgtgtttctttttttttcttttttctttttctttctttcttttttttttttttggtggagtcttcctctgtcacccaggctggagtgaaatggcatgatctcggctcactgcagcctctgtctcttgggttcaagcaattttcctgcctcagcctcctgagtagctgggactacaggcatgtaccaccatgcccagctaattttttattttttgtatttttagtagagatggggtttcaccatgttggccaggctggtcttgaactcctgacctcaagtgatccacccccctcggcctcaccccaacattgctaagctaaagggaaaggtcaagctgggaactgcttaggggaaacctgcctccaattctattcaaagtcaccactctgctcactgagataaatgcatatctgattgcctcctttggagaggctaatcagaaacttaagagaatgcagccatttgtctcttacctacctatgacctggaagtcccctggccgcttccagttttcctgcctttctggactgaaatattgtttgtcttacatatgttgattgatgtcttgtgtctccctaaaatgtttaaaaccaaagctgtgctctgaccaccttgggcacaggtcatcaggactgcctgaggctgtgacacaggcactatcctcaaccttggcaaaataagctttctttttttttttttgagacagagtcttgctctgtcacccagtggcgtgatctcggctcactgcaagctccatccccaaggttcacgccattctcccgcctcagcctccagagtagctgggactacaggcacccgccactatgcctggctaattttttttttttgtatttttagtagagacggggtttcaccgtgttagccaggatggtctcgatctcctgacctcgtgatccacccctctcggcctcccaaagtgctggaattacaggcatgagctaccacgcctggcctcaagtgtgtttcttgtaggtagcaggtcattgtgtcttattttttcatctattcagccattctatgtctttttattttaatagtttagttcatttacatttagtgttattattgatgttttattctactgcggccaagatggcactcacaccacaatacaaagtccttgccactcttctttcccctttccacaggtagaggaacctctctcagtggccaccaccaccactggcccatgggaggttctgctagcccgctgctcatgttctgttaaagcccaagggctcttcaatcagcttgtggtgaatgctgccagtcctgggactcaccctgaattctggcttggggcaggtccagaaatgctgcccaagagccgaggcctagattcctgaactccaagagactgcttgttgcttacctcactgtgtctgagtgggttcctaaggtgccaaattcccctttgtttttccctctgcttttctcaaacaggagactctccatgtagccacgacatctggttttgtgctaagtcttaccggacgccagcacatctcagtctctcccaaggtccacagcatactacctgggtatttctgctggttattcagggcccaagggctctttcatcagctggtgatgactcctggcaggactgggtccttcccttcaaggcagtgggttccctttttgcccaggggtatatgtctagtaatgtcatccaggagctggggcctggaatgggggtctcacaactctggccagtgccccatcctactgtggctgagctggtatccaagaggtaagacaaagtcctcctcagtcttccctgtcctgtcctcaagtgaaaggaaggggtctctttctcattgctgcgagctgcactgtctggggttgggggaggagtggtgcaagcactcccttagccacccctgctggtgtctccctaagtcacatgccaccctagtacactggttctaagcttagcacagcactaggagttgcctagaaattgcaatccttgtgccctagactgcctttcaagtttacctagaaccccagagtactttggcctgcgattggtgaggttactgagaaacttaagttcaagctgctggcatgagcgattcccatctggttagggctgatccaaatgctcccgccatgcctgggtgcttgttgagcacagcacaactttgttcccctctgtggcagggcagcactaagttcaatgtaaagccccccagtccctgtgctctccctcccccaagtatacaggctttctctccctgcactgctggctactgtgggtagctggctaatttttgtatttttagtagagaccgtgtttcaccatattgtctaggctggtctcaaactcctgacctcgtgatctgcctgcccaggcctcccaaagtgttgagattacaggcatgagccaccgtgcccggccacaggtgaatttctaaatgcatttaataattgatttctagacaaaacagttaaaaagtattagagtatctgtagccagttagttttaaatattatttgatttatttaagtggcatatatgtcttcaaatgtatctcattactattatgataaaacataataactcataaaatacatattgatttcataaatatagtacactatttttatttaaaggttaaccccctggaaaatattttgacacattttctatgatcattgttcgttttatatgggagtaaagaagccactgggattgtaaaataacctgatttattctgagtcagagtttatgcacaagttattgtctctcttttgaaattattacaagcttctgaggctagtccgaattcaatggtgtttacaacgaattgctcacaattacacatttgtttattttccactcctgctgcttcacttgactagcctcaaaaaatatgtatatgtatatgtatatgtacataaaagcttctgagatggactgacctttctgtttttctggtttttaaactaggcctttattgtaacatttgaatttagatgtaataaaacttcagtaattcagaattcagattaatactagttggggatagccgagttgaattagtaaaaacttggaattagagagtattttcaaatctatgtatatattaggtttggagtttcaagacatttaaatatgtgcagtaatgcaaacttagcatctttctaagttttcatgtataatgagtattttaaattagaattatagttgagtaacagtaatacatttcccattttctaagttcttaagtatatcatcttgtatttctttgcatttcagttatcctcttattcttctatgtctttcctgcctctttacctttcaccttataaatatgctcaaacctctgttatagggaagaaaaagtagtatcttttccctactcgttgcaagaatgatagctgacaccccataacaaaagatggattaacaagagaaaagcataaaaatttactcaagtttttatgtgacacaggatccttcagaaatgaagacccaaagacccagggaaaaccgtatgttcatgctaagtctgatgaaagaaatgaatagttgtggagacacgtgattgaacaaaaaagggtatgatctaatggtaacaaactgggcctgtttgttgagaatcttttctgtgtctctctatgacattccttctccttcggtatgctgcaggaaacctgtcacatgcatcttaaagggagaagggaggaggtcagagagtgacctttctagattgtatggcttgctttgtgagacggggaattctagtttctattacctgccttagggagaggaaggggggcgaagaaaggggggcctggagaaggtcagagagtgaccttgaaggtgccatatcttggggtagtattttctgagccctgacactaccattatccctgactgcccttttagctgttgccttatctctttgctctcttttagggctaaactttcttttttttttctcttgagacggagcctcgctgtgtcacccaggctggggtgcaatggcgtgatctcagctcactgcaacctctgcctgccgggttcaagtgattctcctgcctcagcctcccgagtagctgggattataggcaccctccaccacacccggctgatttttgtatttttagtagagaaggggtttcactttgttggctaggctggtcttgaactcctgaccatggccagggccaaactttctatttctagttctccagtttctgatcattccttaacccactgcaatctggcgttcgcttccatttctccattgaaatagcccctcgctagattttaacatgcacctactaatggcaaaatccagtgtagcatttgacaatgatgaccacatcttccttcttgatactcctgtcttggtttctatctcatttttcttccctgttatcattttgatgtccttctctaacttttcttctgcttgctcttagggtctgatcctcattttattactctaaaaagctctctctggagtgttaatgactctagatgtttcttatattctgctgtgtctaaatttacatcctataactttttttctgttccctaaatctgtgtttctaattgtttggatgccctcattcccatcacctaattggttatcagccctaatatatgcatcgtttctgcaattcatgtctatctctattgcccttgccctttttggaaccctcatactttcttgcccaggcaattgtgataactgattaatggtcctcctttctcagccgttggataattctctggctttaaatttctttattctagtgttcagtagcaccataggttgactatagttaataataatttattatatattttaaaatagctagaagaaaagattgataatgttcccagcacaaagaaatgataaatgtctttgaggtgattaccctgatttgatgattacacattgtatgcatgtatcacaatatcacaagtacctgataaatatgtacaattatgtatcaataaaaaataattatcagacaatgtgagaaaatgcccttaaataaaactgtaaatctgtaaattttctcttaaatctgtaaaactgtaaatcatccaaaaaacttcttactggcttcccattaccaataagataaagtttggatttgttaaaatcttcgtggaccattccttctttccttttctatatttcattacctgccaaaattcactttcctcactagcctcattaaactgctctttgttttctacacaggctgtgctttcttagttctttttgcttttcttcttctgagaatgcccattagcccttttatctctggcaaattcctattaattagtgtttagaaatgggagtatagttgtccctctgtatctgcaggttccacatgcattcagccaaccttgattgaaaatatgtggggaaaaaaggcaaaaaaaaaaggtaaaaataatacaaataaaaaatatagtgtaacaactgtttagatatcatttacattgtattcagtattataagtaatctggagatgatttaaactatacaggaagatgtgagtagcttatatgcaaatactgtgccattttatgtaagggaagggacttgaatatctgtgaattttggcatgggtgaggcgggggtaggggtcttggaaccaatcccttgcagatatcaagagatgattttatggcacagtgcctgggcttatagaatcaaaccacttgtgttccagtccttacttggatacctattaactatgtgactttgtcaagtcatgtaaccttaattaagtttgttttttaaaactttataaatgagtgtaacagtacaggcatacttaagagatattgtgggtttgattccagacaatgccattaaagcaaatatctattcaataaagcaagtcacatgaatatatatcaataaagcaagtcacatgaatattttttggtttcccagtgcataaaagttatgtttacattgttctataatctaagtgtgtaatagtattatgtatgaaaaaatgatataccttaattaaaaatactttattgctaaaaattactcacaattatctgagccttcagtgagtcataatctttttactggtggggggtcttgtgtagatgttgatggtggttgctgaaaattgggtgaatatggcaatttctagtttgccacatcaatggactttcctttcacaacagatttctctgtagcatgcgatgctgttagatagcattttacgtacggtagaacttctttcagaattggagtcaatcctctaaaaccctgccactgctttatcaaataagggtatgtcacattgtaaatcatttgttgtcatttcaacagtgttcacagcttcttcaccaggagtaaattctaccttaaaaatccctaccttttttgcacatccattaaaagcaactccttatttgttaaagttttatcatgagattacagtaattgagtcacaactttaagctctacttctaggccaggcgtggcagctcatgcctgtaatcctagcactttgggaggctgaggtaggtggatcccttgagctcaggagtttgagaccagcttgggccaatggcaaaaccccgtctctacaaaaaatacaaaaaaattagctggtcacggtggcacatgcctgtagtcccctctacttggtcgggggtggctgaggccagaggattcttagagcccaggaggtcaaggctgcagtgagccaagatcacgacactgcactccagccaggtgacaaagtgagaccctgtctcaaaaaaaaaaaaaaaaaagaaagaaaagaaaaggaaataaaaactctacttttagttctcctgctgtttccaccacatctacagttatttcctccactgatgtcttgagcccttcaaaatcgtccatgacgatcagaatgaatttcttccaaactctcgttaatgttgacattttgacctcctctcatgaattataaatgttcttaatggcatctagaatgatgaatcatttgcagaggttttcaatttgctttgcccaggcccatcagaagaatcactatctatggccccaatagctttatgatatgttattacttagtaagacttgaaagttgatattactccttgatccatgcactgcagaatggatgttgtgcatgaaaacattgatgtctttgaacgtcttcatcagaactcttggttgactagactcattgtaaatgagcagtaatattatgaaaggaatctttttttctgagctcgatagtgggcttaacatattcagtaaagcatgctgtaaacagatgtgctgtcatccaggctttgcaggtctatttataaagcacaggcagaatagatttagcataattcttaagggacctaggagttttggaatcgttaaataaacattggcttcaatttagagtcagcagctgcattagcccctaacaagagtcagcctgttctttgaagctttgaagcaggcattgacttctctctatctacagcagtccaatagaaggctattttgtctacatagaaaatttgttgtttagcgtagtcaccttcatcaattgtcttagctagctagatcttctctataacttgcttcagcttctacatcagcacttgctacttcgccttgcacttttgttacgcagtcagcttctttccttcaatcttatgaaccaaccaacctctacagcttccagcttttcttctgcagcttcctcaccttgacttcataggattgaagagagggccttgctctggactaggctttgtcttaagggaatgttgtggttggtttgctattctatccagaccactcaaactttgtccatatcagcaataaggctgtttcactttcttatttttggtgtgttcactggaatgagtagcacttttacttttcttcaacacttattttgcattcacagcttggttaattggagcaagaggcctagcttcaccctatctctgctttctacatgtcttcctcactaagcttaatcatttcaagctttttatttaaagggaaagacatactatttcttttcacttgaacacttaaagaggccattgtgggattattagttggcctaattacaatattattgtgtgtcagggaataggagatagggaacaactggttagtggagcagtcagaacacatgcaacattgatcgattaagttcgctttcttatatgggcgtcgtttgagtcacccctcaaaaattacaatagtaacatcaaagatcaatatcacagatcaccataacagacatgataataatgaaaaagtttgaaatattgtgagaattctcaaaatttgacggacatgaagtgagtacgtgctattggaaaaatgacaccaatagacttgcttgatacagggttgccacaaactttttctgcacattttgaaactttgtatttgcacatttaaaaaattgtgtatcccgataaataaaatcactggaacaaaaaaactgatactctgattaaactgaattttatagcttgcaggacaccttgggccagcttggttttactctagctttcactgtcattccaccctgcttcttccttcaccaacattcaaattcttttccttatctgccagccaggcagatcggagaggcaagagcggtcttcattttcagtagctcttgattctttgatgtgagaggagcagcacagtcgtttaaacttgatccaacctctttgcatcttgcaaagtcaatcagccaaaagaagtaaaatatgaaggcaatgcttgtgcaatgtacagttcgttttcatgatgtatacctcattatgatttgtctgcttgcttctcctgtttggtcatttctttggaaggcagtggatttttttcttgtgttttttgtcttcttcaattttgacttaccaaatttctcaatcccagccatatcgggtttgttggatgtggttgccaaggaagtggagtaaggcgtttgagcaagcagaatctggtctgctcataactattaaattatttaataataaaagtacttagaattacacttgccacagagtaaccacttagtaaatattagcatattcactcaagtatcactgtttcattgacatagattaaaaccaaaaataagtgacttcagtgattgtcttgcctgataaataggattttttcacacgtgccaatttcattcagtggctctctggcacactgggttgaaggcatattgagattctgtgtgagatcacctggaaagaacatgctgctagattagtgatagttgccataggagagacagtggaggaagaatacgttttgtatttattatccctaatatagctcacttcccagtttttggctgagatatcaggttggttatctatttttccaagggttgtggttgagatatcaggttggttatctatttttccaagggttatggaagataatgctgcgtatgtaaaggggaccattaaatagaccaatggaacagaacagagccctcagaaataataccacacatcgacaaccatctgatctttgacaaacctgacaaaaacaagaaatggggaaaggattccctatttaataaatggtgctgggaaaactagctagccatatgtagaaagctgaaactggatctcttccttacaccttatacaaaaattaattcaagatggactaaagacttaaatgttagacctaaaactgtaaaaaccctagaagaaaacctaggcagtacctttcaggacataggcatgggcaaggacttcatgactaaaacaccaaaagcaatggcaacgaaagccaaaattgacaaatgggatctaattaaagagcttctgcacagccaaaaaaactaccgtcagagtgaacaggctacctacagaatgggagaaaatttttacaatctacccacctgacagagggctaatatccagaatctacaaagaactcagacaaatttacaagcaaaaatcaaacaaccccatcaaatagtgggcaaagcagatgaacagacacttctcaaaacagacacatgaaaaaatgctcatcatcactagccatcagagaaatgcaaatcaaagccacaatgagataccatctcacaccagttagaatggcgatcattaaaaagtcaggaaacaacaggtgctggagaggatgtggagaaataggaacacttttacactgttggtgggactgtaaactagttcaaccgttgtggaagacagtgtggcgattcctcgaggttctagaactagaaataccatttgacccagccatcccattactgggtatatacccaaaggattataaatcatgctgctataaagacacatgtacacatatgtttattgcagcactattcacaatagcaaagacttggaaccaacccaaatgcccaacaatgatagactggattaagaaaatgtggcacatatattccatggaatactctgcagccataaaaaaggatgagttcatgtcctttgtagggacatggatgaagctggaaaccatcattctgagcaaactgtcgcaaggacagaaaaccaaacaccgcatgttctcagtcgtaggtgggaattgaacaatgagaacacttggacacagggtggggaacatcacacactagggcctgtcatggtgtggagggggggggagggattgcattaggagatatacctaatgtaaatgacgagttaatgggtgcagcacaccaacatggcacatgtatacatatgtaacctgcacgttgtacacaagtaccctagaacttaaaatataataaaaaaaattgaccacaaatataactatatacaaatgtaaaaataataataatttaaaaaaatttacaaaaaagaaccttgaatgccaggcatagaaatttggacataatctgaaagttagtaggtgttacaacagggcagtcatgagttgtaaacggaaggttaatctgccactgatttgcaggatcatttgcagtgaagaggagtcagaagtaagaattccagtggttgtcatactgtattttcttgactctaagaagcattttttcacatataagcatggttcttatgtagtagggttgttaagaagattaaatgggttaatacatgtaagacatttaaatcagtgcctggcatatagcaagcactagtacaagtgttagctgtcatcattattacagttattgaacaatcaatatatacatttaatgtagtgttttttaacatgaaagcagtaggtttcttaataatgaatgacatcttagaatggtgagattatagaccaggtgtaagataatgagggcctggaaaagggtggtagttgtgagaattccaaagaagtaagtctgagagagattaaaaaaagaatcgacttgatgacatattggatatagtgaattaagaaaaaggaaaattctaagacaaccctcagattgcacacctgaatgaatgggaaatagcttggcttaagaaagaaatgttacttgatctgtataaagtacttataacaatgccttgcacatggaaagcattatttttgttagttattagtagtaggactatttacacctgttatatacttaaatttgttatcaggtaatgtaataaagctaccaaaatatgaaagaaccttgtacataatttactagtagagaatttatatgttcaagggaaaataaattatgtgttttaaatatttttcagtataaatcaatgaggaagagttcaagtggcaatgaaaatgatgaggtgagaaaagataatattaataattatttgaaatgtttacttatcatatgaagttggctcagtgagagtaaaatgtaatccatttttcagtttctttgttattgatttaatgcatggttttttttcaacaataaaaacatatgagcatcatcatacaattattaatttaatcatttaatttccatatgtcctttagaatggaattactaataattcagttttagaattttatcatcattcgtcttagacctgtcatatgtgagtgtgtgttgtctttcacatcttttatctttctaaatcagcctggtcgtcaattgagattttttttaggaactttgtttaggaactccttccacaaattctgcatgctattttaaaatttaaaattcgacttctacagtttgtgcattaccataaacctttctactgcacagtgtaaactatgcagcagcctatcattgttgaaaagatatattctcattaccataaatacttaagttttgtgtatttttgttggagagattggtatttaatttgatgttgggtacttggcagggcttctgaaaatgtcttcagttttaggaaatagaatcacacagggaaaaataatgaatagagccagatgattggtcgtctgccagctcagatgccgatttctctccattggcctctccagtagtatttactgggatgaataaaagtcagttatggctatagctggtcatattttcactgttagtatttatatttaagcctaaattacatgttttgtatgggtatgcttggcaatatttacccatgcatcagcacaatcagttcctgtacacctgcccaagctttccattgcaccaactccacaagatcccagcctaccctttaaatattattcccagggaatggcctactgtgtggtctctagcatgtcttcaccagctgtcaagccttcagtgaataacacctgtgtacctgctgaagcctctcagatttgtctgtagtccagacctctcccctgaggttcaagcccttgcaatattttatccatcttcctacctgcttagaatttctgctggatatatctcataaacccaataggactaaatatgttcaaaactgagtttttaaaaagtttttgcttctaaacccactttttcgctaatatccgacagtttgtgtagtggctctcaactttggctgtacactaaaattaccaggtgagctttagacaatactgtcgcctgggtcacaccccctagatattataatttaattgacatgtggtatgttgtggtatggactgagcaatgaagtttttaacgtttcccatgtgagtttaatgtccagccaaggttgagaactactgagttaatggaatcaccttccatcatctagctggagcaggggctggcaaattatgatccaggggccaaatttgacatgctgtatgggattgtaagtaaagctgtatcagaaaacagccatactcatttgcctatggctactttttcattactgtggcagtgtttgagtatagtagctctccttttttctccatttcactttccaaggtttcagttacctgtggtcaaccacagtctaaaaataggtgagtacagtacaataagacacttagagagagaccacatttacataacttttattacaatacattgttataattgttctattttattattagttattgatgttaatctcatacctgatttataaattaaactttatcataggtatgtatgtataggaaaaaacatagcacatatattataaagggtctggtactatctgtggtttcaggcattcactggggttcttggaacatattcctcatgaattgggggacagttagttgtcacaaagcctaaaatatttgtcatctgcctttgacagaaaacattttcttatccctgcctcctcataccctcttttctcttgcctgcctcaatatctaatcagcagccaagacttactgtttgtttatttgcactaaaatattttgcatacattccccttttatttctactgtttctgctccggcagaggccctcgtccatttcttgcctgttctactgcaataacttccttgcacttctccctttctctagtccattctcactgcagccagagtggtcgtttcaaagaacacagatgcaatcaggccattcccttgcttggaaaccttcagtttccccccataacttagaagataaattctagatcctcctttatcaagcccttgcttgccacatcagccttaattcacaacttgctcttctttcaccttaccctccattcaccttaccctccaacaagacaaaactgctcagaggttttctgcactcatctttacatttgttgcttccatgctttggttcttctcctctcatcttagcatgttgttcccttctttctttttctggtagacactcagttttttactgaatttatactttctcaggaaacttgcctttctctaccatcttcatcatcccccccaagtgccccttatctgtgcctcataatatgccatgcattgttctgtattatactgagaatgttgtattacctgtatacattaatctatttctgtcctcgactgaaaggtccttgaatgggtgatattttactaaatttcagtactctcactgtctagcatagtgtctgacatatagtaggtagccaataatcatttgttgaatgaatacattttctatgtagtgtgcatattcaaagttaaatgtcaaaattttcatatttggttggcagtagaatagtcatttaaaaatcatggaccatttaatgttttattaaattaaattctttgtaattatcaataagcctatattagatacatgtaaattttcagatgaaagttatttggggtgatggagattttgcatgccttcatttacatgtctcagattggtaacacgtccctgctattatatgtagatagtatttttcaaactttactatatttcgaaccacttgagggtcttactgaaatgtagattctgattagttaggtctcgggtgaggcctgagattctgcatttctaaactcccagaggatccctatgctgctggtttacagaccacatgtagagtggcaatgtgctggatggcatatctttagtaggtcttcctttagtagttggtcagaacaatttttattttccttttatatgtttaaatcatcatttgtattgtaatttcatcttccatctttttatttttatgttttagcaagacagtgataatgctaatatgtcaacacaatctccagtatcatctgaggtacaagttctgtttttatttgtcttaaaaatacgttttgtatgttttctgtgttttacataagagtcttccttgccagttctctgtaacctgattttttttgcaatataatttattcactcatattttaaaatccgtggcagattagtttgtacaaaccttctagcctataaaaaattctaagaatgccattttttggtaaaaatattgatactagcacttgtttatttatgattttctgtagtgtctgtagtgtctgtagtgatttttggaagtgtctgtagattgcagaaaagaattcactttatcaaatctatgctttctcattcatccgtattttaaaataaatgatagattttaagaacaactttcaaattttaaatttgaaaaaagtacttcagcattgtgcaatggcctttggtttttcttgtaaccagttaggtctgaaaccaatgcaaaagaaatttcctttttccacgagaaacatccctgcagtgggttgttcctatcgacaggaggttacacgtttttgggagaatgggtatcagaaagttagagtttgtgaaatctcgatcaaatactctggtggcttgaatgactgattcttctaatttatttattcaagtctattgctttacaacaagagataaatttaaaaaattctaaactctatctcttctacttaagattaccttaaagtgtattggcattagtaagtaaatgattacacattcatttgatgaattcaacactttgctcaaagtgttggatggcccaaattcactgtgtaactttggttacatagatgctgctaatatttcattatatgtaggtggtgttgcttttttaataggctaggattctttgttgttgtgggtgatctgcattacaaaacttttgaatggatttggacattaattttataaacatgtttctaaattattcatatgataggtaaaatggtatacacacttttagaaaacaatttaaattaggatatcttaaaattagtctttgtcatatgcttttgtaattcttttactttaagttacaagtataagcatataagtgactactacttatttgtctgcttgatatatgattttatgatctgtgttcacagggaagactattcataccaaatttcccaaataatttacattgatatatatatacgtatatatatacgtgtatatatatatgtatatatatgtatatatatacatatatatatacgtatatatatgtgtatatatatatgtgtgtgtgtatatatatatatatatatatatatatatatatatatatatatatatatatatatatatatatatatatatatatatatatatatatatatatatatatatatatatatatatatatatatatatatatatatatatatatatatatatatatatatatatatatatgacacatgatctcactctgttgcctaggctggagtgcagtggcacgatctcaggtcactgcaacctccacctcccacattcaagcgattcttgtgcctcagcctcccgagtaggtaggactacaggcacatgccaccacacctggctaatttttgtatttttagtagagacagggtttcaccatgttgatcaggctggtcttgaactcctggcctcaagtgatctacctgccttggcctcccaaaatgttgagattacaggtgtgagttttgtaatatattttttatttcatttggatcagtgaaattttcatctaggaattcatattaatttaaccaaaatagtgaagacaaactgggaggcttgtagatttggatagggtggtgagtatgtatgtgctttggtaactcaactgacatttaacctgaactgcatatcacgtgttaacagaagatttaggtaatctacagaattctgattacattaatttcatgtgtgaatggaaaagagtaaaactaattggtgtaatgctttagtattaacaaagtgcttgcctgtatatttgtacctaaaagcagccccataaaataggtatgatcctcatcattttacagctgaagagatgggtaactttccaaactatcttagttaataaatggcagagaagtgactgaagctgagccctactcacttcacagagttgttgcacagattaaataaggtgctgctaagattacattattttatcatcatttagttatctcatttaatcttcacagtaacctcatttgaaagatgaagaaacaatcacagagaaattatatgttgtgctcaaaacatagcctaagctttctaactccatcttcagatttgtttaatgtactacaaatctttccatagcaaaccactgtgtgtgaaagatttgaaaaaatattcattcaaatagaagagatgatatttatcatctatcattctgcagtccctatacaaatatgtttgccttcagattatctactgttaggtgttaagtccatagtagatgctgagtaaatgctaaattcacttaccttttcattgaagcttacttctttttttcggaaacttcagtctgattctttcaaaaagtatgatctattttatacagttcactaatgattttcattttctttctactatgaaagtatttaaagcctatatggttagctcaactagcaaatattagttgacctcttaaaagtgacatgtatcaacttgaattgaaatgcaagttacttttctcttcactaatcataggaaaataagtatttccccaaattggaatggatgtgaataagcaccttgattattttgaaagaaaagaagttttattatttatttatttttaactttttaatttttttttaggaatatgacagaactgatggtttttcacacagtccctttggcttgaagcctagatcaggtaaatagatattctgtaaataaaatttattagttatatatgaaactagtttcccagcttaaatgggattgattccatagtcttaagtacacatagattctttcccctctcctaaaagcaattttctcttaacgatatttgtctttccaattcccattcccatttctttcttcctctttaccttcaagctcctgaaacctcagctttttgccttagatatactgcagtcttatttctactctactgtgactgctgttagaatgaccactctgccagcagaccaaacactgtttgaaattatagcactccattatattgtggttttataaagggatcttttcgcatttggcaagcccaaaagaaaatggatccatgttacttgtcaaggtattgaactatagtttttattcctgaataactgtattgaccttcaagaataatttccttttttaaaagataaaaggctgacatatgttcagtaatcatttttaacctgggccataagtttctaataacgtatgtttgaataagaacatgtataggtggtagaaatcattacacttatcttccctgttgctttcaattatgcacataaatagagttcaaatatattctctaaaaatatttggaatgtattagtgagtaataatattttatgtaattttgtattgattcatcatgcctctttccccatcaatagttgctccttcccattaactttgtaacaagttaggaaatttctgtttttatagcttttagccgctcatctcgccaagaatatggggcagcagatccaggatttacaatgagaagaaagatggaacatttacgggaagagcgagagcaaatacgacaacttcgcaacgtaagtcagattgctctttcagatctgctttgtggaaatgggtttaacttggaaaattaataaggcgtacagatttcattttcaatgctccttaaaatgtttggatatacaacaattagtaatataaacatttaacatgtatgtttagatagagtatctgatttatacctgtttttctatagaatcttgaatccaggttaaaagtaattttgcctgatgacattggagctgcactgatggatggggttgttctttgccatttagccaatcatataaggccacgttctgttgctagtattcatgtaccatcaccagcagtggtaagttttgtttacaatttgttagttctctaaaggaagatatagcttcttaaaattgtctttaaataatatacctcagtgaacttagttttcagttttgattaagttccatagaaaaatgcctaaaagtacattttttccctcttactttacagcccaaactgagcatggcaaaatgtcgaagaaatgtagaaaattttcttgatgcttgtaaaaagttgggtgtctcacaggtaattgttatttatctaacaacgtgatcacttaaatttgaatttattacatgcaaactggggttcttcttagagcaatgaataatgctttctgaacatgaaaatgaatgccttctcttggtaccttctcctaagctccagctttcactgtagcagttatctaatgaatgtttttaagctacctttaaagtaatttataaaatagctacaaatatggaaaatcatgcacatcactgaccaaacataactcggtggccatatttacaacttggttgtgatgtcattgttaccatctttttttccttcttttttttttttttttgctagagaacatttggaccccattgtaattcactggatagattctgattggaagatttgcattcagtgtgaatagctttttaaactttatttaaaatgcaaaattggaaattataccagcatattatgataatacctgtattggacaaactttgaaatttttaggaattgtcttatgtttcatgtaataattgcactactatacaataatcattaaagcagtattgtaaatatgtaaggaagatatataatcacaatattgcttctttgtaaagtgttataaacctaacctcaacatgaatgactatggagagaaatgacattgttatcagagcacaattaagttgtgcttgttaagctgtcttttgaacagtgtcttaataatctggtctacagatcccactttaatctcttccctcaagtaagtaaacataatttaatgtgtagagaatctgaattgttgggtaatttggaaattacataatgttctctaattacctcttgtatatagttgatgtgatggttttgtttttgtttttgcttttgtttttttgagacagagtctcacgctgtcgcccaggctggagtagtgcagtggcacgatctcgtctcactgcaaccgccgcctcccagttcaagcaattttcctgcctcagcctcccaagtagctgggactacaggcacatgccactacacccagataattttttatttttaatagagacggagtttcaccatgttggccaggctggtcttgaactcctgacctcaagtgatccacccgcctcagcctcccaaagtgctgggattacaggcacaagccactgtgcttggctgatgtgatgttttaaatttttaattcttaaaaatgtttgttgtttcttttttctactctcaatctttcagtggggaaatagcaaacttagcaacgttttctgcagccattacattatacagattttcccgttttgccattttttcttttttaaaattaaaaaaacccctttatttatttatttatttatttatttattattatactttaagttttagggcacatgtgcacaatgtgcaggttagttacatatgtatacatgtgccatgctggtgcgctgcacccactaactcgtcatctagcattaggtatatctcccaatgctatccctcccgcctccccccaccccacaacagaccccagagtgggatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggcgtatatgtgccacattttcttagtccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgaacattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagttgaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattaatttttttataaggtgtaaggaagggatccagtttcagctttctacatatggctagctagttttcccagcaccatttattaaatagggaatcctttccccatttcttgtttttctcaggtctgtcaaagatcagacagttgtaggtatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcaggttaaggagattttgggctgagacaatggggttttctagatatacaatcatgtggtctgcaaacagggacaatttgacttcctcttttcctaattgaataccctttatttccttctcctgcctaattgccctggccagaacttccaacactatgttgaataggagtggtgacagagggcatccctgtcttgtgccagttttcaaagggaatgcttccagtttttgcccattcattataatattggctgtgggtttgtcatagatagctcttattattttgagatacgtcccatcaatacctaatttattgagagtttttagcatgaagggttgttgaattttgtcaaagttcttttctgcatctattgcgataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctgaaattctcttttttggttgtgtctctgctcggctttggtatcaggatgatgctggcctcatcaaatgagttagggaggattccctctttttctattgattggaataatttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagggtgtatgtgtagaggaatttatccatttcttctagattttctagtttatttgcgtagaggtgtttgtagtattctctggtggtagttcgtttttctgtgggatcagtggtgatgtcccctttatcattttttattgtgtctatttgattcttctctctttttttctttattagtcttgctagcggtttatcaattttgttgatcctttcaaaaaaccagctcctggattcattaattttttgaagggttaaaaaaaaccctttttttagagatggagtctgactgtgttgcccaggctggactggaactcctgagctctagacttccatttcacaaataactgggattacaagcattcactacctcactaatattatgtcatttttgttttaagggttttatttttagcttcattgcttttctctgaactcagaattggtaatatataataatttttaaattaattttctttgttttaggatgttttccaatttttaacagccttattgagttattaacatacaatatagggcatataaataaagtgtacaatttgatcaattttgacatatgcatacaccatgaaatcatcaccacagtcaaaataatgaacatatctactgccccccaaaatttcctcatgtgtctttgcaatccttctttctccagcaaccactaatctgctttctgtcattgcagattagtttgcactttctagagttttatataaatggaatgatacaatatgtattatatttttctatcttctttcactcagcataattattttatgactcgtcagtgttgttgcatgtatgaatagaccattgctgttcatttctggatagtattttattgtatggatataccacagtttgttaatcccttgacctgctgatggacatttgggttgtttccagttttagcggctgctacaaataaagctgctatgaacatttgtatacaagtctttgtatggatttatacattctttaatttttagtaaatacctagcagtggaataactggaacatatggaagtgcatacttaacattttaagaaactacataactcttccaaagtggttgtactgttttacattcctgtcagcagtatgtgagagttccagttcctccacatcctcactaacattcagtatgatcaatcttctaaaaattttagtcattgtgatatgtatgtactgacttgccagtgcagttttaatttgcattttcctaaagactaatgatgccgatcatcttttcaaggcttatttgccacctgtatatcttctttttgaagtactttgaagtatactttcttttttgaagtacatattctaatctgaggtatattttgtattgggttgtttattttcctatgattgaatttcagatttctttacaagttatggataaagacatttaccagatttataaatattgcatccaaatctttggcttgtcctttcattgtccttagagtgtctttcaaggagcaggatcttcacttattgaagtacaatttattttttaaaatgggctgtgctttttgtgtcaaacctaggaaatcttcgtataatccaaggccacaaagatttctttcctatgtttacttctggaaattttataatcttaggttttgtgttcatgtctatgatcaattttgagttagtttttgtatgtggttaaaaagtatggattgaagttctctttttttaagcctgagattgggcatatacattgatttttttaagaaaatatttttattgagatataattacaatgccatagcattcactgatttaaagtgtacaattaaatggtttttagcataatcacagagttcagcaacagttaacaacaatctgtttaaaatattttcgtcaccccagaaacacagcccttgcccattcgcagtccttcctctgttctttctatggatttgcctactctagacatgacatataatgaaatcatacaatatgtggtctttagtgtctggcttctttgacttagtataatttttccaaggttcatccatttgtagcctaaatcagtacttcatttctttttatggctgaatagtgttctgttctaaatacataccacatgttgtttatccattcatcagttgatagacatttggattgttatcactcattgtttattatgaataatgttgctttgaacatccgtgaataagtttttctttgaacacttgttttcagttctcttggttatacctagcagtgaaattgttaggttatatggtaactctatgtttatattttttaagaaactgacaaaatatgttgcaaagtggctgcactatttttacatttccaccagcaatatatgagggttctaatttcttcacatcatcaccaacaatggctactactgtctacctttttggttgtagctattttagtgtgtatgtgatgtgatatcttattgcggttttgatttgcgtttccctagtagttaatgatgttgagcatcttttcttgtgcttattgatttgtatatgttctttggagtaatgtctattgaaaccctgtgttcatttctgagttagattatttatcttttttttttgagttgtagttccttatgtattctggatacaaattgcctaagagatacatgatttgcaaatattttctcccattctgcaggttgtcttttcactttcttgatggtatcatttacagcacaaaagttactaatttgatgaagtgtagtttatcccattttttcttctgctgcttatgattttgatatcatatctaagaaaacattgtgtaattcagggtcacaaagatttacacctgtgttttcttctaaaagttttatagttttagggcttacctttttgtctgtgatccattttgagatcagttttgtgcatggtatgaggtacggatccaaattcattctttcacatgtggatatccaattttcccagcaccatttgttgataagactcttcttttccccattgaattgtctgtcttagcacctttgtcaaaaatcaggtgaccataaatataaggctttatttctggattctcagttttttttaccactaaattccttattccagtatcacactgtcttgcttactgtaattttgtgatgcattttgaaatcaagaagtgtgagtcttccacatttgttctgtatcaaggttgttttggctatactgagtcccttgcatttccatatcaattttaggattgattagcttgtcaatttctgcaaaaaagccacttgggattttgctgggattaccgaatctaaaatgatttggggaatattgtcatcttcacaatgtttattcctgtgatccattaacatgagacatctttccatttatttatatcttttaatttttattccaacagtgttttgtagttttcagtgtatgagtctttcattagatttgttaaattaaatgcttagtattttattctctttggtactattataaatataattatttctttaattccactgtcaattttttattgctacttcatagaaatagaagtgattttcttttattgatcttgtattctgcaaccttgcagaactcatttattagttctataatagtttttttgtgtgtgtttctgtgccttaggagtttctctttacagaatcatttaattattctttcaaagaattcatccatttcatctaacttgtcaaactattattatgaagttatttataatgtctccttattatcattttggtatttgtagaatatcttgtggtgtcacttcccttatttatgatattggtaatttgtgtattctctctttccttcctgattagcctagcttgaggtttatgaatttttaaaaatcttctaaatgaactaactttgggttgcattgattttttttatctattgttttttgtttttttactttattgttttcctctctcattctcattatttgcaccattcttttgccattggtttaatttgctcttctttttttagtttctagggtggaagctgaagtcattgatttgaagccttccttcttttctagcatacacttcagtggttatttgaataaataagcaaaatattaagagggcaacaaatatagcagtgaagatggagatgaggcaataattttgagaactctttatgggataccatcattagtatttggagaatgggttatgggagtaaggaagaaagaggaagactattatatttcacaggtttgtcaatggagattgaatagtgtattactaagacatggatcgcagaagggcaaattaatttggtaaagtagttctgttgtggacacattgattttgatatgtctgttagatgtccatttggctgtgtccagttgatattgtatttggagatcaatagagagatcttgggaggaaataaaaacttggaagccatcggtatggaaggggtagttaaaactagaaatagatgagaataccaaaagagagggtatagtgtaaaagagaagagagtgaagacagaacccttggaaacatttggaatgttggaagaggatcggtgagggctaattaatgaaagctactgcacaattgctgtcagaaaagttgaagtagaaaagaatggtgtcacacaagacaggggaggagtaaggttcccagaaaggcattaatcaaaggcataatatgactgagcagtcaactagacatgtgcaacatttgacatttaagatggcattggtgatttttactaaaatagttttagtgggcatatgctttagggttagatgtaagatagcagtggttgagtagtgagtgggaaatccaaaagtggtgaccaactcttttataaacattttctttgtagagaaagaggtacaagtgtggaatgacagcatttcaaacaaggccgacttctataatcttttttcttagtataaattaagaatctaaaaacattttagattacaatatttataagagaaaacttagaattatgtagttttcttgacattttatagaaatcatgtttttaaaatcaaattctgacttaattttattacacttctaaaaaatgaatgttcaaatatctcttttttttctccaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgt

SEQ ID NO: 3642 - DNA, 2084 bp, human
tttcagccctcacctcccaggaatggggagggggcatcctaccccatatctgaggtgcgactgcgggacgtagagcggactgggcctttcccgttggcgcgtggcctcaatcaggtaggtctccttcgccttttctttcctttatttgcctttcctttccttgacacaggacacgagatcagggtttgtgccatgggcagcctttctggtgcagaggaccttccctgccctccggcttctgggcagccagtgccgggcgcgcgaccttgtgcaatggcggctgcagccgagctggctccagcgtcctgcaggcatcggagggctttcgggcgcgttttggacgccgagtttttgccgctgcctaagttttagttctggcaagtgtagggaggtccttctagtagagcctttctggccttccccgtcgggagcctggaagcgtctcctgtggcagggcgggcagagggagaagggtgcgcctgcagatttcttcgccccactggtgttctccccacctacatggctgaggaggtgtgcgctctcgttcggtttagattgagtggttgttaaaccacgtggctgccctgcccacaggcagggctccccgtaatgtaaaactgtagaagaaacatttcctctaacgaataattgaacaaaaagaaatacagcttcaggccgggcgcagtggctcacgcctgtaatcccagcaccttggaagactaaggcgggagaatcacttgagaccaggagttcgagtccagcctggccaacatggtgaaacgccgtctctaaacaaaaattagccacgcatgatgccgcgggcctgtagttccagctactctggaggctggggcgggaggattgcttgtgcccaggactttgcgactgcagtgaactgggattgctccattgcactccatcttgggcatcagagccagagcccttcttttaaaaaaagaaagaaaaacggcaatatacttcatttccatatatgcacttaacaacgtggaaggacaagccctcaaaattttcagggacttgcctgggcgaggtggctcacacatttaatccctggactttgggaggccaaggcgggcgaatcacagggtcaggagttcgagactagcctggccaacatggtgaaaccccgtctctactaaaaatacaaaaaaatagctgggtgtagtggcgggtgcctctaatcccagatactcgggaaactgaggcagaaaaatcgcttgaacccgggagggggaggttgcagcgagatgataacctgccaatgcactccagccctggtgacagagtgagattccgtctcaaacaacaaaaatttcagggctttcacattttcatctttctacagttctgtaaaataggatttgaaatggccgtgattattaatgaaataaaaagaagattataaagaaataatttaaggtatcaaagatgatagaagatagtcataataatacaaaatatcgatacaagttggacaaattatgtagacaaagagtcaaaaaggaaagaaaacacaattacattggttatttctagagggcagtgctcagtgtgtgtgtgtatttgtatgtgcatatgtttcttgttactgatactgaggcaaaagtttggctttcttttctcttcccttctctgattctttcctcctttcttgatagggagtcttcctctgtcacccaggctggaatgctgtggcaccttcaagactcactacagcctcaactttctggcctccagcaatcctccaaacacatcctccaaagtagctgttattacaagtgcgcactaccacaccgggatagtttttggttattgtttggatgggtcttttattaatattactattttttgcagagatggggttccgccatattgctcacgctggcctagaactgccgagctcaaagaatccacctaccgtgacgtcccaaagttgtggaattgcagtgcttcactggccccggccttatttccaaaatgaaataactcacataagttctgtggtgacatgtaaaaacccaattcccgtaacagctttcccaacgttgattttttagacatga

SEQ ID NO: 3643 - DNA, 2040 bp, human
tatctgaggtgcgactgcgggacgtagagcggactgggcctttcccgttggcgcgtggcctcaatcaggtaggtctccttcgccttttctttcctttatttgcctttcctttccttgacacaggacacgagatcagggtttgtgccatgggcagcctttctggtgcagaggaccttccctgccctccggcttctgggcagccagtgccgggcgcgcgaccttgtgcaatggcggctgcagccgagctggctccagcgtcctgcaggcatcggagggctttcgggcgcgttttggacgccgagtttttgccgctgcctaagttttagttctggcaagtgtagggaggtccttctagtagagcctttctggccttccccgtcgggagcctggaagcgtctcctgtggcagggcgggcagagggagaagggtgcgcctgcagatttcttcgccccactggtgttctccccacctacatggctgaggaggtgtgcgctctcgttcggtttagattgagtggttgttaaaccacgtggctgccctgcccacaggcagggctccccgtaatgtaaaactgtagaagaaacatttcctctaacgaataattgaacaaaaagaaatacagcttcaggccgggcgcagtggctcacgcctgtaatcccagcaccttggaagactaaggcgggagaatcacttgagaccaggagttcgagtccagcctggccaacatggtgaaacgccgtctctaaacaaaaattagccacgcatgatgccgcgggcctgtagttccagctactctggaggctggggcgggaggattgcttgtgcccaggactttgcgactgcagtgaactgggattgctccattgcactccatcttgggcatcagagccagagcccttcttttaaaaaaagaaagaaaaacggcaatatacttcatttccatatatgcacttaacaacgtggaaggacaagccctcaaaattttcagggacttgcctgggcgaggtggctcacacatttaatccctggactttgggaggccaaggcgggcgaatcacagggtcaggagttcgagactagcctggccaacatggtgaaaccccgtctctactaaaaatacaaaaaaatagctgggtgtagtggcgggtgcctctaatcccagatactcgggaaactgaggcagaaaaatcgcttgaacccgggagggggaggttgcagcgagatgataacctgccaatgcactccagccctggtgacagagtgagattccgtctcaaacaacaaaaatttcagggctttcacattttcatctttctacagttctgtaaaataggatttgaaatggccgtgattattaatgaaataaaaagaagattataaagaaataatttaaggtatcaaagatgatagaagatagtcataataatacaaaatatcgatacaagttggacaaattatgtagacaaagagtcaaaaaggaaagaaaacacaattacattggttatttctagagggcagtgctcagtgtgtgtgtgtatttgtatgtgcatatgtttcttgttactgatactgaggcaaaagtttggctttcttttctcttcccttctctgattctttcctcctttcttgatagggagtcttcctctgtcacccaggctggaatgctgtggcaccttcaagactcactacagcctcaactttctggcctccagcaatcctccaaacacatcctccaaagtagctgttattacaagtgcgcactaccacaccgggatagtttttggttattgtttggatgggtcttttattaatattactattttttgcagagatggggttccgccatattgctcacgctggcctagaactgccgagctcaaagaatccacctaccgtgacgtcccaaagttgtggaattgcagtgcttcactggccccggccttatttccaaaatgaaataactcacataagttctgtggtgacatgtaaaaacccaattcccgtaacagctttcccaacgttgattttttagacatgatg

SEQ ID NO: 3644 - DNA, 538 bp, human
gaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaaggtgaggcagggtcctgaagtcacaggggctccagcagccgcttccctgccttcggacccggcgctgcgcggtgcgcggcgaggagttgcgatctgtaccaggggcagaggagcagaggagcagggaaacagcttcattttgcccgccgccccctctttttctcccgcgtgctggtgcgcgccctcatccttacaccttcgcatccctttctgccggtccctctggctccgtcggacgcctgggtt

SEQ ID NO: 3645 - DNA, 218985 bp, human
ggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaaggtgaggcagggtcctgaagtcacaggggctccagcagccgcttccctgccttcggacccggcgctgcgcggtgcgcggcgaggagttgcgatctgtaccaggggcagaggagcagaggagcagggaaacagcttcattttgcccgccgccccctctttttctcccgcgtgctggtgcgcgccctcatccttacaccttcgcatccctttctgccggtccctctggctccgtcggacgcctgggttcttctaggaccccagaacccggctttcctgtgcttctttgtcatctctccaagatcttctcctctgggcctcgctgttgctgccctgacggtctggggtcccgctgcccgccccggccctactgtctcttgccctctaacagtttctgctttgtgcctcctaatccatctctccttcagaatcttctaacttaggaggctcctctgctggctcccaagtcaggagcacactcctcttcttcctcgaagcttttaacttagctctgaatgtcttcagctctgaatattttgacttttttgtttgtttgtttgtttaattacagttgactaatgattttcttggaggcttatagtctaggctacagtttactgaaagtgatgagatcattccttcactaaatagccttagtaaatatcaactagggaactttaaagtttctttctaggtttcattaacttagtccaagaacaatagccacttaaaatgtatgtatatatgttggtacgcaatcttcgtacatggtcctaaatctgattcttccctggctgctgagcaggcctgagagagaggattggtgggaattgtgatgcctggctccatttctctaattgtaaactaggatgttaatcgttttaatgtagtcagaggactttagtggtttgggataaagtcgctcaagttagcataggctggtaactaagcacattgaatggagactaagagacgctgggatttaaaactgtctctggagggcacctgctttcttttttttgaagccacagtttcttaacagtagatttcatgtttgtataaaccctctaaaagcagcatattttaaaaccacgtagttacaaaaaagactactcactcttagcgatatcgctttctccccatgtagttgtggtgttagctcccatactgaggttcatttgctcactttcatactgcaattagtgtgtgaagaaagctgaatggagaagcacaaagtggaggcaaataccagtgaacaagcacatgctgacatacgcagctgtgtttttggaaatagactgtatctagtgttcaaatttaaaaactgagaaaaatgaaataattcagcatttatgacatcattttacatctaaaaatattagctcccttaactgcaagttcttattaatatcctcatacttaacggtaaaagagttgtttgcctgatgtatgaccaagtgttgccattgacacagtgtgcactaattggcagcaatctcagaagaaaccaggttgtgaatgaagataatggctaaatttcactgtcctggtagcacgtcttatggcagtgagatgagagtagtttctgctgcaacatcaaatgatgtatttaaaaaacagataaataagagcttcaattattaaaaagcccaaggttttcaatctgccatttttataagcacacttcaaaaagtgtagtgtgattatataaggctcagttgatgttctgaagaaagtagttttcacaagaaaagtaaggcctattgcttatcaatttagttagataacttgcagatgatttgtagtttcccaattgatttggtaaattcctgagtttacttgaggtttattaaaaaatggaatgtagtagggaaagggtacttattctaataggcccactttctaagtctgtaattttcttagcaaactattctcaaaatacataaaaacttacaactttttcaaggaaaagagtttatactattttcttacttttttcttttcatgcttattattgatacaaaatctaagctaagattgctgctaatgtgattgcatagtaagactatttatatttgccaggaaaagaataaaggtggatgagttagccataagcattttgctctgaatcttcaatatgactcaatatgtgtttgatagtccatctggtacacctagaggttagcagactggatatttctgatattactaaatgtaactgcacttacttattggattatcttctttctcattttatgtacatttcaaattatgcttcttcatgtaatttgacttgcagtagtgaaatgagactgaccaattttcaaattgtttgatttttattgatgtttgataaaccactaaaacctcttgaaaatatttttttcttaaatccactgattgaaaccgatgtatttttattgctatgaaataatacaacaaatttccaggaattatttcagaaaatgtggaaagactgtagagaaatgaatagccctagagaaaatatctcaaaattataaaaatggctttctcaagttactgatattcataacaatcaggtttttatgtatcattcattcatttactaattcattttacaaaatctactgggtacttgtgtgccaaggccctgtgttaggcacaatgataaaccttataaggcatgatctttgctcttgtggagtatcacagtgcttatattctaccagagaatacagacaataaacgagcaaacaaatgaagaagatccttatagactgtagtaagagcaatgaaaataagtaggggaatatgatacagatagctaggaagggcctactttagtgtgggaagtcagaaaaggcctttcagagaagatgattgagcagagacctgaaagagaagagagaataggcctaccttgtcaggatctgggagaacattcccgagataacattcttgcagagagaagagtaagagccaaggccttgaggggggaaaaagagacttggcgtttttgaagagcagaaagcaagccagcatggcggattaaagaagatgttacagagcctagaagcagctcaataaccgataaataggacttggaggtcctgagaaagaatttgggtttgattctcagaacaataggaagccactgaagagtctttcctggggaaggtcattggcttaaaaaaattatccagggaaatttaaaaaaaaatgttttgcagaggataaatagaatgtctactcattcagtcatttatattaatacctgagaataaaaaaaactctatgatcagtatgctaaataatcatgtaattcggttcctctactctgtttaggtaaggggatgggggaatgggaaccctgaggtgagtatgttaaaaggcagtttactttccactgtcacattgtgacttgtgctacaaggtaagttgtcaccaactttattaaaaatcagatcattgttcaacttaagaatttatttttcaaagaatgatatcttattttctcatggaaatatgtttcctttggaaggttggaaattttattttgtataaaggaataacctaggttttagaaagggcctttggaattttaagaagggcttatcattttcttttacctgttgcctctccaacattttcaaatggccatacctttattccttgagagattagggttactgtgtttcctgaggcttaaatgaatttattgccctaagcccttccttgaaagcaatccagctttgaggtctagttggtcccaaataggaatgcagatgattattgacattccataggagtaaatcctaatattgtgggggaataacctgcaaaataaccttcatcagtgcctgcagggtcaacttgatttgatcccagcctactttcccatatgtccttattattccctttcacaaatctctattggtttaaactgattttccccagtttggaacttttgtgcttagcattattcctggcatagagtacgtgcacagtgggtgcttgtcaaatggatgccatgcctttcttttttgtcatttcaaattccaggtcctattacactattccccattgaactagatctccccctctgaaggtgaacagcagtcacacacttgccctgttgtgtcataattatgcttatttgatgcctggccatctccccacttgcctctggcttcatgaaggcgacctagacctcatccggtttgctcattgttgtattctgagcacccagcacatggtatgcactttataaatagttattgaataatgaataaatactgtcttgtgatgtttctcctattaattttttgatgttagatcatttaatactgttttacttttcacgtgtttggtgttccgaagtggtttctgagagaggttgtagagcatacttgttaagagctcaagctctggagctaggccacctaggtttcaattccagctaggagacttaatagttgtgagacactgggtgagtcagtaaacctccctgtacctcagttatctcatatgtaaaaaaggggtaatagaacttgcctcttatggtacttgcaaagattacatgaattagctaggcccactttttcttttctctttttctttttcttttttttagacggagtctcgctctctcactctatcgttcaggctggagtgcagtggcatgatcccggctcactgcaacctccgcctcctgggttcaagcggttctcctacctcagcctcccgagtagctgggactacaggtgcgtgccaccacgccaggctagttttttgtatttttagtagagacagggtttcaccatgttagccaggatggtctcgatcttctgacctcgtgatccacctgcctcggcctcccaaagtgttgggattacaggcgtgagccactgctcccggcctaactttttatttttagtggagacagggtttcaccatgttggcgaggctggtttcaaactcttgacctcaggtgatccacccacctcgggctcccaaagtgctgggattgcaggcatgaaccacctcccccggcctaggcccacaatttgtttgcaatttttaaatttctaaagctctgaaaactgaaaaagattttatttggtaacttagatgccaaaactcatgtggtggcaaaacctgacttaaactgacatagggtatttatagtctttattctacttaatgttgatctttattttgttttgctatagaattactaatatgtttatggggttgcaccatagaccctaatggtgtattacataacatatggtatataaagtatatttcctgtctaaaggtctggacatttctaaattcagaaacacatctggcaccaagatttttcgatgagattgtacaccttgcagtaaactgcttaaatcagggccttgcacatagtatgttgttgctgtgggtggtggagattagggaggtaaataaactactttatctttcccaatagcttgctcataatagttaccatgtaaatatatactgatttactcatgcaataactgtaaatagaggactggctgtgtggttctcatgtcataggaaaatagatatggcagggtcatgtaattgaaatgagccaagactcgtctgttagtactctcatctggtaccattcagagcagtttagtttttgtttttctgttgttatttaaaccaacctatgcttctttagcacaagagagtcttttgtgggggtgggggtaagaaattcagttaagaacttatttaatgtgattagacacttatttttttgcagttgttgaacatttattgaactgctaatgtgtatagaaatctgtattaagagcaagagaaggccgggcatggtggctcacgcctgtaataccagcacttaaggaggccgaggcgggcggatgataaggttaggagatcgagaccatcctgaccaacatggtgaaaccctgtctctactaaaaatacaaaaatgagctgggcgtggtgacatgtgcctgtaatcccagctacttgggaggctgaggcaggagaatcgcttgagacagggagttggaggtttcagtgagccaagatcgtgccactgcactccagcctggtgacagagcgagactcagtttcaaaaaaaaaaaaaaaaaaaagaaaaagaaatagaaaagtagaaaagagaaaggtagaaaacaaatgagacatgattcctgaccttccttagccccagcgccctgcatggttacatggggacatgagtgtgcgttacaattctttattttcctctgtaaacttgacatcattaagattaaaaacatgcaaaggaaaacccaagagttaattgaaaactcttcttagcgtccatgatatgaattgggttttaattatcctaacacaacccccctcagtattatctttatataacatcttgacagccttttcctttctaactaaactaaaacaacatggattttcttgttctttaccaatacacaattggtgtattttcttttgtttttggtagagatgaggtctcactatgttgcccaggctggtgttgaacccctggcctcaagtgatcctcatgctgtggcctcccaaagtattgggattacaggcatgagccactgtacctggcctgtttttttttccttcggttttgtggggttgccagtaattacatgtctcaaaggattttttctgcagttttcttgcagttgaaaactagtccttgaaactattctgccaattcattcaacaaatacttattaagtgcctattatattccaagcattgtgctagtctaaacaaatagaatctctgtctagtgctctttccattactttgggtccttcaaagtggagcacatgtactgattgagcagggtggtgacaaggtggtgctcccaggagccacaaaataaagcagcttgtattttcttgaagcatctgttttacacagagatttaggagaacattaactggtagctatttaaaaatctttaaacaaattcagatacattctgccttagaacgcaatattcatagaaaatctgaggcaaaccccaatatttcagagaaagtctctgcttgcaagggcagctgtggtaaccctgagatgaccctttggaaagcactgaggtggtgctgtactgcccgaatctgttcttttagtcaaacacccaaacattttcatagccgtaaattcccatgatgacctgtgggaaagttaatggacataaatgtttttctctgttgcgcaatttcaagggtacatgttggttacccttggtctaatggtctaaatctaaacatgtgttgagttcttacagagtttttaatgttggtgggtaatggctaagagtgactatgaaggacctgcctagggaatgatattttcagaatagaggttattaggcctgacgcagtggctcactcctgttatcccaacactttgggacgcctaggcgggagcattgcttgagcccaggagttcaagaccatcctgggcaacaaagcgagaccctgtctctataagaacaaaaaaaaatttaaaaattagctgggcatggaggcacacgcctatagtctcagctactcgagaggtttaggcaggaggatcccttgagcccaggagttcaaggttgccgtgggctacaatcacaccactgctcttcagtctgggtgacggagtgagaccctgtctcaaaaaaaaaatctaaaaaaatttttaaaaaaggctagaggttattagaacacaaggaccacaaacttaaagcagcacagttcatggtgtcaaagctttgccttgttctgtgcacacttgcctgtctcactgatttgaagttcacttttgctaactttaaagctgctttcatttacagcatagtatacaaattggtttgttaattgctggccactgaaatagttaatactagaagaaagttgtcaaggattaagtgctttgaggttgataaaaggtttctacagtttgagatggttttgaaaataggccagcagagcattggaggaatgcctgttacaacgtgatggtttaatttgctccagatgagaaagatgaagaagaaaaaggcaagtgaagaaagggggtgaaagtaaatggagtaagtcaaacactaaatctttcaactgattttcattattgcagtcccactttcattgttgttgttccatgccagacatagttcacagggcctgacattgttatattgttgtgttactgctcaaatcttgtaaggacatgggtatagaggattgtgattagtggatggtctttatcgtctacaggtgaagtgcttttacagtctattcagtaaaaggagataagagttttgcttgtagtttgtagagttttctttcttggtcccacttttaaaaaaatggtgatacatttctaaagatcacttcatttcaacaaagttttctgttccactcttggatgtttcttttttcttttaagacagggtctcattctgtcactcaggctggagtgcagtggtgcaaagtcaaggctcactacagcttcaacctcccaagttcaagtgatcttcccacctcagcctcccaagtagttgggactgcaggtgcatgccaccacgcctggctaattttatgtattttttgtagagacagggtttcaccatgttgctcaggctggtcctgagctcaagcaatcctcctgcctcagcctcccagtttgctgggattacagacatgagccactgcacctggcctcactctcagatatttcttagtggaaaggcagtagagcttaatggctatgatcttgaaccctggaatcataggcttgggttcaaatcctgactgccttttgttgggcaacttgcttcacctctctgagccttgtttatctcccttgtaaactatctcatctagtttaaggattaaattaataatgcgtatagagtgctaagcacacttaagccacatatgaaatataactatacttattattattttcatagatttgtggctaaattagttgataacttggagcatactataggaccttggccaatcatatatgaagcagaaatgtgaggggaaattgtgtgtcttctttgtttatattgtcttaatcctagctggaatgctatttttcgaatgtgcatctcgtaaatggtgagtagactgtttagaagtaacactagttttctggcagacaagaaagtttatggtgaatgttggcttattacttactcaaatatggcatcacattgattccaagaaaaatgtcagtttttaatacaattagcccaatatatatttaaatgtgatactgtttgggttaataggattttaaattttaatatccattttgaaggaaaagggttatgcaggataatgtatactatgaacaatgttatcttttaaacatgaaaacatttggttttctgataatcacaggggtcacacatttttctgatttatctctaattgttccagattttaagtccccaaagaagaaaatactgaagcatttgtaatagttaagccattgggaagaggtataattctgttgtgaataatgtcttcctatggattttgagttgttatggttatttcaagtttttatcatggttactgtaataacaaatcaaataataccctaagagaagataaaagtttgatagtacctttgataaatgaatggataagtctaaatggagtattgagaacagctttaggtgttagagggatagactaatcttttaagttgagagtacatgaatctacctttcctactttcttacatgatgccctttagttccaatgtcagacaaatgatgagagagataatccttggtgatgaaatgccacaggtgcacagaagggaaaagaccaggtaacatattggtcatatactgtatattcacaggtttttatgaccgttattaagataatgtatattcaagtgcttgaaaagcttagctcactatattgatgaaatatattatttattagcagtgatgtctacatttataaatagtgatcattctcagtatcatttgatgataaaaaggcagtattcaaatttatatattttttagaaaaattagacttactctaccattaggtcattagctcaaaccttaaataaagataataccctttatttttagagcatctttcttttgaagcatgattaactgttcttattctgtttattcctgtggaatatgcacaatgagtttaagtaaattgcagaagggttacatcctgtgaggtggagctaagagtaggcctttagtttctaatccaatgcttttgtactaatgatataaaaagctcttggccgggcgcggtggctcatgcctgtaatcccagcactttgggaggccaaagcgggcggatcacgaggtcaggagatcgagaccatggtgaaaccctgttctactaaaaatacaaaaaaaaaaaaaaaatagctgggcgtggtggcaggtgcctgtagtcccagctactcgggaggctgaggcaggagaatggcgtgaacctgggaggtggagcttgcagtaagctgagatcgcgctactgcactccagcctgggcgacagagcgagactccatctcaaaaaaaaaaaaaaaaaaaaaaaaaaagctgtttagaccaaaggatcctttaatatctgtagcctttcaattgatggggttaaagcaaaatgtcagtaattgtgatagcaatttggtatttatcaaaatgagttttggattcagtaagaattttataagtacttttggtatcatataggtacagtatccacgtgaacatttatgaacaagcaattatacgtaaagcactctactaggagggagaaaatgtattcactgccctgaaataggttacagtcttgccaggggcaacagagaacatgagtcaatttgatatcggccaatactaatattattaccaagcagccagtgactaataaatcattattgcactcattatgagcctgggacccttccaagtgcatctgatgcattgatacatttaaaccacataacaatactatgaggtagaaactattattagccccactttacagatgaggaaactgaggcatatagatgctggataacttgcctgtggttacacacctaatatgtataagaactaggagtaaaatccatgtagtctgattcttgagtctatgcttttaaccacaacacttcctttcatgctatctctgacagaggccattatataacagagcatgatatctaaaaaaggcatgttagaaaacagattctagagaaataaagagaaatgatcagatgagggtgttaaagttggaaagatagtttgaagaaggcacttttaaaggaggtcttattgaaaagcaaggaacgtatttctgaatatttcaatgctcaaagctatgtgtacatatgtgcatgtgtgtgcacaggtgtgtgttggtatatgtgtgtgggcgtgtttattttaaactggaaaaaaactttagaggttaaaacaaattgacaatctttttactgacagctaatcagagctctgtttttgtgtacaatattttgacttcacaatcctgtgtcgaaaaaaatatttaacggctttattaagatataattcactcatcatacaatttacctgtttaaagtaatataattcagtaatgtttagtatactcacagagctgagcaactgtcaccacaattttagaacatttttatcacctcagaaagagaaatttgttttgaaacaaatgtggccacaaagaggatggaactagtgtgtctgttggtactactgcttgtctatcaaaatgttcatgatttatgctcagtctaacacagacctcatgctgtttttctgcagtctagctccaaattgctgtagagctcctcctcctttgaatttaattttgatcggtgacagtctttcaaggcagtatgtattgatctaattttgaattctcaattcaagttgattgtatatttgtatttgtcataaaggtattgatcttagttctaaatagcaaagccagactcgtatttaaaacaaaactgctaaacccactagtatgagtggctacctccttgtctgtgtatgctctatagtgggccagagccaaagatttctgagaaattttatgtgtatacactgatatttttaattacttctaaaagttatacctgatataggttactagtggacagatgattgaggtaaaagcaactcctccacgccattttttttggctggggcatagtattggggtggtgtgttatggaaaatgtcttttttttgagacagggtttcattctgttttctaggctagaatgcagtggcatgatcacagcttactgtagccttgacctctggggctcaaatgtttcttccacctcaacctcctgagtagctgggaacacaggcgcacatcaccatgcctggcattttttttttttttttttttttttttagtggaaatgaggcctcggtatgttgcccaggctgttcttgaacttctgggctcaagtggtcctcccaccttggcctcccaaagtgctgggattacaggtgtgagcgactgcatgtggctgaaaaatgtcttataaaatgtattccatgatactatgtacagatagtatgaaataactggaattaaaaaaaattcggccactgacttttcagctatttagggttcaaaaaagatacagttagtgtttatagtcaaggactgtgtttctgtccagtgggagttaccaaaccaaatatctctgtgtgtgttgggggaggcaggctgttcccaggtcttcattaaagtaataagctacagtcagtgttatctttcagactaaataattactatttcctttctattattaaaaaatgaccttcagacataattaaatgtcttaaagaacataggtgtcttttaaaatgtgttaatcttaggttgctctctttttcttcttacaatttttcttacttttaattttaccgaatttttctttcagaatgatcttgaaatgtcattttacactttttcagtatttttaaatgcctattatctacttgggttgtttctactcaggggccaaagtagttttagttgaagttaaagtgagttgataaaatgatttcctgtgaatcttaagtaaagtttttatttgcatagatggaatttctgctttgccatgtatggcaaaaggtgtggtgatctcacagctagtaggtaggataaaatcaattaaggtggcactgctgtcactagaataaaaaatctatgcatacctttatattaattagatgaaagctcctctttatcactaagctcaacagttgacatcacctggagtcagggagtcaggtgccgtggagttaaaaacagaaagcatgctcgatttagaaattctggcatatatgtatgatgctaccttttctcacaactagattttggttattaagccattgtgatattgggctatgttaaaagacattagaaacctgttcatttaagacaagccaaattggtctgatataagagggtcatgctgaatgagaaagtatcacataatttaggagagaggattttgagtaatgtgaatattgagttttctgtgacttggtatatcatttattgattttaaaaaatgaacccattacattatactcataaactattacttcacaatagtttgattttctgcttaaatcagtgcctaaaatggtaaagtcttaaatggtttagaatgactctgcatgtaggttaggtccatctacctgttttatatggggatctgctttatctgcacataaagaagattcgctagctttaattagccttactatgtagggcagcactttctctaatgagagaaaatgaggtattttacacaaattaattcaacagaaattagtgactaccttctttaaaccaggtgatggggatgcagtggtgaacaaagttctatcttcattctatgaggtactcacagcattatatgcactctctttgttcttttctaagaacattccattcaaaggaataggaaaagtggcaggagaaaacacactcctttcctttaaggatgtagtttagcatttgcacacatcacattcacacatatcccactggccagaacttaatcctatggtgatacctaagctggaaaatgtggcccttcactgcatggacaagcaaaaataattattactatatgagccgggaagaacagatattggggaataactaatagtctctgctatacattgtccctaatgtaaacctttaatcattcatcaatttttgacttatctggagatattatctctatgacatcagctacacatttgcttcatggtaaaaattaagacttctcagcagagtatacaagtccatcatgacttgactcctgcctgtccctttagcacctctctcaccccatccaaagttgcagccttatggggactacttggacttccccaaactagccatgctctcttaccacacatttgtacttgctacttgtattagtttgttttcacactactataaagaaatacccaagactggataatttataaaggaaagagttttaattgactcatagttttgaggggaggccctcagaaaacttacaatcatggtggaaggtgaaggggaagcaagcaccttcttcacaaggtggcaggagagagaagagtgaaggaggaacttctaaacacttataaaaccatcagatctcattagaactatcacgagaacagcatggggaaaactgcacctgtgatccaatcacctccctcccttgacacatggggattacaggtccctccctccacacttggggattataaattgagatgagatttgggtggggacacagagccaaacgatatcactactcatcctaaactgctgcctactttttgtccttgaggtttcagtttagatagcacctcttctaggaaggttttcttgagcctcctgtacctcacacccctgttatgtgtttctttcatgtatttccatagtattgttcatgactctctttagcaacctgtattacaagtagtgtttttccttctctgtctctctccctggattatgaattccttgaggacaggggctaactcagttatctgtattgtctgtcatgatacctgctccagagttgagtttacttaatgtttgttggtaagaaaatgaatgaatgaatatttagtttactaattatgactccttgattaagatgtcaactcttcctatttaccatctggaaactgcagtacttagagtattttccagtagctaggactgggtaattttgtaagaggtattgataaaataaaataatttgaaataaacatcagatgattaatatatgaattatagaaggcacaaacaattgatgtgtaagagttaggaagagccctagggatcatttaatccaacccttctagaagattttaaaaggacacacgactaatatatagagagaagttaaattacttgctcaagggcctccactttcaaggatcttgcaatatcgttaaacagatgatatgtatagacatgaaagaggtgattgagaaaaaattgccgaaggaatagaaatgattggaatagtcagggtaggtttgatcaaggatcttggctttgcagtgagccttggtcactgggtaggattttgatatgagaagacattcaagatataggcaatgtataaataaaagtggaaagacaaggatatacgggagaattttgagatctctttagttgagtgatatttagtagtaagagagaatacagaaaaattgggccagaaaatggagggatttaaataccaggctgctgagggaaaccattggcagttttaagtaggcgagtaatacagtttttgtatgttgtatctgactgataggtgggctgggttgaaggctgaatgggtcatgaaactggcatattgtctaatgtgccaatttaaaaatatgaacttaatgggttctcgtttttgctcaaaagcaaaaacatgatatactatcaattcccatgataattaacataacaatatcagtgtttttcttaatggagaaagtgagtgtaagtagcaagcttatagtattagtattgcatatgtattagtcatgacataccatagataattgtataaattttcacgttacgccaataaactgtaaaaattccagaagtaactgagaacgtggtagcagctgcagcatcggcccatgctattttgccagccattcggagactgcataaattaactagtggcatgaactctcctggtgcattttggagccattttattcaaaaattgttttgtagaaagtgaaaatgttatactgtattttggcaaaaataagaagaacaataagcagagctctctttagtgtattaagcatcatctaaaaatgaaaagcgtgaggggagaacctttacttcatgtgcctgtgaggaaattttgactttgtatagacaaaaagtatgtacacagagaaagatttgttatataaatagtatagctcatttgtatagtcaagggtgtcttcctttccttccttccttccttccttccttcctttcttccttccttctttccttccttctttccttccttcctttcttctttccttccttccttcctttcttctttccttccttcctttcttctttccttctttcctttctttctttgtgacagagtctggctctgtcacccaggctggagtgcagtggcaccatctcagctcactgcaacctctgcctccagggcttaaggaatcccccaccaagttgctgggactacaagtgtgtgccaccatgcccagctaattttttttaaaatttttattagagacgaggtgttgctgtgttgcccaggctggttggtctcgaactcctggcctcaattgatccagctgccttggcctcccaaagtgctgagattataggtgtgagccactgtgcccagccgagtgcatttatttaatagctgtgtacacttggacttaactcatggctttaacccatggctggctttaacttagccttttgaaagtctataagtttatagcttcagacacatattaatacttactttttaggacctaatgaaaacagtttatattatcatttgtctttctactaggagttggaaggaaattttcagtttaatgaagttttaagttatattaatttgagtctagaaaatttgtacaactttttttgggaaaccttcaaaagtatttgtttcagatggtgtaaaatgaaatgcataaatacctatttccataatatctttgtacttgaaaataatataaagttaaccttatgtacccttctgaaaattaaaagcatttaataaagtataatttttttaaattttattattattatactttaagttttagagtacatgtgcacaacgtgcaggtttgttacatatgtatacatgtgcaatgttggtgtgctgcacccattaactcatcatttagcattaggtatctctcctaatgctatccctccccctcccctctcccccctccccccttcccccaccccccttcccccaccccacaacagtccctggtgtgtgatgttccccttcctgtgtccatgtgttctcattgttcaattcccacctatgagtgagaacatgcggtgtttggttttttgtctttgcggtagtttgctgagaatgatggtttccagcttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgctataaacatacgtgtgcatgtgtctttatagcagcatgatttataatcctttgggtatatacccagtaatgggatggctgggtcaaatggtatttctagttctagatccctgaagaatccccacactgtcttccaccatggttgaactagtttacagtcccaccaacagtgtaaaagtgttcctatttctccacatcctctccagcacctgttgtttcctgactttttaatgattgccattctaactggtgtgagttggtatctcattgtggttttgatttgcatttctctgatggccagtgatgatgagcattttttcatgtgtcctttggctgcataaatgtcttcttttgagaagtgtctgttcatagcctttgcccactttttgatggggttatttttttcctgtaaattttttgagttcattgtagattctggatattagccctttgtccaatgagtaggttgcaaaaattttctcccattctgtaggttgcctgttcactctgatggtagtttcttttgctgtgcagaagctcttgagtttcattagatcccatttgtcaattttggtttttgttgccattgcttttggtgttttagacatgaagtccttgcccatgcctatgttctgaatggtattgcctaggtttccttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgttttcctccagtttgtcaaagatcagatagttgtagatatgcggcgttatttctgagggctctgttctgttccattggtctatatctctgttttggtaccagtaccatgctgttttggttactgtagccttgtagtatagtttgaagcaggtagtgtgatgcctccagctttgttcttttggcttggaatcgacttggcaatgcgggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttctttcatttgtttgtatcctcttttatttgcttgagcagtggtttgtagttctccttgaagaggtccttcacatcccttgtaagttggattcctaggtattttattctctttgaagcaattgtgaatgggagttccctcatgatctggttctctgtttgtctgttataggtgtataagaatgcttgtgatttttgcacattgattttgtatcctgagactttgctgaagttgcttatcagcttaaggagattttgggctgagacaatggggttttctagatatataatcatgtcatctgcaaacagggacaatttgacttcctcttttcctaattgaatgccctttatttccttctcctgcctgattgccctggccagaacttccaaaactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagcgttgctgaattttgtcaaaggccttttctgcatctattgagataatcatgtggtttttgtcgttggttctgtttatatgctggattacgtttattgatttgcgtatattgaaccagccttgcatcccagggatgaagcccacttgatcatggtggataagctttttgatgtgttgctggattcggtttgccagtattttattgaggatttttgcatcgatgttcatcaggcatattggtctaaaattctcttttttggttgtgtctctgccaggctttggtatcaggatgatgctggcctcatcaaagagttagggaggattccctctttttctattgattggaatagtttcggaaggaatggtaccagctcctccttgtacctctggtagaatttgtctgtgaatccatctgatcctggactttttttggttggtaagctattaattattgcctcaatttcagagcctgttattggtctattcagagattcaacttcttcctggtttagtcgtgggagggtgtatgtgtcgaggaatttatccttttcttctagattttctagtttatttgtgtagaggtgtttatagtattctctgatggtagtttgtatttctgtgggatcggtggtgataccccctttgtcattttgtattgtgtctatttgattcttctctcttttcttctttattagtcttgctagcagtctatcaattttgatgatcttttcaaaaaaccagctcctggattcattaattttttgaagggttttttgtgtctgtatttccttcagttctgctctgatctttgttatttcttgccttctgctagcttttgaatgtgtttgctcttgcttttctagttcttttaattgtgatgttagggtttcaattttagatctttcctgctttctcttttgggcatttagtgctataaatttccctctacacactgctttgaatgtgtcccagagattctggtatgttgtctgctttgaatgtgtcccagagattctggtatgttgtgtctttgttctcattggtttcaaagaacatctttatttctgccttcatttcattatgtacccagtagtaattcaggagcaggttgttcagtttccatgtagttgagcggttttgaatgagtttcttaatcctgagttctactttgattgcactgtgatctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctgttaggtccgcttggtgcagggctgagttcaattcttggatatccttgttaactttctgtctcgttaatctgtctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgtatgtgagatgcatttcctgaatgcagcacactggtgggtcttgactctttatccaatttgccagtctgtgtcttttaattggagcatttagcccatttacctttaaggttaatattgttatgtgtgaatttgatcctgtcattatgatgttagctggttattttgctcgttagtagatgcagtttcttcctagccttgatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgtcgaatattggcccccactctcttctggcttgtagagtttctgctgagagatcagctgttagtctgatgggcttccctttgtgggtaacccgacctttctctctggctgtccttaacattttttccttcatttcaactttggtgaatctgacaattatgtgtcttggagttgctcttctcggggagtatctttgtgacgttctctgtatttcctgaatctgaatgttggcctgccttgctagattggggaagttctcctggataatatcctgcagagtgttttccaacttggttccattctccctgtcactttcaggtacaccaatcagacgtagatttggtcttttcacataatcccatatttcttgaaggctttgttcatttctttgtactcttttttctctaaacttctcttcttgcttcatttcattcatttcgtcttccatcgctgataccctttcttccatttgatcgcatcggctactgaggcttgtgcattcgtcacatatttctcatgccgtggttttcagctccatcaggtcctttaaggacttctctgcattggttattctagttagccattcatctaattttttttcaaggtttttaacttctttgccttgaactaaaggaggaggttcgaacttcctcctttagctcagagtagtttgatcgtctgaagccttcttctctcaactcgtcaaagtcattctctgtccagctttgttccgttgctggtgaggagctgcgttcctcagttggaaatgcagaaattacccgtcttctgtgtcgctcacgttgggagctgtagactggagctgttcctattcggccatcttgtctccacccccgagagaaaaagtataatttttctgtgattccttttcctactctgttggaacatctgctaaactttagcccatcatacttcttatgcttgtataacaacatgaaaacctgtaataaccagtttttggcatcatacattattataagactttgtcataatatttcaggaaggtaatgctgttgaatgtactaataagttacaaaattaatttagatgatttcctagctataacctattgaaaatcatttgttttggtttccaatctgattgaaatcctaaaaatacttaaaataatttacagagtagcatgtaataggaatcgttcaatatacatcagcacacatcctgtgtattcattacatgaaatggtactcgaacattgtgaatataaagttatggtatagttttaattaagactgtggactctaaacctgacctaaaatctgattctgtcatttgctacttgtgttacttcattttattgcgtcatggtttcctcatctctaatggaggaacaagagattttatagaaattagataaagtagtgtatgtgagtgttaagcatagtacctagaatatgataagatttaataaatgttagttattattttatataactagtattatctggttatgaaaggaactttggcttttagtttcaaatttatctttctagccattttatttaagacgtttatacaagaagaaatacataaagaatgaggtaaatgacaaattagcaatgtaattgttatcaactagtggaggcacttttagcaggcaaattactcattattatggtcaattattttggcaaataattaaagaaaatgaaaaagaagaccaccagactatgaatgactttgcctttaactgatgctgatagaatttgttttaaaattttttcactattaggaagtagcctggttttgactaaactttttaaaaagaaaaaaaagtttgtttgaaataattacagattcacatgaacttgcaaagatagtacagagaggtcctgggtacctgtcacccagtttccccaaatgactacatcttatgtaactgtagtatattttcatagcccagaaattgatattggtacaatgtgtgtatatagttctgtgacattttatcacattatggattcatgtaaccacctccacaatgatgatacagaaatatttcaccataagagacataaattacagaactcaagaggagggggaaggaaagaaaatttgttgtattgacacatattttgcttaccatgttctttcttccttcctgatgttccaagataccctcttttatcattttcttttggtttagataacttcttttaactaatagggtaggtatgctggtgacaaaatcttagttttcctttatctgagaatgctttaatctcccctttattcctgaagattttgtttttgcttgatataggattctgagttgacagttcttatctttcagcacttgaaaaatcctttgtgtctcttctttatggcctccatggtttctgatgaaaaatctgctgtcatgtgaattgtttcccctgataggtaaggtgtttctttcactgctttaaaaattttttatttgttaacaactttcaaaagtttgattatgatgtggtttagagtcaattttcttattttatttatgtattttttaatttcaatatgtttttgaggaacaggtggtgtttgattacacgaataagttcttcagtgatgatttctgaggttctgttgcacccatcactcaagcagtgtacactgtacccagtgtgaagtcttttatcccttgccacccccatccctttctcctgagtgtccaaagtctaatgtatcattcttatgcctttgcatcctcatagcttagctcccgcatatgagtgagaatacatgatgtttggtggttttccattcctgagttacttcacttagaatattctgatatgtatataatgatgctacctttatccaggttgctgtgaatgccattatttcattccattttatgtctgagtagtattccatggtgtgtgtgtgttgtgtatctccacattttctttatcctagagtggattttcttgggtatattcaatttgggatttgcatggcttctcgattctgtaggtttcttatctctttgagtactttttcagccccaccctctttctctctccttcttatctctcatattgcaaatgttagatcgtttgttatagtccctaaagtccctaattctgtattcatatttttttcagtttattttatctttgtttttaaggttggataattagtgttcttctgttttacagttcactgatttttcctctgtcttttccattctgctgttgagcctatctgttgggtattttattacaattattgtattttttgcttttaaaagatccatttggttcttctttatatcttctatttctttactgagactttatttttttgctgaggctcttggtttcaaatgttttcataattgctcaatgaagcatttttatgatggctactttaaaatctttgtcagataattctaacatcgctgtcatcttgctgtcaacatctattgatactttttttattatactttaagttttagggtacatgtgcaccatgtgcaggtttgtcacatatgtatacatgtgccatgctggtgtgctgcacccattaactcgtcatttaacattaggtatatctcctaatgctatccctcccccctccccccaccccacaacaggccccatagtgtgatgttccccttcctgtgtccatgtgttctcattgttcaatttccacctatgagtgagaacatgcggtgtttggttttttgtccttgcgatagtttgctgagaatgatggtttccagcttcatccatgtccctacaaaggacatgaactcatcattttttatgactgcatagtattccatggtgtatatgtgccacattttcttaatccagtctatcattgttggacatttgggttggttccaagtctttgctattgtgaatagtgccgctataaacatacgtgtgcatgtgtctttatagcagcatgacttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaataatcaccattctaactggtgtgagatggtatctcattgtggttttgatttgcatttctctgatggccagtgatgatgagcattttttcatgtgtcttttggctgcataaatgtcttcttttgagaagtgtctgttgatatccttcacccactttttgatggggttgtttgtttgttttttcttggaaattagtttgagttcattgtagattctgaatattagccctttgttagataagtagattgcaaaatttttctcccattctgtaggttgcctgttcactcttttggtagtttcttttgttgtgcagaagctctttagtttaattagatcccatttgtcaattttggcttttggtgttttagacatgaagtcctcgcccatgcctatgtcctgaatggtattgcctaggttttcttctagggttttttatggttttaggtctaacatttaagtctttaatccatcttgaattaattttagtataaggtgtaaggaagggatccagttttttttttttttttttttgagacagagtcttgctctgttgcccaggctggagtgaagtggcatgatctcggctcactgcaacctctgcctccccggttcaagcgattcttctgcctcagcctcttgagtagctgggactataggcacacgccaccattcctggctaatatttgtatatttttagtagagacggggtttcaccatgttggcaaggctggtctcgaactcctgacctcaagtgatccacctgccttgacctcccaaaatgctgggataacaggtgtgagccaccacacccagccctattgatacttttttaatgcagctgaatcttcctggttcttggtatggcaaatgatttttttgatggcaacctggacattttaggcattatatcgtaagattctggatctcattgaaactttcttttttctttctttctttctttctttctttctttctttctttctttctttctctttctttctctctctctctctctctctctcttttcttttcttttctttcttctatttaaaatcttgccctatgaatgaaactttctgtcttagctggcttcatctgatactgctgtgtcaggggagggagggcactgcctcattactgccaggtgggtctagacagccaggtttcctaattgacctctcttgatacctaagagggtggtttttccttactggtgggtgagggtggaagtcctggctcctcactagacctccagtgatatctccctgcctgagagggctaagagtgccttgttactgctttacacatagccttcactgacatcattagggggatggtctcacagccactggatagtggtgaaagtcctggctctccactgggcctcttctgaccccatcccagcgcagaaaggagtgtgtttcattacagcattgtgaaggtggaagtctaggattcccactaagcctttggtgacgtggatgagggtgcagccatatttttttctgtagtgtttagctggagtagagtaattattgtctaaaaattttctgtcctaatattctgccctttttctgatcctctggctagagagagcagacttttcttcttctgtgtttttggtttgtgctcactgtcatttctaggttgccaacttcttcagctttataccttgaatatattaggcaaaaagaacacccaggaaaatctccactgtgctattccttgggtcctgaggtccctagcccatctgcttcttcctgccacctttcagaaccattttatgtttttatatacaatatccatgattgttagccatattttgtaggagaaataaggaaaaaaatgcatctacctcatctttccagaggaagtttgacttattttggccttgctgactttttcgtaagttattatagtttgattatatcttgaaaccagaaactattccttgtcctaactcaggagacattttggagtggctttatattctattttgctgctttgtcaatagagttatttaaagttatcattatgtaggcaacagttccttagtttgtaaggcaaaatgctgaatctaagaaacatgtaccacatatgtgtctgttatatctgtaagaatttacttatttaaaatcctgtttgcgttaagggtaataaaagtgaagtgatatatagatgacagatttcatgagagaaaaattttgaagtcagaatggggatgagtatcatactgaattcagtaatgtattatatataatgcttaagtaatgattaacgtatacattattgcagtaccggttaactagtgatcacataattctcatcgaaattgtttagagacataaaatattggcacagggtattgttttacattctttgaaacagtaaatgtagattggattgaggaaaaggctatctgctttaacaataaatttcctaggtacttcagtagcttactgtgaatttactttgccctgtctgttgtattactcttaaaggagttagagaatatggcttcaaaataatatcagtggcattgctttcccctgctcttgcaggtgaaatccactgataaaggggaagaagatccattgatggtcataaataaaatttatcctaaaagtgtaaaatattcagagctgaatacagctctctatatatcagccctctgagtttatagatgaggaaactgaagcccagtaatgttaagagacctgggaaaagtaacaagctacttagaaggaactgggacttgaattcagattctctgatcctggggccactatattttccattagctggtacagtgagggaagaatcagacctagaagctgccctcaaagagtctactggagcagatgggaagggcaaaagtaattgtaatacttggtagaaagtgacctttcccataaaagagatttggataaagttttttgaaatgtaattctttaagcatttaaactgtactttaattttgtactatgcatacataaaaggaaagaagtcagaaatcttatttccagactcttttagataaagaggtccccaaatttattaatttttattttgaaaaagtatactcgggataaaaatgtggatgattatgtctggtttagagtgtttcataatttaattaacctaagataaatttatataagtaaatagataaatgaataaatgtactcacagaagatatatatatgtgtatatatatatatattttaaagagtagattcagtggatagaagtttcaaagagttagatgtcacctcggtataaggagatttttctgataaagctattgaagtacggaatgggccatctcaaattatagggagttcacattactagaggtggttaagggaaggctagttaacttcttaacagggatgagagtttagagggaaattaagcattgtgtaagtggcaggacccatttgatctgtaaagttccctttgaactttgagattttatgatttgaattatttcaaattttgcctaaactttggaggcttgggcatagtttaaatattgtatttttctcattttcaataagagaaatcctttattttccaatttttagagtatttaaatgtcatgtctagcagtaaaaaataatagtttttttttgtagcgtaacatccttatttgttaaggttatgttttatgatttcaccaaatttgtatttcatcataggtacatataggactaacacattttaatacatgcctcatagactggaagaatttcaatctacatatttcatatgctttctatttttttaaattataaaggcatctaacacacatggcaaaacatttacagaaacccaaagtatccatgaaaaataagtcttctctctctggaggcagccattgttatcattttgtttatttactttgcttacagatgttttctatgcaaatacaagcatgtgtgtatatcctcttttaaacacaaatggaagtacgtgatacacattgatctatggctacttaacaaaactttatattataaatatttctatatcaggacataaatacctaccttattcttttatttctcatataattaaaaaaattgagatataattcacataccatacaattcacctttttaaagtattcaaatcagtgtttttttttagtatgttcacaaagttgtgctgccattacagtgatctgattctagaacattttcatcagtgaatgcctatatactgttggtgggaatgtaaattagtacaacctctaagaaaaacagtctagagatttctcaaagaactaaaagtaggtctaccattcagtctatcagtcccactattgggtatctacccaaaggggaaaaaaaaagccattatataaaaaagacatccgggcatggtggctcacgcctgtaatcccagcactttgggaggccaaggcaggcagataattgatggcaggagttcaaggccagcctgaccaacgtggtgaaatcccatctctactaaaaatacaaatttaaccggctgtggtggcgcactcctgtagtcccagctacttgggaggctgaggcaggagaattgcttgaacccgggaagcagaggttgcagtgagccgagattgtgccattgtactccagcctgggcagcaaagcaaaactccgtctcaaaaaaaaaatccatcttcatgcatatgtttattgcagcacaattcacaactgcaaagatagggaatcaaactaagtgaccatcagctgatgagtggatgaagaatatatgatacacacacacacacacacacacacacacacacacacacacacacaccatggaatattactctgccataaaaaagactgaaataatgtcttttgcagcaattggatggaactggaggccattatcctgagtgaagtaactcaggaatggaaaagcaaatataatatgttctcactgttaagtgggagctaagctaggggtattcaaaagcatacagagtgatatcatggacactggaatctcagaaggagggagattgggaggagaatgagggatgaaaaactgtctgtggggtaccatgtacactatttgggtgacaggtacactaaaagcctagacgtcaccactatacacttcatccatgtaaccaaaagccacttgtaccccccaaactattgaaatatatatatatatctatctccttttactcatcccatttgttctataataaagtctatctcccctctccccagttcctggcaattatgattctgctttctgtttctatggatttgcttattctagacatgttatataaatggaataatacaataaatggcctattgtgtctggcttctttcccttagcataacgttttcaatgttcgtcttagttatagcatgtattagtactttcttctttctatggatgaataattctacaaggtatgaatatactactacttatgtttattcatttatcggttgatggacatttgggttattttcactttttacttattaataaagctgctgttagcatttgtgtataattttgtgtgtgttatgttacctcattattattattattattattattttttagacagagtcttgctctgttgcccagtctggagtgcagtgtcatgatctcagctcactgcaacctctgcttcccaggtacaagtgattctttgcctcagcctcccgagtagctgggaccgcaccacatgccaccacgcctggctaatttttctatttttgtagaatggggtttctccatattggccaggctggtctcaaactcctggtctcaagtgatccatccgcctcggccttccaaagtgctgggattacaggtgtgagccaccatgcctggcctattaccttatttttaataactccatagtactgtgtcatttggatgttttataatttatctaaatagtctcctacatagagacattatggttaggtatggactttgtgattgatattgaaaacagccttgcacatttctgtgtacaattgtgagataaaagttgagagttggaatttctgcagcaaaaggcatgtgcatttataaatgtatcctcattgcccctcagagaagtttcatcaatttattcctctaagtacctgtttcctcacaacctttcttaaaatcttttgaatctttgtagcattgtgatgttcatttttatttctaatatattcatgctatctctctttttctggatcagtcttttaagaagtttgtcactattattcagctaataaaatcctcagcaacccaactttcttttttgagacagggtctcactctgtcatccaggctggagtgcaaaggtgcaatcatagcactcctgggctcaagggatcctcctgcctcagcttcccaagagcaggtaggactacaggtgcatgtgaccacttccagctaagtttttaaacattttttttttttttgtagagacagagtttcattatgttgctcaggctgatctcaaactcctggcctcaaacaatccgcctaccttggcctcccaaagtgttgggattataggcatgagccactacaacaacccacattttgattttcttgatcatttattgttttagttttctatttcatttatttttgttttttattatttctccatttgtactttctttgatttttataacattgtttttctagcttattaaactagatgcatagtgcatctatttttagccttttaaaacagttttattttgttttaaattgatacatgataattgttcgtatttatggggtacaatgtgatgttttgatacatatatacattatgtaatgatcaaatcagggtaattaggatatcagtcatctcaaatacatgtcatttcttcacggtgagaacatttgaaatcctctcttctattttaaaatacattattgttaactgtagtcaccccgccatgcaatagaacaccagaacttattcctcctatctaactgtaactttttgttgagcaacctctcttcattacctgccccccactctcgcccagcctctgataaccactattctactctctacttctatgagataaacttaaaaaattcctcattatgagtggaatcatatggtatttgtcctttcgttcttgtcttatttcacttagcataatgtcctctaagttcatcaattttgtcacaaatgacaggttgcattccttgttatggctgaatagtgttccattgtgtatgtatacaacattaaaaattaatttatccattgatggacacttaggttgattccatattttggttattgttaatagtgctgcagtaaacacgagggcataggtatatgatgatagatacatatatatacttggaattgtgattgctagatcatatggtagttttatttttagttttttgaggaacctccatacagttgtctatattggctacccaaggtgatccacagagtcaatgcaatcctaccaaaataccaatgatagtttttataaaaacaagagaaaaacaatcttacaatttgtatggaacaacaaatgacctagaatagccaaagctatccttagcaaaaagaacaaaactggaggaatcacattgcctgagtaaggaaaacagcacggtactggcataaaaacagacacatagaccactagaacagaatatagaacctagaaacaaatacacatatatacagccaactgattttaacagaggtgttaggaacattcagtgagggaaaggaaagtctcttcaataagtggtgctgggggaaataggatatccatatgcagaaaaatgaaaagtagacccttatctctcaccatatacaaaaaaatcaaatcaaaatggattacagaattaaatctaagacctgaaactactacaagaaaacataggggaagtgctttatgaaattctttggggaaagaaatttttggctaagcttcaaaagcatagacaacataagcaaaaatagacagatgggattacatcaaactagaaagcttctacacagctaggaaacaatcaagagtgaagtggcaacctacagaatgtgagagaatattttcaaactgtgcatctgacaaggagataatatccagaatatgtaaggaactcaactcaatagcaaaaaagaaaataatatgattaaaaaattggcaaaagagcggaagagctgtttctcaaaataagatataaaaatggctgacagatatattaaaaaaatgctcaacatcactagtcatcagagaaatgcaaatcagaaccacagtgcaatatcatctcacccctgttagaattgctattatcaaaaagacatgaaataaatgctggggatgatgtggagaaaagggaacttacatattgttggtggagttgtgaattagtacagccactgtggaaaatagtgtgaaggttcctaaaaaaatctaaatagatctcccatgtgatacagcaatctcactgctgactgtatattcaaaaggagggaaatcagtatattgaagaaatatctgcactcccatgtttattacaacactattcacaatagccaggatatgaaatcaacctaactgtatgtcaaaggatgactggataaagaaaagctgatatatgtatacacacacacacacacacacacacacacacacacacaatggaatactattcagccttaaaaagaattaaatcctgtcatttgtagtatcatggataaaactgggggtcattatgttaagtgaaataagccaggcatggaaagacaaatattgcatattctcactcatatacaaaagttgacttcatggaggtagagagaagaatgatggttactagaggttgggaagggtagcaggaggaatgaagagaggttggttaatgtgtaccaacatacagttaaataggaggaataagttctagtgtttaatagcacaatagagtgactgtagttaacaataatttattgaatatttcaaaatagctagaagacttgaaatgttcccagcacaaagaaatgataaatgtttgaggtgatagataactcagttacccagatttgaacactgcacattatatgcttgtatcaaaaatattatgtgcaccccaaaaatatgtccaattattatgtatcagttaaaaaaaaccaaaaatcaacatcactgtaacaaatggtatttgtattcttatttttttatagatattgacaagttgttccaaaacccatgctcccatgatgagtgagtttaactatctgcccacccccttgacatatctgatgtacttttttttggcacaggtgtgcacacaatttgatagaaaaataatttattcttgttagggagtatttaaaaatattttcaacttttattttagatacagggtgtacacatatgcaggtttgttacatgggtatatcgcactcaggtagcatgcacaatacccaataggtagctttttaacccatgccccactctgcccctcacccctctagtagtccacagtgtctattgtttcgatatttatgtccatatgtgctcaatgtttagctcccacttctaagtaacaatatgcagcatttggttttctgttcctgtgttaattcgcttgtgattatggcgtctagctgcatctatgttgctgcaaaggacatgattttttctttttttatggctgcatagtattccttgctgtctgtgtaccacattttctttatccagtccaccattgatgggcacctaggttgattccatgtctttgctattatgaatagtatgatgatgaacatacaagtgcacgtgtatttttggcataatgatctaatttcctttgggtatgtacccagtaatgggattgctgaatcaaatggtaactctgttttaagttctttgagaaatctccaaactgctttccacagtggctgagctaatttacattcccaccaacagtgtataagtgttcccttttctctgcagcctcactgacatctgttgttcttttactttttaataacagccattctcactggtgtaagagggtatctcattgtggtcttgatttgaatttctctgatgattagtgatgagcattttttcatatgcttgttggctgcttgtatatcttttgagaaatgtctgttcatgtcctttgcccgtttttttaatggggttgtttcttgctggttgatttgtttaagttacttatagattctggataatagacgtttgttgaatgcatagtttgcaagtattttctcccattctgtaggttgtctgtttgttgacagtttcttttgctgtgcagaagctctttagtttaattaggtctcgtttgtcaaattttgtttttgttgcaattgcttttggggacttatccaaaaattctttgtccaggctgatgttgaaaagagtattcataggttttcttctacactttttatagtttgagttcttaaatttttaatccattttgagttatttttgtatatggtgaaaggcaagtatccagtttcattcttttgcatatggctagccaagtatcccagcaccatttattgaatagggagtccttatcccgttgcttgtatttgttggccttgtcaaagatctgatggttgtaggtgtgtggctttatttctgagttttctgttctgttccattggtctatgtgtctgtttttgtaccagtactatgctattttggttatgtaaccttatagtataatttgaaatcaggtagtgtgatgcctctggcttttttctttttgccttggctatttgtgctcttttttggttccatatgaattttagaatagttttttctaattctgtgaagaataatgttggtagtttcataagaataacgttgaatctgtaaattgctttgggtagtatggccattttaatgacattgattcttcaaatccatgagaatggaatgtttttccatttatttgtgttgtctttcatttctttcagcagtgttttatagtgctccttgtagagatcttttacctccttggttcttggtgttcctaggtatttcattttctttgtgactattgtaaatacgattgtgttcttgatttgactctcagcctgggtgttattggtgtatacaaaggttaccgattttcatacattggttttgtatcccaaaatcttgctaaaatggtttatcagttctagtagcgttttggtggattttttagggtattttaataatagaattatatcatcagcaaagagggatagtttaacttctttttttcctatttggttacctttttttcattctgtttcatgattgctctggctagacttcctatacatcttttaagccttattgtatgtcctgatatttagctagagatggctgaatcttttcttacgcttctcggatattcacatttctttttctgcgaatttacaatttcaaatcatttgccctatttgtgcttttcttttgaattttatgaattctttttctcctttgaatttttattcttagtcacttttgtatgttactattattttatccttctttgttgattgtcttttatttttagatgatcaattttactgtggtataatttacctgcaatagaatatgagatacccctaggaacctactagaatgtctaaaattaaaaaaagaatacctaactgacaatgcgaaggtgctggcaaggattgtgagcaagtaaaactctcatacattgctgatggaagtacaaaatggtacagctaccctggaaaacaatttggcagtttcttacaaagttaaatatacacttaacatatgatccagcaatctcattcaaaggtatttaccatagacaagtaaaagcttatgttcacagaaaaatatgtatacaaatgtttatggtagctttatttataattgccttaaactgaaaacagcctgagtggttttcagctggtgatagaataaacaaacgtggtgtatgtacaccaaaatatactacttaacaataaaaaggaacaaagtactgatacatacaaaaatttggatgaatctcaaaggcgttaatgctaatcaactaaaagaggtcagactcattaaggctaaatatattatgattccatttatatgacattctgggaaaggcaaaattatagggacagaaaacaagttagtgcttgctggagaatgggggtgaaaagtggatgattccacatcaaggaaatttggacagtgatggaattgttctatgctgtatcttgattatggttgtaattatgactattatatgtttgtcaaaactcagctgtacacctaaaaagtgtgaatttttctatatgtaaattacacctcaataaacctaattaaaaattttaaaattaaacccatgtgatttgcattataaattggaccaccatttgtgattatgaaatatgaacttgccaataaactgctacaggtgacgctaaactataaggagccccttctgctgcgtctactaattaaatactttgaatgaggttcaaaaatggccaatttgaaaataaaagtaacttttaaaacaaaagttgttacacagatattcaattgcagaaagagtaagagctttgctcaaaaacttgaatatgacattcacataatatccactgtttctaggaaaaaaacttataataatgtctgcatctgtacattactttagagtttgtaaggtacttttatatatgccatctcattttgaattattgcaaaacaatgcctcactagcaaagaataaatgttcccatgaagctgcaagcccctatgactatgaatacaattgtgaagtagggattgtcagaccccaaggttcattttctccctgagtgacacttaatccagaggtaaaaatcagtctcagatagtagaacaggccaagttatgtggtaaggctgtggtgtccccaaacagaagcaactttgatggaagaaaacagagaatacatgtaaacatgtatttgtgcacatttgtattacatggctgctgagagaaaacagcaggctgtttcctttctagggcctgtttatttctgagcatatctccttggtgagtgctccccacaaaatactggtgcataatacgtaacatctttccttaatcataatgcaccccctacgtccctggtcccaggccttttctcaccatgttccctcgtttttgaatatacttttatactcccacaccctccacaaggcagtaatttaaacctcatccatccttaaggaccagccccaaacgtcctcattcacccaagcagaagtaattactttttgtagattcccactgcatactgcttaactttctcttatagaattgatcacatttggcattgcctcatatagatgtttgattgcttccagttgtaaactcattaagtacctagcctagttcattggagacccaccacaccagctagcagtgtgccttgctatactgtaaggtcttagcactttcactgaagttcaggcataatcaagtgtgccacatgattccagaaagcaccaagccaagaggaaacacagaggtggatgtggaaagcaaaatacaataataaagcaaaagtatgtttctccctgtgttagtcggggttgttcagagagaaacggaaccattaggagattatctatcaaggggtgggggttgagagaaggggagagagggagagagagagagagaagaagaagagaagaggagaagagaagaaaggagagaggtgagagaaagaaagaaaagaaaagaaagagaaaaaagattttaaggaactgtggaagcctacaggctggagacccagggaagagttaatattgaagccccagccaaaggcagtcttcttgtttgggggtgggggacagaaaaggagcagtcatttttctattaaggccttcaaatgattggatgagactcatcaacattaggaaggataacctactttatgcaaagtaacctgctttactcagaaacgtctagaataatggttcaccaaataaccatgttgacacataaattaaccatgagacctttttttctctacaagatgctccacaagtctcttcttcccagtccttctcccaatgcaacgactgcagtgggagccacctccttaaaaaggaagcagttttatctaaggcatgctaaacaaattcctggaaaggtctaactaaatgataatgcttcagaaactatagtgatcacataaccaaaaaaattccaagttattttaaagttgcagataaatcccaattgtgtataataatttatcttgtgattggtgagttttgttacattgcagtcacatttaaaaaaaatctctcagaagaattaatttcaaaataaacctcaatcctggaacacattacaacattctcttcttatgctcctctttctaaataaggtaccagtgacctcaactgaaactgcagtttaactttattaaggaagaagaaatagaagggacaaaaactgttgtaaaataaattataaatattaataatcactaatgctgaaatttctagtgctcaaataaacataaaattagaaactggtctgttctgcctatggagtagcgattctttattcctttactttcttaataaacttgcttttacttaaaaaaaaactgtcttaactattttaatgaagtatttgaaaacagtttttttcccacaaatatcttatgacacagaaatagaacctagcagactattacactagtgagcaaataatgaacttttggtaaagcatacccaaccttcagttagaatatctcctgataataagaaagatctcattgaaatttattaattcttttgtgtctagtagataacttggatggcacacagtgctttgatttttacctgcccagaatttaactcctcatcctatcctacatgattttctttttcctctcccccttcctcttttattccatgtcactgggaatggcaggtcttgcaccaagtaatggcaggtcttgcaccaagcaagccagaaacctgagctttagtctttattcctccccacttttcactcctgcatccattctagtagtgaaaccattcaatagctttcaattaatccttcctctctcttttttcttagttcagattctttagtttgaattactctatcagttttctaacttatccactgacttcaggacttgccttccttcagtttgttcaactgcattttgagaaatactgctaatgctattctgaagtcactcttgcttgaaagtatttcagtggctccccagtatcatcagtataaaaaaatctttttttgagttacacataaacccttcagtatggacctgatcacttgctaattctcatcgtcttccacacacagcaaacaaactgacttttctgctgtggtttatgttttatctcccttatgtggctccctctgcctggaatgcccactccgttccccactttgcctagttaacccatatatgttgtctaacaaagactaaaatcaacctttgtcacctctcagaagctttacagacacaagaatattaactgtagtgtattgaacttgggaaaagagcaatgatctgagatactgagtcaaaaagcctcacagataatctaaacaatttccaatccaaaggggctgaaccagtagtttacaatgtattatttcccccatactattcatatgtgtagtgcattctatcagtaactctcaatataagtagtgaatctccagaagggaagggaacacttcgggagggataattcaatgtgcacatgttgggacagaggaaaagaaagaaaagaaagagaagcagcctcacaaacctaagaaaatcttatcaaatttttatagtgaaacagtttgggggtgggtggcattgaatcaaaaatgactttactggaggtccagttttcaaatgtagataataattatgggcacagagattttatatagagtttacaacttgacaataagctcttacaaaatcgccagtggaaaatgtttgccatggtcataaattcagtgacctgcttgaaagatgtgtggtatttaccctatcttgctccagccagctcatacagaaagcagcagcataatccaaaggagtggggacatccatggaaaatttcctggcctggcagtttgcatgataagtgaagaaaacacgatttactaagaaaaatgcaggtggaacccccacagcaggatgaggccaacaaatttattacactaggtgaaatacacatgaatgtctgctgccaggtcagactcataaatatgcattaaaagagattctgaacccttatgagaaccagttttttctcaacctacaagggctgacagatttatggttgagggttttacttcacaaacaaacccttaggtagaacctacatttctgctaaggtcatagtgttctttcacaccaaggagactcctaagaagaaacaaacagttttttaacagtttatacaggtagaacattccagtaatcagcagatagcaaaatctgtgactataatgagcaactaaaatggaaaaaagcagaaaaaataggacaagggagtcagaaaggacagacattttttctaatctctactttgctacaaattagttagctatgaggaccccagtttcctcatttataaagtatgttaagggtaggaagataataaaatcttttaaggtctgtcccagcattgaaacagtaggatttgatctagagtgacctccctgacagatacgagggtgaaatagaggcaggctcacatgacagttactggcaaggaagagaaatgggtagtcatgactggtggaagtgagtaaaagttacaaaagtaagctggacatacagtctgggtagccaactttatattgttagaaagtttaaccattcttttccaaacatcccttcccacaactttcaaaattattccttaactcttctatgactttctattgttatattctacatttgtatcacaataatgttaacatcaacccctagtacaggtagggctgaaatttcagtcaatctactcttatatccacagccaagtatatgtagagaggatgatattgggggatgatatggtttggctgtgtccccacccaaatctcatcttaaattccacgtgttgtgggagggacccagtgggaggtaattgaatcatgggggcaggtctttcctatgctgttcttgtgatagtgaataagtctcacaagatctgatgttatataaaggggagtttccctgcacaagctctctttttgcctgctgccatccatgtatgatgtgacttcctcctccttgccctccaccatgattgtgaggcttccccagtcatgtggaactgtaagtccattaaacctccttattttgtaaattgcccagtctctggtatgtctttatcagcagcatgaaaacagactaatataggggagaagggagaaatagagggaatgaggacttctttcttcatttgtggggtttttttttttttgagagagtgtctcactctgtaacccaggtgatagtgcagtggcacagtcttggttcgctgaagccttgacctccagggctcaagcaattctcccacctcagcctcctgagtagctggcaatagaggcactcaccaccacacctggctaatttttaaatgtttggagacatgggggtctcactgtgtttcccaggctggtctcaaactcctgggctcaagtgtcttcccacctcggcctcccaaagtgctgggattacaggtatgtgtcactatgcccagcctctttctccatttgacatcatgatataggcttcaattcatcaggaagagaaaacaattctaaacttttgtggatctattgcatagcttcagaatacataaagcaaaactgaacaataagaaaatgacaaatctgttcatgtccttcgcccactttttgatggggttgtttgtttttttcttgtaaatttgtttgagttcattgtagattctggatattagccctttgtcagatgagtaggttgtgaaaatttcctcccattttgtaggttgcctgttcactctgatggtagtttcttttgctgtgcagaagctctttagttgaattagatcccatttgtcaattttggcttttgttgccattgcttttggtgttgtagacatgaagtccttgcccatgcctatgtcctgaatggtaatgcctaggttttcttctagggtttttatggttttaggtctaacatttaagtttttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcacatagttgtagatatgcggcgttatttctgagggctctgttgtgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttgattccatatgaactttaaagtagttttttccaattctgtgaagaaagtcattggtagcttgatggggatggcattaaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctttgtttgtctgttgttggtgtataagaatgcttgtgatttttgtacattgattttgtatcctgagactttgctgaagttgcttatcagcttaaggagatcttgggctgagacaatggggttttctagacacttctcaaaagaagacatttatgcagccaaaaaacacatgaaaaaaatgctcaccatcactggccatcagagaaatgcaaatcaaaaccacagtgagataccatctcacaccagttagaatggcaatcattaaaaagtcaggaaacaacagatgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgccgctataaagacacatgcacacgtatgtttattgcggcattattcacaatagcaaagacttggaaccaacccaaatgtctaacaatgatagactgggttaagagaatgtggcacatatacaccatggaatactatgcagccataaaaaatgatgagttcatgtcctttgtagggacatggatgaagttggaaatcatcattctcagtaaactatcgcaagaagaaaaaaccaaacaccacatattctcactcataggtgggaactgaacagtgagaacacatggacacaggaaggggaacatcacactctggggactgttgtggggtgggggaaggggggagggatagcattgggggatatacctaatgctagatgacgagctagtgggtgcagtgcaccagcatgtcacatgtacacatatgtaactaacctgcacattgtgcacatgtaccctaaaacttaaagtataataataaataaataaataaataaaaatatttaaaaattaaaaaaaagaaaatgacaaatctaccaattggagtggaaaattgtaaaccacctctctcagtaactgatagaacaagcagacaaaaaaaaatctattatggttatacataatttgaatacaattatcaagcttaatttattgagtatacatagaatatttcagcaagtggagaaaatgtcttatcacaagtatggacagaacatttattaaaattgaccatatactaggccatcaaacaagtctcaacaactagtgaaaggactgaaaattagagtatattctctggttactgtgcaattatgctaaaaatatgaaacaactaaaaatagccatgtatggatattgaaaaacatttttaaacaacacatggggtgaaagaaatcctaatagaaatgtaaactacttaaaactgagcaataacaaacactgcatagcaaaacgtgtgaggtgcagcgtaagcaaaacttacaggaaaatttgtagccttaaatgcttacacagccttcatcacttaacgacaggtatacattctgagaaatgcatccttaggcaattttgtcattgtgtgaatatcatggagtgtacttacacaaacgtatgtggtatagcctactacacacctaggctatatggtatagcctgttgctcacaggctacaaacctgtaatgcatgtgactgtactgaatactataggtagttgaaacataatgatctgtatttgtgtatctaaatatatctaagcatataaaaggtatggtaaaatatggtataaaagataaaaaatggtacacctgcatagggcatttatcatgaatggagcttgcaggactgaaagttgttatgggtgtcagtcagtgagaagagaatgtgaatgcctaggatattattgtacactactatagactttataaacactatacatttaggctttactaaatttataaaaaatattttttctttggtaataaattagccttaacttactgtaactttttactttgtacactttttaattttttaaaactttttgcctcttttgtaataacacttagcttgaaacaaaaacatattgcacagctatacaaaaattctttttttatatccgtacatatatacatataatttctttatataagcatttttcttttttcatgaactggaagaattaatattgttttttatttgtataaatgtaaggggtacaagttcaattttggtacatgggtatattgtataatggtgaagtcttggcttttaccatatatatgcctttttctatttttaaaattgttttttttttttttttttttacattttaaacttttttttgttaaaaacgaagacacaagcatatacatcagcctgggcctacacagggttaggataatcaatttcactgccttccacttacacatcttatctcactggaaggtcttcagggcaataacgtgcatggagctgtcatttcctatggtaacaatgctttttttctggaatacctcctgaagggatgtgcagctgctcagctcagcaaaggcaccaactcccaagggggcaattttcagtttcagttcaggtgagggtgtgtgtgtgtgtgtgtgtgtgtgtgtgtgtgtgtgtgactcttctggatggccctgttttcaccaggatgcagggctccaccaaagcgctgtttgctcagcagcagagtgcagattcagctcaggtccctaggggcagggtgcaggcatggctgggagaagatggagctgttctgccaaagtatgggttccccaggagggactgcgcagcctcaactctgcctgaggggatgggggaaggagtgggtggagcagttccaccatttcttggccccacagggaagggacagttgttcacagctggacttgaggatatagggccactaagcaggggtggtttgagggcagtttagtctcagggaagaagatgtgctgtgactactcgtactcatcctggggcaagacatactctagcattagctctcagtgcagtagccctgtgggccacttggggtggggcacagtgttggcttcttatctgtggggggagcacagctttgtggtctctaggcagctccctcagctgagcttaatgctagtgaggactgcaggggaccccagtagtgaggattgtaggtatccaaagggttgatgggggctgctgggatcctcttgcctacctttgcaccatagagagaagttccttctggttcccaggttatctcacatgggggatggggtgatggagtcctagtatttccttccgttctttatgtgactctcctgagtttctgtgctcaccaaggtttgtgttactcctttgacgcaccctggtgttctccattagttattttcattaaaatatagctgtttatttgttgttttgcttgtctttatggaagggaggagggctaggggcttctagtcggccatcttcctctctacccattgtgcttttctagtgatactgttctgaaggctggatccaacagaaattgtgtgtgtgcagagatgtgtaaataagaatgcgatattatagtcatgtgtcacataacctttcggccagtgattaactgcctacgaaattgtggtcccatatgattataacggagctgaaaaattcctattgcctagtgaagtcagatccctcctaatgttgtagtgcaaagcattcttcacgtgtttgtggtgatgctggtgtaaacgaccccactgtgctgcttctagtggtataaaggtatagcaatactgttatatatatagtacataatacttgataataaatgactgtgttactggtttatatatttactatactttctattgttattttagagtatattccttctatgtatacaaaaacctaactgtaaacagcttcaggcaggtccttcggaaggtattccagaagaaggcattatcatcataggagatgacagctccatgcacgttattgcccctgaagaccttccagtgggatgcgatgtggaggtggaagacagtggtatttatgatcctgaccctgtgtaggcctatgtgcttgtgtcttagttaaaaaaaagtttaaaaagtaaaataaaagtaaaaattgaataaggattatagaataaggatataaagaaatacaatattttttacagctgtataatgtgttttaagctaagttattacaaaagaggcaaaaagttaaaaaaaatttaaaagcatataaaaaaagttacagtaagctaaggttattattgaagaaagagaaatttttttataaatttagtttacctaagtgtacagtgttgataaagtctacaacagtatacagtaatgtcctaggccttcacattcacttaccactcacttactgactcactcagagcaaccaacttccagtcctgcaggttccattcatgctaagtgccctatacaggtgtaccattttttatcttttatactgtatttttactgcaccttttctaagtttagatatgcttagatacacaaatactgactattatgttacagttgcctacagtattcagtacagtcacatgcattagaggtttgtagcctgtgaacaataggctataccgtataacctgggtatataataggctatatcatctaggtttgtgtaagtgtattctatgatgtttgcataatgatgaaatcacctaatgacacatttctgagtacctatccccattgttaagtgatgcatgactgtacttacaatgagaaactattggaaactctctatgtatataccaatgggaagaataaagaattgtctcattgtgttcatgggcacgtaccttaatgactaatgattttgagcatctttccatatatttatttgttattccatatatctttgagtatgtgttcagatttttgcccattaaggaaaaaaactagattttctttcattgtagagttgtaatttttttattgattctggatgtaaatctttcatcagatgtgtgggttgcaatttttcttcctggtttgtggtttgtcctttcattttcttggtagtctttctcagaacaaaatattgtaatttgataaagatcattttgtcaggtttctctttcgtagatcatgtttttcatagctacaagatctttgcctaacctaaaatcctgaagattttcttctatcttttcttccagaagttgtatatttttgggttttatatttagatctgtgatccactttgagttaacttaaagcaaataagatttatttgctaggaatacttttatttgtttaactcataaaataaatatgttatgaaaatgtgttactaggagttattgcctccagttggtattttggaagcatgggattgttagtgacatttaagctcttttgaccctggccagaagttagaactatagttgatttcataatttagtgacttaaaagtgtgtagtatctggagcaaatcgtttcatgaaagaatacttaccaatatttatttttactattttacccctgtagttctgtttcattaaaaataaacacttgtcctgacccactaaacagatttcatgtctcatgactggttccagataatttaaaaagcatactggcttaactatcttcctgaattggaactcacaatcttcaccacctccactactaaataaatattacctgtcattacccttttctgtctgctttgtaacaattctacttggtttttctctaagcacagtttaatttttgttatgactttacaaatttttagataatatactatcagctatgttgtcagaaaaaaaacagtaaatggagtaatagaaggaacttattgtgatactgtagaattttagtatctattaaaatagcgatgtccagccctggaggagctataactcttccgtatttgtgtttcattacctattcctgtcttagttgagtttcttttacttctatgtagcagaaacacactggagcttgctctagcctaatggagcctagggaggccaagggcaggaagctagaagggctcagtaactttggaagctattcttgcttcttgtatcatttgtgttccaggctacgttggctctgtttctttttatgtgagtcctttacacctctgtctttctgaagactggctttctctgatttctctgtgcatatgactgccctgagaccctgggattacttctggccagactagaattgctctgctccaattcccaggagagatagtatatataattagtttaggacaagttccacttctggtctaatcagcatggcccaaaggtagttagattggaaagaacaacccatgtttgccttgtgggtagatggtatgcagttctcagagactgagaagggtgctgggtctactgcaagttcacaaaatgctggttggtatacatttaccttttaaaatgaattttaattaatttggttttcagaatgtagaagtttataaaaagttcattgtatattaaaaaagactgagttaaggattacaaaactagaaaagtcacactgacatcaaaggatgactattcttttattactttcatgttaaaaataattaagcttatataacaaatttagtcaaatatattgaccacagagtactctttattttcaaaggtggtagtcatccacatagtgaacgtcttgtcgatccagcagttgaaggtgttataggctaaagaaaattaatatttaaaatattagacatgcattacaaatttacctctgaagagttttcatttagatatattaaaattccaagttgtagggaagggaagatatgagacccaacatttattgtgtttctgcctagtcagtcagttaacatattttatttcattcagaccttatagccaccctttgagaagtaggcgttgttatcctagaagcagtgaagaaattaaaacacacagaaaacagctagcaaatatgtagtgaggctagcatttaagctcaagtctgtgtgactctacagtttcttctctcttcactctactgtttgggggtatgaaagtatatttattaaacttttctaaaagaggctataagtaggactatacagaagctattcagttcattttcttgtctgtgtgcttaagacagtctcagtgtcaaacatatgataatcatttctccatatctggagcaaaaagagagtcatgtcagttacctaatgttagtcacttaagcacatggattttttagaggtcattacagtgataaatcaatattttaaaatagcagtggcttcttcagtttggagagaaatgttttttaaccttatattctaaaccttaatgcatgctaaattgggaattggagggaaaaagggaaagctgacctttcttttttagtctgaacaaacaagaagaggaaagcaaagactggctaaatagtataaggcagtattttaagctttccatgtttattcacttgaaacctgttatttttcaaaaacacatttttaagtgaaaaatcagaaaatatatatgctttagaaattattgttaaagacaaattttgtaacataaatgctttatgtaatagttacataaaacaagtttaagttgtctggtattgatgatatagaggaaaaactatccttcaaatatttgtgaattttacctgtgagttaatgatggtttaccttctaatttatcaacctaaatggccttgtccaatacaattaaaatgaacaattatttggtttattgtaacttcagacttagtcggaaaaaaatatataacagctgctagggtgtaattgctaaaataactataataatttttgtctctgcatggtgaagaatatgcattaagactttagcaaaagataagactgtgctctctttgtaagtagtctgatcaaatgtggctcatgacttaaaattaatttgatataaagtaaatctagcttaattctttattaagaattcacaatgacctttttgaaatagaggaatttgagatgaggatgagctagatgctccagagttcacattgctgctaccctttagggcataaaaggagcaaccaaaatcatgctattttagttctttaatagtttggctattcctttacaagctatcttttctagggacaaactaatatagcatgacatactttaagcatcaaacataaaagagttttgaccaaactgctctcagcatttctgttctgaaagtacctaattaaaagtaaccctgagttactggcccagatattggcccagtgtaggggaaatgaagcccacttagagttaatgggttgaaccaattgtcctctgtagttcatttcagtacctctaatgtttttctcattggtaagctttgagacaggatgggagcttattagtgacacagttttcttcttctgaagctaaactcttggtattgtgatcttttgaccttttattcgctctaacttcttgattccctttttccactcctctaaagtacagcacatatacaggttcattgatgtacaaccaaattttactgtagtggtgagcatggtttatggatttaattaattgacctattagtgaaatccagcttattggcagtctttcacgattgaaattctaactagtctctctgcatatctatttagatcatcccttaaccccaatgctaggctgctgctaggttagatctgaaagcactaccggcagtcagttttgcatattcagttaattatttggtttcttataaaccacttctctatttttttcttttacttattctttgcttccaatttcttggctacagtttcttagttctgtttgctgtttagtcagaggaccagtagaaaagagcattttccttttccttttcaccagattcagggacagtttctgtgttctcctggttcaggtctctgtaagtcaccatatgtggctttcaaccctgtcagacgttgaccttacccttttaaacattttgtagcagtttgtttaattagtgggaaatagaattcatagatagtgtgacctacttatatacatataacaaaatcaataccatgattataatataaagaataaataaatataatttatagtgaaactgtacgtatttcaggatatgactgtgagggcccaactgtactagaagatgtagtgaagtagtgaatgcttgtacctacttcttttttttttaaaacaaaaagttttttaatgtctgtagcctaatcttggaaatgaagcttgtacctacttctaaagaattaagttcaggtttatgagaagtaacaaggtaattctgtatagaaaactacagaaaatgaaaaattagtggtacatgtggaccataacataaaaatgttagaataaataaccacagatgagacttgtttgtatataataagagaaagaaggaaatacttgaagccgagaaaacatgtcatgacaaattacagactctcaaaatgaagaaaatgaggaagtacgatattctcacaaaggacttgggccatatttataagggtactgagaaagtaatttcctatattgtgatagagaacaagaccctgatgaggcatcacagaaagcatatttcctattttgaaatactaccactttaagacatggtttagattcctggtgcctcaaaagaccttgatgaccaaattcttctctaggtgatgagaaatagagaggatggattagaaagagaaacaataaaacagtaaggtatggagaagatggggcagtagatgtctctataccaaaaagatagaaaaataacaggcaatcaccaaatgaatactttcaatatgggtttttacaggatatgtttcttagtgttacagaacattttttttaacacatagaatttcgtaatttgaaacattaatttaagtaatttttattcttttaaaaaatttgctcttcaaaattcaacttcagtaatttttattgagatccctatggttcatatgtctctacgaatttaataatgctttgtttgtaatctttaagaatggactcaaatatcctctgccattttttgcagaggttccattgcttttgcagtaactgcactattatactaaactcttttcaacaaatatataattagaaatgctctagtatgtagtgcatagagtggatatataatttagttttgagacaacatctttatttgattcaagcttctgcctccgtaaagactttgtcctaaattattgggcttttttcttaacttcttgtcaaatctacctgtattagtatacacagttcgtatactacctgtgtattagtatacacagttcctggtgtttattgtgttaagtttcacctggcagagtatttccctcttctgggaaatgaggccattctttactgtttgggactgctccatgtattccataacacttacctctgcccaccaaatgctcgtggtttctctcaataattttgagtggtaaaagtaccccaacacatttccaaaatgctcctcaggggcattggactcattggctattcctagctaaatgtatatgcttgcatttcttaaaaaacaacctccacaaattttatttatgatttaaaaacacttaaggttaatccccattttctcttggaagaggagtcttttttcagtgtgactgttgtggattgaattgtgccctcctgaaacctagatgttgaagtcccaaccccaccagtatctcagaatgtggtgaagtgtggagatagggtatttcatggtagactctaattcaatgtaactggtgtccttttaagaagaggttaggacataggcaggttcagagggaagaccatgtgaagatggccatctggaagccaaggagagagacctcagaagaacccaactgtgctgacatgttgaatctgttgtttaagctgcccagtttgtggtactttattatggcaaccccagcaaactaatacaatgactgattgatacttcttaatatgtgttatttccatgttagtataccaagatagcagtataatttagtggttgcagttcagattttcaaggttagaattctgactcagccacttagcaatggtgaccttgagcatattaataaactctgagaagcctctgttttttttaatctgtaaaatgagggtaataatacgttcttctctgggttgttgtgaggatttggtaaagtaactaatgtaaagtgtctggtacgtggaagaattctataaataatacttcttttttcatctgcttccatttttaggtatactttgcattttcaaaaatgatgtaatggcatacttgttagatggacatttattgtggggatttcaggctgcctgattcgtggatgagggagaggtttgcgggtcatagggctttttcaatacctttatactcaataatatgcatttaacactttacaaagtcatagtacctcacatccaggtctacatgatgcacaaggattaccctcattgtgcctcaggagatattattgtaacctttgttttgcttacataacttcctttaagacacagtatacctgtcccctgggaatatgctgagataagtattcttcctctgtattgcatagtgccttagcacacataccttcattcatagcatttatatgctctgttatgtctgttttctccatgagactgaactctttgaatgtaggtactgttcctcgttcatatttatattcctaatgttctgcacagtgcctgattctttgtagatgtgctataaattacatattaccaacatttatgagtaatgctaagtgctagatgctgtctctgtctctgttttacagacggtagttaagtgctcacggtaacacagttcagtggtagagctagaattgaacaccatgatagcttatttgcagggcccatgctcttaaccattataatataatgtctcttccctgagaatggaagggtcatcatctggtatattgtaggtcagtgtagcccagagagggagtttggaacatttaattggtaggaccaagaacctgaagcacgccttacctgaaagcaagttgggggtgtgtgtgcatgtcctgatgcttggaaaagaagttatattttaatgcacatagtctgctatattatttgtactactggtattgaaggtttagataaaatttgtatctctgaaatgcactttcttcattaaaaatgaatttctatagtgatatagagtgaaatttcctagtaagcccccaaatcgcttaaaatggatgtcatcattgactgtgctcccttatacgttgatagcagggttaagatgattgatatagctttagggaatttgctatatttgtagtggaaacagcgtgagaagaaaagtgaagatgctgcttgtaacagttaaaacttcagatttcttaaatgcttaggagatgaactgttccagaattttgttttattgtatttttatttacaactgattttatctccttaatatcaatgtatttttcattttcaatactttggttaaattttttcctgctgactcatggctgtcattacagctgttacagtaaagtgttttagagatgctgtaggatctgttgagacttgtagaactatttgcttctacaatatatgatcccggattgttgtactcttcttatgttccttgaacagcttttgcattttcttctatgtcatgccttagtgtgccttccttcagctccttatctccttcttctgattttttgcatgctcaaaaccagttggccaaacagatttagaattgtacatgaaggactaaggtgtgcgtcagttactaacatgaatgtgcatttgtgcttgagctttgtgatatctattctgtctctgaggcctcttttttacttgtttctttactgtgttttgaatagatgaagttactgcaaaattggttcattctagacatactataaaatgatgtcaattttcagtctgtctattaaaagggatagtttggcttaatagtcagaagttcaggtacttttccagtagattgttttagtgacattttgcaattgattattattggaaagtaaaattctttctgccttaatgaaagaaattgtgctttaatttatcctgtttaaaaggaaaagtcaacaaatattttgggtgataaattcatgaccagcattcatttgggcacgttgcataactgagctatagttattgacccagaagaagtaatacctcatcaggatagcaaaggattataattgttttgaaagatcaagacgctagccatggatttaagagtggagaactatgaaagcacttggtgtttaggaactctgagaggaactgtagaatgaaataaagtagagcataataggaaggtggaagctgataaagacagagcactaaattagtgtggcatactttaattaattagtgtgtgtaagagaaataaaaatgagggggggagtaggggaagggatttctggagatactactctgtagtttcatatttagaagacaaatcaaagctgttaatagactgttgactttgagctgcaattattgatatcagtatgagaaacagtgggctgacatcagaatttaaagggctaaggtggtaacactatgtaatggagaggctttaaaatcagacagtcctgggttagattcctggcatcatcacttctggctattttgacattggataacttcatgttttctaaaaagcctagaaaacgtgtaccagtgcctgtctttctctttgtattcatcattttggtagattactggaagatgactgtttgggcctaaaggaagctgtccagttttaaattgttgttgttgctgtatatccttacatataatttattgtcaggtatatgatttgcaaatattttctcctattctgtaggatttttcacttttttttttttgaaatggactctcgctctgttgcccagactggagtgcagtggcacaatcttggctcactgcaagctctgcctcccaggttcacaccattctcctgcctcagcctcccgagtggctgggactacaggtgtccgccaccacacccgactaattttttttcttgtatttttagtagaaatgggggtttcactgtgttagccaggatggtctcgatcttctgacctcgtgatccacccaccttggcctcccaaagtgctgggagtacaagcatgagccacggccccggccgatttttcacatttttgataatgtccagtgatgcacaagttttacattttgattaagtccaaattatctattgttgctcatgcttttggtgtcatgtctaaaaatcctttgccaaatgtgaggtcataaaaatttgtttttatctaagagttttagctcttaacaggtttttgatccattttagttaatatttgtatatggtatacacaaatgtatatgtatatggtgtatacctcattcttttgcatgtgactatccagttgtgccagcaccatatgttgaagagactttcctctcctcaatgaacagtcttggaacacttatggaaaatagttaaccatagacacgtggctttatttctggactctcaattctattccattgatctatccttgtgccaacaccacactgtttgattaccactgctttatagtaagttttgaaattgggaagtgtgagtcttccagctttgttctgctgtgattacctttaaagattaatctttgctgaaaaaaagtcccaaggaacagggacaaagtacagtgtggttttgacaggggaataaatactctgggaggctgtagctgagatagatagatttaagtgctcggaggctgataataaagaaatgaataaaaaagtaaaatatattgaacacctattatatgtcagctgttcatatatcctcacaacaaacttgaggaagtgggtattggctccccatttttacctagtaacattctgagaattaatgagatgaagtaatttgcttgtgcagctagaaagtgacagctgaacctatgtcattaagcttctaaaggcctattaccatgctgccttgataatgaaactacctgaataaatgtatcaaccagggtctaatcaagagaaagaaatcacatgagttatttgaacaaagagaatttaatataaataattattatgtaagtatattatctactgtaaattaattgaaagggtaaaaaggtatttttttacccaggacagataaggctttcctgtccgatacaatagccactagctacatgtggcttttgagtacttaattatgacttttacaattagctagtcagtttctacaaataagtcagttgagagtctgatgaggattgtgttaaatctgcaggtcactttggggagtattaccatcttaacaatattaaggcttccaatccatgaacatggtatgttttcccatttatttagatcttattctgtttttcagcaatgttttatagttgccagaatataaattttgtactttttctgttaaatttatttccaagtattttatgtttacattgatggaattgttttaaatttcgttttcagattgtttattgcacatgtatagaaataaaatctatttttgtatattgatcttgtatcctgcaactttgctggactcatttttttacttctaatagtcttccatcaattctgtaggattttctacgtacaagctcatgtcatctgctctgaaaaaataaagtaaaaatagttttacttcctcctttccaatatgggtgcctttttttcttttaaaaattatttccctgagttttccaagatgaatttcatttccttttcttggttaatttccctggatagagcttctagcacaatgttgaatagaggtagtgagagcagacatccttgttttgttcctaattttagggggcaagcatctaatgttttatcatcaagtatagtgttgtagacttttaaaaatattacattaaattattattcatctttctttcttagagctgagggtcttgctgtgttggccaggctggtctcaaactcctgggctcaagtaatcctcctgcctcagcctcctgagttgctgggatttcagatatgagccactatgcctagcatattcatctttattactgaattttttttgcaaccccttaaatttctgtggttgaggtgagaccctcacttactttacatcagttttggccctgtggttatagaagatttgggggaaattgtaaaaagtcctaaagattctgaattcagattgttttgcaagtgtctttatattctatatctgttttaaagaaaccaaatctgtaactgacagttcatgcattcatcatggtagtgaggttaattttaagatgccatgccaagatttaattaacaggcatttgtgcaaatcaacagccttagttctatatcaaatgataaagtaaaccatatcctactttaacttttttgatctattgttgaactgtgggtctgaatgtgttccataagatggtttctactgtggctatgaagattgtagaaaagatagagctacctacacttctctttatgtcttctgtcattttcttaaatttgctaaaaatatttgttatagatccagaaaaactgttacctttattcagacctgcatgctgtactcccttgaatcccttgcacagtaaaagtagagtgacctaatttagtaacatggtgatttctgctggaaagatttgtatctgaaatactgctttctaaggagttctgactggtgatttgccagttttttttttttttaccatatttgaaaatcacttactaaaaagagttaaaactctagtacattgactatatgaattttatcagaacaggttttaattgttttacatttaattgacttgtggcttttgatcgaataggatgttaaacagtatttcatctatttagagggaaatactttgtctttttaatgtaatattgaggaatatgataaactcctaaggaggcagtttataatttaatacagtactcacaatatttctaagactgattgtgatgtataaatcagagtggaccttaaagagggttcttaattcatattagcctatgtcattttagcaaaagattaatacttattttttaagaaatgtgataataaacttgtcattgataaagaaatacttttatgtcttcttgttgttatttagatgttgcttagtgtttgagcacggactttagatttcagctatagattcacttaaaaaccagaattcttcagcttaaagacctcttgcacaaagaaagcaaaatgatgtttttttttcttttactatactagaagaatatcatgttataaaaatgctgcttgcatctagatttcaagagttacttggaacttaataatattttattatattagagatataggcatttttgttttaagatagtttgtgaatctcattttgcttggataaacagctttctgataaggtgatcactgtaatataaaagcacttaagaattttaccctttggaacatggagggcaaattgaattatagcttgttagcatggagatgaggaaaaaaagaaacaacctgcacctgcttgcttaaacgcatcccaaattgaaagctttaatacatgaagccacttagttttccctataaaatgctcagcagttttttatcttcactcaatttatctatagatttccacttaaaatcttttgtaagcgtttttcttctttctccttcattgtctttttcttgtttgtaatttattgtgggagaaataggattttccatggtaactaggaccctgagaggtgttttatattctgtggtttcagattttctcttggtttctctctctctctctctctctctctctctctctctctctctctctcctctctctctctctctctctctctcctctcctctctctctctctctctctcacacacacacacacacacacacacacacacacaaattgagattggacatcttttcttatgcttattctttttattgccattcttctgtgaaaggcctgttgaaatatttgctcacaggattgctcacctttgtttcattatgttttcttttttttattattatactttaagttttagggtacacgtgcacaacgtgcaggtttattacatatgtatgcatgtgccatgttggtgtgctgcacccattaactcttcatttaacattaggtatatctcctaatgctatccctcccacctcgccccaccccacaacaggccccagtgtgtgatgttccccttcctgtgtccatgtgttctcattgttcaattcccacctatgagtgagaacattcggtgtttggttttttgtccttgcaatagtttgctgagaatgatggtttccagtttcatccatgttcctacaaaggacatgaactcatcattttttatggctgcatagtattccgtggtgtatatgtgccacattttcttaatccagtctatcattgttggacatttgggttggttccaagtctttgctattgtgaatagtgctgcaataaatatacgtgtgcatgcgtctttatagcagcatgttttataatcctttgggtatatacccagtaatgggatggctgggtcaaatggtatttctgttatgtttttagaatattttatgtataatgaatattaaacatttgcctatgttgcacatctcctggcttccaatctcacacccccatgcctcttcttaattatgtttatggtgttttgtaccatatacaattgcaactttttgtaaccagcaaacttaaacattattttctttatgggctctaagttttgtgtcaacccttagaaagattttgtgactcattaaaaattgttttaaaaaattctcctttatctgtcttctagttttttttttttcttgagatggcgtcttgctctgtcggcctgactggcgtgcagtggtacgatcttggctcactgcaacctccacctcttgggttcaagcaattcttctgcctcagcctcctgagtagctgcgattacaggtgcgcccagctaattttttgtattttgttttttttttagtagagacggggtttcaccatgttggccaggctggtctcaaactcctgacctcatgatctgcccacctcggcctcccaaagtgctgggattacaggcgtgagccactgtgcccggcctctactacttttttttttttttttgagacggagtcttgctctgtcgcccaggctggagtgcagtggcgcatctccgctcactgcaagctctgcctcccagattcatgccattctcctgcctcagcctcccgcctagctgggactataggcgcctgccaccacgcctggctaattttttgtatttttttttttttttagtagagacggggtttcactgtgttagccaggatggtctcgatctcctgaccttcgtgatccgcccgcctcagcctcccaaagtgctgggattacaggcgtgagccaccgcacccggccctctacttcttttacgattttttcatattgcaatatttaatctatctgaaacatatggtatagataggattttaatctcctctccccagcatagccagtttcccctaaagtgttttttgagaagttttatcttcctactgatttcaattgccacattcatgatatagttaataaccatatgtattttgatctatttttagattcgactctgttcattcctctgtctgttcccacactagtaccacactgtaatagttactatatatattttttactacattttaatatccactggaaaaagtttccttgcctctgcctccacaaccaccctccccaaacaccagccatgatgtttattgcttatttttcttttttaagcttattggacaatttttatgtgttcagttctcccaatgaactacagattcaacgtacaaaatgtccaccttctccacaaaaaatctgactcttttagggaatttgattgtaattgtattgaatttgtgtattcaatttgagggaagtttgcatctttatgattttgagtttgtctgttcctggatatggtgtgtgtgtgtgtgtatgtgcgcgtgagtgtgtgtgtttccatttattcagggtcatttattcttttatgtgcttccataaaattttatttttctttttatttatttatttattactttttttgagatgaagtctcactctgtcgcccaggctggagtgcagtggtgcaatctcggctcactgcaagctctgcctcccgggttcatgccattctcctgcctcggcctcctgagtagctgggactacaggtgcccgccaccacgcccggccaatttttttgtattttcagtagatacggggtttcaccaggttagccaggatggtcttgatctcctgacctcgtgatctgcccacctcagcctcccaaagtgctgggattacaggtgtgagccaccgtacccggccataaattttatttttcatatgtctttcatacatcttttaaagcacatttgtaagttttttttttttttacaaactttgctgctctcaggtaggtggtattttttccagtacttatagaatatgatattggtggaatataagaaatccttgttttcatggacctgacattcttgtaatgggcctctcattgtgctaatttttcagttgatacttttgcattttccataaaccttatgttacctataaatcattaatttttagacaatcatttatgatcctgcagcagcaacattcctcaggaacttgttagcaatgcagattctctagaccgatcccacaccaactgaaggagaaactctttccagcaatttgtgcttcacatgtctccaaactctgatgtatgctcaagtttggagaccactgatgtaaataataattttatgctgtcttgctcatattttcatttctcacattttttaaattgcaagatgtgtgtgtatcagggctcagtggattacatagaatgagcactgactgaataggctgagacaaatcgttaacatccatgggtaagatgggaggggaatgatgagacatgaattattccttaatttcttaattccttaattaggtgaataaggaaaaagtaaatcagagagagagagagagaaggaaagaaagaaggaaattaagtatacaatttagggtgaggattttagtggttgacagagggaagtctgattcaaagatcactcctatagataagtaagaattgtaacattatgaaattgaaagaaataaagacagctaagcctaagcctggcatttgatacttaatgaatgtttgtaagatgaagttcagtctttgccatatgagggtcaccaccattagaaaatcatatagaattgcattaatacaaggataatactttcaatattggcaaaaaagccaattgcaatgatgagtcagatgataccatgagccaacaatatacctcaaaggcattcctaaagcctattatgaatgacaacatgagaagggactaccaagggatcttgtcaggaaagaaggaggccaggtgtggtggcttatgcccataatcccaacactttgggaggccgagacaggaggactgcttgaggccaagagtttgagacaagcctgagcaatatagtgagactctcctgtctaaaaagaaaaaaagaaagaaagaaaagacgggaggaatgatattaagcagtggaactgcatggtgtatggtgtatacctatagccaacatgaagtacaatgatagtgaccacatggtggtgacatgggcagattgcttcagtgactatagaagggaagctgaaattgttgagaagagtgtgtcagccactctggcacttggccaggaaaagggagaaacctaagaaacatgggaatccagtctttttggtaggagtttagacctaaaagtagctgtgaacatacctctctggaccccctagttgtagcataagatgctggtcaaggggaaaccaggcaggctgatcatgtacttaaaatgagcgttctgaaataggctttagctgcaacctttagtatagtgcaactgttattttgttagggtgcgtgtgtgggagcataccagatagacctatcaatttttagatttactgtagtgaagaatcaccactcaatgcaacagttagtgctcaggtattttaggataagacctctttagtgccacaggtgggagaggagaataagctaaatgattctatgatctaacactctgggacatttaaaaaaatcaacttttgtctaacaaactattttttaaagaacacaattctgttaaacttcagattttgcattttcaagatgattttgaatttttgtaatgctgctatatataatttaatttagaggagtgcaattatgtgcagtttttctagattttgcggttttttgattttgtcgtgtttagcatttttcactaatcctttctgtcagttttcttttcttaccacagtacttatcaaaattttatttgaagacagagtactagagaaactcctaaaatttcttttatatagcatcagtttaattcataagtgagacttaccttatgtagtgtgaaattggctaaggatatctcaaatctgattattttaaagctattagtttttggacagagtaggaaagagtgatacagtgggttttaattaaacgctaggtcataaactggaatctttatttgaaatattatctaagataggtgcttgagaaatattagatttgtgaattacttaaatacttatgaataaaattgcttgaacttatgcaagatatctcaactatcataagcagttttgtcagttttgtttctggtgagctatattgaatattttaagggcaaaactacaattaggtcgttggcaggtatgtgctctgagtaatgattagtttcccttttattcatgagggtgtcatggccaggggaaagtgtgcatttttaattacaatacttgtctcgttatatttttgttctgtctggttttatttctttgaaagctctttaaaaaaaatgttggcctttctatgtcatatcccgtctgcacatctacatagtcccgacttcagggcagaaataatattttctactttttttgtttcttctttattagaaaattccaaacatgcagaaaagtacaatataacagttgcccatgtagccaccatgtagctgtgtaaaacctcaaaattttgccatttttgttttagatcctcaacaaaaaaagatacaggtgaagctcctagagtatccttccacaattgcattttcctactatcctctcctgggggaactactgtccaaaatttggtatttatcatttcccttattatttttgtcctttttctatatctgtgtgtatgtgtgtgtgagtgtgtatgtatatgtgtgtacatatgtgtacttgtttacttcttcagtttacatttttgtctaatgtaatgctattcagatttacctgctctagtatctcctattatgaaaacaaaataaaacaaaacattaactacttgtacattatgtctcatccaactgccacccatttctctactctctattaaaggaacactccttgtaagagttgtgtacttatttcctctctcccttctaattcttaaactcatactaatcagctcatctccattactccacacaacccagtcttacttaacaaggtctccagttgcctctctgtcactacactaagttgtcatttctcacttccttacttaatctctcagcaacatctgacacacttgcttactcttttcttcatataacaccttattttgtcttctgggttaccacaccttcctggtttcccttcgagcccacggcctctccttactcttttttaccagatcctttttgtctttttatttcaaaatcaattgagcaaaaaaaatacaggattaaaagtaaacatctctcccatctcatattccttctcacaaataaaggctataaacaggctttatgtgttgtgcatgtgcatgcacatgtgtgtgaattcataggtgaaaacagtgcctcaattaaaatagcatttatttgtttcctgtttctattatggttggtgcgaaagtaattgcggtttttgtcattaaaagtaattgcagttttaatggcaaaaactgcaatagctttcacaccaacctaatattggttttatatgtgcttcttgcttatattatttccttattttaccattatatgttattgttttcactaatttgtgtaagttaaaattattagccctttgttgcctgtcatgtgtgttatgaattatttttcctagtttatcagttgcctgagggccttggcatatttgaagtacagagttttaatttttttctatgatcagattgaatagtctgttatgatttctgatatttgggtgctgcttgccttcttcactgcatgattataaataatttcacttaggttttcttttggtactctttcagcttcattttgttacctttaaattttgatccttctggaatgtatttcagggcaacaagtgaaatagtggataacctctgctttttaaaaaaaataaacacaaccaaatggctacccagttgtcctgaaatcacttattcaatcatccccccttctcttacttgtttgaaaggccatctttaccccagagtaactccctgctgtatttgcattcctcacaagatcttgaaataatttatttatttttgttttgtttttcaagccactgcagtaaagttctccccactgatattgaaactgctcttggtaaaggtcaccactcatattataattgttaaatcaagtagatgtatcttacttggtcttgaatttgttgaatgctgttgaactactcttcctttttagcttttatctcacaattctcatagtttccctcctaccgttctctctgttttccttactaatttgtcttcttccatttctttgggattccaccttctcatggggaatatattctttttctgctttttatttatttataatttttgtgggcacatagtaggtgtatatatttatgggatacatgagctgtttagatacagacatgtaattggaaataagcacatcatggagaatggggtgtccatcccctcaagcatttatcctttgagttacaagcaatctaattatactctttaagttattttaaaatgtacaactaagttgttattaactatagttgctcctgttgtgctatcaaataatagatcttatttattctatctaactgtagttttgtactcattaaccatccccacttctccctacccagctacccttcccagcctctggtagccatcattctaccatctgtctccatgagttcaatcattttaatttttagctcccacaaataagtgagaacatgtgaagtttatctttctgtgcctggcttatttcacttaacacaatgtcctccagttccatccatgttgttgcaattgacaagatcacattctttttgtagttaaatagtactccattgtgtatatgtactacatcttctttatccattcatctgttgatggacacttaggttgcttccaaatcttggctattgaatagtgctgcaataaacatgggattgcagatacctctttgatacatagattttctttctttggggtttgtaattagcagtgggattgctggatcatatggtagctctatttttagtttgttgaggaattgccaaactgttctccatagtagtggtactaatttacgttccaccaacagtggacaagggtttccttttatctacatccttgccaacattagttattgcctgtcttttggataaaagccattttaactgagatgagatgatatctcagtgtagttttatttttatttttattttttggagacagagtctcactctgctgcccaagctggagtgcagtggctcaatctcagctcactgcaatctctgcctcccgggttcaagcaattctcttgtcagcttcctgagtagctgagattacaggcatgcaccaccacgcccatctactttttttgtgtgtacttttagtagacatggattttcatcatgttggccagctggcctcaaactcctcacctcaagtggtccactagcctcagcctcccaaagtgctgggattacaggcgtgaaccatcatgtctggccctcagtgtagttttgatttgcatttctctaatgatcaatgatatcagccacctttttattggcctgtttgccatatgtatgtcttcttttgagaaatgtctattcagatagtttgcccatttctttttctttctttttttttttttttttgatggagtcttgctctgtcgcctaggctggagtgcagtggcgcgatcttggttcactgcaagctccacctcccaggttcacgccattctcctgcctcagcctccctagtaactgagactacaggcgcctgccaccatgcccggctaatttttttgtatttttagtagagacagggtttcactgtgttagccaggatggtctcgatctcctgaccttgtgatctgcctgccttggcctctcaaagtgctgggattacaggcatgagccaccacacccagcctgttttgcccatttcttaattggattattagaattttttctatagagttgctgagctccttacatattttggttattaatcacttgtcagatggatggtttacatgtgggaaaaaatagatgcaaattatccatctatcgttgtctcttcattttgttgattgttttctttgctgtgtagaaactttttaacttgatgtgatcccatttgtccatttttgctttggttgtctgtgcttatcaggtattgctcaagaaatctttgcctagaccaatattctggagtctttccccaatgttttcttttagaagtttcatagtttgaggtcttagatttatgtctttaatccattttgatttgatgtttctatatggtgagagataggggtctactttcattcttctgcatatggatacccagttttctcagcatgatttattgaagagactgtcctttccctaatgcatattcttggcacctttgtaaaaaatgagttcattgaagatgtatggatttatttctgggttctctattctgttccattggtctatgtgtcttttcttattccagcaccatgctgttttggttactgtagctctagagtataatttgaggtgaggtaatgtgattcttctgattttcctttttttttttttttcctcagagtaactttggcaattctggtcttttgtggttcttattaatttttggattattatttctatttctgtgaagaatgtcattggtattttgataggggttacattgaatctgtaaatagcattgggtagtatggacattttagcaatattgattcctccaatccatgaagatgaaatatctttccattttgttgtgtccacttcaatttttcatcagtgttttatagttttcattgtagaggtctttaacatctttggttaattcttaggtattttcctttatgtgtggctattataaatgggattactttcttggtttctttttcagattgttcacttttgacatatagaaatgctactgattttttatgttgattttgtatcctgcagctttactgaatttatcagttctaatagtttttgggtggagcctttaggtttctccaaatataagatcatgttatctgcagtcaaggatagtttgatttcttcctttccattttgtaagcctttatttctttctcttgtctggttgctctatctaggacttcctgtactatgttgaataacaatggtgaaagtgggcatccatattttgttccagatcttagaagaaaggctttcagttttttcccattcaatatgatactagctgtgggtctgacataaacagcctttattgtggtgaggtgtattccttttatacccaggtttttgagggttttctttttatcatgaagcgatgttgaattttatcaaatactttttcattatcaattgaaatgatcataaggtttttgtccttccttctattgatattatataccacattgattgatttatgtatgttgaaccatccttgcatccctggggcaaaacccatttgatcttgatgaatggtctttttaatgtgttgttgaattcagtttgctaatattttgtggaggatttttgcatcaatgttcatcagatatattggcctatagttttctttctgtgatgtgtctttgtttggttttggtatcagggcaatactggcctggtagaatgagttttgaagtattcattcctcctccattatttggaatagtttgagtaggattggcattatttcttctggaaaggtttggtaaaattcatcagtgaagccatctgatcctgtactttcctgtgctggagacactttattacagttgcaatctcattacttgttattggtctgttcaggttttggattttttcatgggtcagtgtcactaggttgtatatgtctataaatttattaatttattctcgattttccaatttattgtcatgtatttgctcatagtagccagtaatgatcctttgaatttctgcagtatcagttgtaatgtctcctttttcttctttgattttatttatttgggtcttttcttcatttttctgtctggctcagggtttgtcaattttgtttctcttttcaaaaaaccaacttttcattttgttgatcttttgtatttttttttttcatttcaatgtcatttatttctgctctgatctttatgatttcttttcttctactaagtttgggtttggtttgctttttttctatttctctaagatgcactgttaggttgtttattagaattttatatctttttgatgtaggcatttataactataaactctcctttaagtactgctttcactgtatcttataggttttgtatgttttgtttacattatcatttgtttcaagaattttttgaatttccttcttaatttctttttataaaatctgctgtgagagaacagcttctaaatttcttcattgacccactgatcattcaggagtgtatattttaattttcatgtgtttgtacagtttccaaaatttctcttgttattgatttctagttatattctattgtggtcagagaagatgcttgatgtaacttcaatttttttgaatgttttaatacttgttttgtggcccaacatatgacctgtccttgaaagtgatccatatgctgaggagaagaatgtgtattctgtgctggtggatgaaatgttctgtaaatttctattagttccatttgttctatagtgcagattaagtccaatgtttcttagttgatttttcagtctgggtgatgtgtccaatgctgaaaatgggttattaaagtctccagctatgattgtattggcatctattgctctctttaggtctaataatatttactctatatgcctaggtgctccagtgtcgggtgcatatatgtttacaattttatatcctctggctgacttgacccctttatcagtataaaatgccattttgtctctttatagtttttgtcttgaaatatgttttgtgatataaatatagctatcctggctctttttttggtttccatttgcatggaatatctttttccattcccttatttttgaactaagtatttctctacaggttatgtgtactttttgtaggcaacagatctttgggtcttgtttttgaaaaccattcagccaatctgtgtctttcgattgtaggatttagtcacgtagattcaatgttgtaaggacttcagccattttgttatttgttttctggttgttttatggtcttctcttcctcctttccttccctcctgtcttcctttagtgaaaataattttctctggttgtatatgttaattttttatatatctgatatatgttttttgatatgaggttaccatgagactttcaaataatatcttataactcattatttaaactgttgacggcttaatactgaatgtgtaaataatcaaacaaataagcaagagaaaaccagagaaaaccaataaaactctacactttaacttcttcccctagctttttaactttttgttgtctctttcttttctttttgagatagggtctcactctgtcatccaggctgtagtgcagtggtgtgatctcagctcactgtagcctcgagacctcctggccttaagtgatccacccacctcaacctccctagtagctgggactataggcatgcaccaccatgcctggctagtttttgtgttttttgtagagacagggttttgccatgttgcccagactggtcttgaactcctgggtgcaagtgatccacccaccttggtcccccaaagtactggggctacaggcatgagccattgtgcctggcctgatgtttctatttatatcttgttatactgtttatgctgtgaaaagttgtaattatatttcactgtgttataatattctgtggttttcagtgtgcttatcattaccagtaggttttgtaccttctgaagattttgtcttgctcaataatatccttttctttcagattgaggaactccctttagcatttcttctaggacagatctggtgttgatgaaattcctcagcttttgtttgtcaaggaaggtctttatttctccttcatgtttgaaagatatttttgccagatatactactctagtgtaaaagttttttgttttccttcaacactttaaatatgtcatgtcactctctcctggcctataaggtttccactgaaaagcctgctgacagatgtattggagctccattgtatgttatttgtttcttttctcttgctgctttaggatcctttctttgtccttgacctttgggagtttgataattaaatgccttgaggtggtcttctttgagctaaatctacttgatgttctgtaaccttcttatacttgaatattgatatctttctctaggtttgggaagttccctgttattatccctttgaataaactttctatcctcatttctctatctaccacttctttaatgccaataactcctagatttgcccttttgagactattttctagatattgtaagtatactttattcttttttattttttcttttgtctctctattttcaaataacctatattcaagctcattaattctttctcatgttttatcagttctactgttgagagactctgactcattcttcagtatgtcatttgtatttttcagctctcgtctgataggattctgaattctttctccgtgttatctttaatttcattgaggttcatcaaaacagctattttgaattctccatctgaaatgtgacatatccctgtctctctaagactggtctctggtacctcatttagtttgtttggtgaggtcatatttcctgggtggtctcaacgtttgtagattttcgttggtgtctgggcattgaagagttatgtatttattttaatctttgcagtgtggacttgtttttactcatccttcctgggaaggctttccaggtatttaaagggacatgggtgttgtgatctaagtctttggtcactgtggctatattttcattaatgggcatctcaaacctcgtaacgctgtggctcttgcaaactcttggagatactgccttggttgtttttgctaagatccagaagaattctatggattaccaggcagagacccttgttctcttcccctaatttcccccaaacaaatggagtctctctctctctcttttctgagttgtttagagctgagggagaggtgacaccagcacctctgtggcaaccaccactgggactgcactgggtcccacctgatgctagcacagccctgggttttgcccaaggctcatggtaaccacttcctggctactgcttatgttcattcaaggcccaagtgctctacaatcagcatgtggtgaatccagccaggcttgtgtccttcccttcagcatggtgagttctccctggccctgggtgtgtccagagatcctgtctgggagttaaagcctagagtcggaaaccttaggaatctacctggtgctctagtctgctgttactgagctggcactcaagttgcaagacaaagtcctccccacttttccccctcctttcctgaagcagaggagccactccttttggccatccttaccccagggctgtaatgagtactatctagctaccagtgatgttcactcaaggctcaagtgctcctcagtcagcttgtggtgaatgctgcctgtcctgagtctttctcttcagggcagtgggctcccctctggccagggcaggtccagaaataccgtccaggagtcaaggcctagaattggggactgtaggagcctgcttggtcctttaccccactgtggtctctccacatagctaacacatctaggaatgttctgggtcacatgtgaagccagcatggctctgagtctctcccaaaacccacagtgagtattgcctcactaccactgctgatttttcagggcccaagggccctttaatcagcagatgattaatcctgcttaggactgggtccttcccttcaaggcagcaggtttcctttttgctcagggtgtctgtagaaatgtcatctgggaactagggcctggaatgggggcttcagaactgtgcctgctgtcctagcctactgtaggtaagctagtatgcaagttgcaagacaaaatcatctttttcccttctgtcctcaagtggaaggaaggagtctctcctgtagctgtgaacggtgctgcctggggttatgggagggctgatgcaagcactcccttgggtgcaccagcttgtgtctcactgggtcatgtgcaccccacatccactggctttgagcccagcataacaccaggacttgcctaggaattgcagtcctagtggcctggactgccttctcactttatttagaatgccagagcgctttagcccatggtagcagggcttgatggaactcaggttctaatcattgggataagcaatttatctcttcctaggcctggtctaaatgctccctccatggtcgttggctgagtttttccccttgttgctctctactctgacagggtagcactgagttccaatggaaagtccccattactgcaatctctctcctctagtgcacagattctccctctgcacaatgtggccactgccaggggatggaggggtggtgatgtaggcgattaagggctgtatatcctacaatcttcagggcctttttccttaatttgatgttaaaacaaggtattgtgatcattcacctgatttttggttgttatgaaagttcttttttgtgtaaatagttgttcaatttcgtcttcctacaggagagatgatcacttgaggcttctattcagccatcttgctctgattgccttcacttgagtaacatttcccaatctcatcacttcacttgttacttaattggctaaatattcctacattgacacttctagttccaatctaaatctagatgtaatcttttcaattttctgttagacactgtttggtgtgtcctatggtacataaatgtgtgtacatcaaacaattgttctccttttttcaatatttttccttattctctacatgctacctcacttgatatcttcatcctcatcccagttatttaaacagattttgtgattttgtttgtgatctccttatccctgtaatacctattcatgatcttttagtcaatcagtcctagttcactctggctatcctcatagacattgtctgggctcttatctcagttcttgactgtagaagaactttcttaactgatctctagatatctagtctatctctcttccatccccatattggagctgtgctaattttcttttcttttttttaattactattatactttaagtttcagggtacatgtgcacaatgtgcaggttagttacatatgtatacatgtgccatgctggtgcactgcacccactaactcgtcatctagcattaggtgtatctcccaatgctatccctccccccttcccccaccccacaacagtccccagagtgtgatgttccccttcctgtgtccatgtgttctcattgttcaattcccacctatgagtgagaataagcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcgaatggtatttctagttctagatccctgaggaatcgccacactgacttccacaatggttgaactagtttacagtcccaccaacagtgtaaaagtgttcctatttctccacatcctctccagcacctgtggtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttttaggtttcctgttcactctgatggtagtttcttttgctgtgcagaagttctttagttgaattagatcccatttgtcaattttggcttttgttgccattgcttttggtgttttagacatgaagtccttgcccatgcctatgtcctgaatggtaatgcctatgttttcttctagggtttttatggttttgggtctaacatttaagtctttaatccattttgaattgatttttgtataaggtataaggaagggatccagtttcagctttctacatatggctagccagttttcccagcatcatttattaaatagggaatcctttccccatttcttgtttttctccggttagtcaaagatcagatagttgtagatatgcggcgttgtttctgagggctctgttctgttcattgatctatatctctgttttggtaccagcaccatgctgttttggtgactgtagccttgtagtatagtttgaagtcaggtagcatgatgcctccagctttgttcttttggcttgggattgccttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggactcctaggtattttattctctttgaagcagttgtgaatgggagttcactcatgatttggctctctgtttgtctgttgttggtgtataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaattgccctggccagaacttccaatactatgttgaataggagtggtgagagagggcatccctgtcttgtgcctgttttcaaaaggaatgcttccagtttttgcccattcagtatgatattggctgtgggtttgtcatagatagctcttattattttgagatatgtctcatcaatacctaatttattgagagtttttagcatgaagggttgttgaattttgtcaaaggccttttctgcatcttttgagataatcatgtggtttttgtctttggttctgtttatatgctggattacatttattgatttgcgtatattgaaccagccttgcatcccagggatgaagcccctttgatcatggtggataagctttttgatgtgctgctgggtttggtttgccagtattttattgaggatttttgcatcaatgttcatcaaggatattggtctaaaattctctttattggttgtgtctctgcccggctttggtatcataatgatgctggcctcataaaatgagttagggaggattccctctttttctattgattggaatagtttcagaaggaatggtaccagttcctccttgtacctctggtagaatccgactgtgaatccatctggtcctggactctttttggttggtaaaccattgattattgccacaattttagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttaacattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcattatgtacccagtagtcattcagtagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgagttcaattcctggatatccttgttaactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacagtgatgggtcttgactctttatccaatttgccagtctgtgtcttttaattggagcatttagcccatttacctttaaggttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagtgcttccttcaggatctgttttagggcaggcctggtggtgacaaaatctctcagcatttgcttgtctgtaaagtattttatttctccttcacttatgaagcttagtttggccggatatgaaattctgggttgaaaattcttttctttaagaatgtcgaatattggcccccactctcctggcttgtagagtttctgccgagagatctgctgttagtctgatgggcttccctttgagggtaacccgacctttctctctggctgcccttaacattttttccttcatttcaactttggtgaatgtgacaattatgtgtcttagagttgctcttcttgaggagtatctttgtggcgttctctgtatttcctgaatctgaatgttggcctgccttgctagattggggaagttctcctggataatatcctgcagagtgttttccaacttggttccattcccccccctcactttcaggtacaccagtcagacgcagatttggtcttttcacatagtcctacatttcttggaggctttgctcatttctttttattcttttttctctaaacttcccttctcacttcatttcattcatttcatcttccgtcgctgataccctttcttccatttgatcgcatcggctcctgaggcttctgcattcttcacgtagttctcaagccttggttttcagctccatcagctcctttaagcacttctctatattggttattctagttatacattcttctaaattgttttcaaagttttcaacttccttgcctttggtttgaatttcctcccttagctcggagtaatttgaccgtctgaagccttcttctctcagctcgtcaaagtcattctccgtccagctttgttccgttgctggtgaggaactgcgttcctttggaggaggagaggtgctctgctttttagagtttccagtttttctgctctgttttttccccatctttgtggttttatctacttttggtctttgatgatggtgatgtacagatgggcctgtggtgtggatgtcctttctgtttgttagttttccttctaacagacaggaccctcagctgcaggtctgttggagtacctggccctgtgaggtgtcaggctgcccctgctggggggtgcctcccagttaggctgcttgggggtcaggggtcagggacccacttgaagaggcagtctgcccgttctcagatctccagctgcgtgctgggagaaccactgttgtcttcaaagctgtcagacagggacatttaagtctgtagaggttactgctgtctttttgtttgtctgtgccctgcccccagaggtggagcctgcagaggcaggcaggtctccttgagctgtggtgggctccaaccagttcaagcttcctggctgctttgtttacctaagcaagcctgggcaatggtgggcgcccctcccccagcctcgctgccgccttgttgtttgatctcagactgctgtgcaagcaatcaggagactccgtgggcctaggaccctctgagccaggtgctggatataatctcctggtgcgctgttttttaagcccgtcggaaaagcgcagtattcgggtgggagtgatgcgattttctaggtgcggtctgtcacccctttctctgactaggaaagggaacaccctgaccccttgtgcttcctgagtgaggcaatgtcttgccctgcttcggctcgcgcacggtgcacgcagccactggcctgcacccactgactggcactccctagtgagatgaacccggtacctcagatggaaatgcagaaatcacctgtcttctgcgtcactcacgctgggagctgtagaccggagctgttcctattcggccatcttggctccctccgctaattttcaaatatatatttgtctatatatatgatctggctaaaaattttagttatatatattatatataactaaatatatatatataactaaatatatatacaactaaatatatatataactaaatatatatataactaaatatatatataactaatatatatataactaaatatatatataactaatatatatataactaaatatatatgtgtgtgtatatatatatatctaaatatatatatctatatatatatctaaatatatatatctatatatatatctaaatatatatatctatatatattccctggctaaaagttttagttaaagttaaatcccacataaacttgatcacatgtgtttacttctcccttcctaacttcatgaaaaagagagtaaggtaatggaaaaactcaataagacaaagagaacaggagtaggagcattgatagttgtaaggttcaaactaacttttacttattgcaatggaagtttcaacttgaatatctccttctacatgaacttctgagagaaaccaactaattcttcccataaaactcctaatattttaagacttggaggtacctggtctgtggaaggcaggaatgtgtcatgagattggatacatgagttatttgttgaaaatctttatgataagtggctgcagttccatatcctatcacctactccctgctcctcaggagaccaaatagtttattttctggagaatctgaataagaatatcccagactcagaaatccaggcacagtaggagggttggttgaaataagaagactgtgttattctgttttgtgctgctataacagagtacattataatttatatataacagattgatttacaatgagcagaaatttatttctcacagttctggaggctaggacgttcaagataaaagaggctggcatctgacaagggccttcttgctgtgtcatcccatggcagaagttggaagggcaaaaagaggcagagggagagagagaacacacaagaggaagatgaacttgaacttgtccttttataaggaacgcattcccatgataatggcattaatccttcatgagggtggtgcccccatggctaaacacctcctgttagaccccacctcccaacagtgttgcattgaggtcaagtttccaacacattcttttttgggggcacattcaaaccatagcagagattaagagaaaatttgcatacctaatttcaggacctgtatgtttcatcctagatgcaattagtgaaacagggcatgagttatttagttttacattatcagatttctagtagtaatctagatatagatttttcccttttcaacatcttctaaataattgtatagtctaaacataattaaaaaattttaacatctcaaattctctcatcactttaacatgttttagaaaaggtaaatcgaaggtcagttcatgtgagagtgtgtaaaatattaatttcatttaacctactcagtttctttacttgtaataacagaattataagcagaaaaatgattgtacaaataaacataaatgatgtcatttgatttatttgctttttagaattatgaaaacccaataaatagagttttttttcctcttctatttcttttccttaaattcaggggctggaagagggctgacgacaatgaagaatccctcctcctgcttgcttaattattttagatcttcacataacttcttttttctttttcttttcttttattattattattttttgagacagggtctcactctaccacccaggctggagtgcagttctgtgatcttggctcactgcaacctctgcctcttgggctcaagagatctttccacctcagccctctgagtagctgggtctacaggcacataccaccatgcccagctaatttttgtatttttatagagacggggtgttgtcatattgtccaggctggtctcaaactcctggactgaagcaatctgctcgccttggcatcccaaagtgctgggattataggcatcagccactgcacccagccaacataactttatgaataaactaaattgcgtattatgcatttttattttcccaatgtaataaattgattttattaacaagagatatttaagtaaaatttacattttgcttcccaatatatctgaaacgaatagaataaatacataaaatatattctaccttcccagtgttatacatcggcattactaaaatgtagatattttagatatagttgagtttaccaaaactcacctactcttttcctacaaaaataatcaccaaaacaaaaattcagtgcaggccaagaaaatatttctatccgctattttatgtctttcgaatttcaaagtactatacctttctagcttatatttttttgcaaccaattctaaaattgtgttccctgtttatagacttctcagaccccaagttcctgaggtaacatgggaatcagtgctgtctctatgtgtgtgtatctatgtggcatgtatttgcctcaactccccccttctaacttctcttgtctaacccaacttcatacagggtccttaggtcttctgattctcagtttattccaatttcctgtataaatagtccctcttgtctgcaggtggtatgttccaagacccccagtggatgcctgaaaacgtggagagtaccgaaccctatatatactatgtttttttgataactgagaccgctactaagtggctaggagacaagtggcatatatagcatggatacactgcacaaaaggatgatttacatcccaggtgaggtgcagcaggatagtgtgaaattttatcctgccactcagaatggtgtgcaatttaaaaacatgtgaattgtttattttgagaattctccgtttaatattttttgaactgcagaaggccaaaccatggataagggaggactactccacttggttgcttttccatggataatcattagttactgatttcacatgaaatttagtcaatagtatttagtgattcactattaaatttcatagatatttttactttcagttttttaaataagattcaatttcttaattttcttaagatgtaatatgaacattaagtacaggggcatacatttttcctttaattcaaccatgaaaagtataaaaatattataaaaacagaagttgaaaattccagtgttaatcttcatagtaaatattggcttcttttcctcctgaacaggtcattatccaacttttagaggtgatggatcatctgcatagaggggaattggttgctgcaatacttcgtaaccggtatatttatggaaatagtttaacttatataacgtctttcctatttatatacctaacatagcaggcattcaataaatatttgttgaatacttggtataaagtaagtatttactgtatgaatgagttagagaatgactaagtgacaaagaaattgaataaagaggatgttagtgacaatgtttcctgagataatgaaaaaatagagaatatatttagaaaatgtaattggtataaattatgagcacctggaatacaatcagtggagatatttatttgaatttttagttttaaaggcatatctgaataaatacaggtatccatagcttaagaatagaagtgccaacaacacatttttaaaaataggattgtcctgtgattgtatatatttatattatttaaaaatccagttaaaaccttttcagggagttactatgagatatttaaagcttcttctgacaaattaggattttaaatttattatttaaagaaaaatagccttgtttgcaggtgtgacagagtctgtcttattcccagtagcttgattgtacagtttggatgaaacatttggaatagtatgtttgagttgtctgtatcctggctctgatgcttactagtggtatagccttgggcaagtttcgtagtcattctatacctcaatttcctcacctatgaaatggtgttaataatagtacctacattgcagggttgttgtgaagattaaataagtgtgaaaggtggggcatgtatgaaagtgtgtgtgtgtgtgtgtgtgtgtatgtgtggagagagagaaaaaatagagagcgggtgtgagtgagtgagctgggcagatagtaagcagtatatatgagctagtatgagggaacttttaaaagttcatggaaaaaatggaaataaaagataaaaataaaaaacaactgtttcttaatataagctccacccaaatcaagttgcttttttaagtgttgataccagccatttaaagaactgagcgtcctgggaatttaaccatatcaatgatgtttcttttacattattaagtgaagaaaaatgggtgctctttaaagggtttttaagactaggaaacaaaaagaagtcagaaggagccaaattagtactgtaagatgggtgcttaatgatttcccatcaaaactctcacaaaattgcccttgtttgagaaatgagcagaagcattgttatggtgaagaaggactttctgctgaagctgtcctaggcatttttctggtaatattttggtaactttctcaaaacactctcataataaacagatgatatagtcctttggcccttctgaaaatcctcaagcaaaacgtcttgatcatcccaaaataactgttgttgtgacttttgcttgtgaccagtctgcttttgttttgactgggttacttctaccttttcctagccattgctttgattgtgcttgtcttcagaatcatactggtaaggccatgtttcatttcatgttacaattctttgaagaaatacttcaggatcttgatcctacttgtttaaaattttccattgaaagctcttttcttgtctgcagctgatctatgtgtaattgttttggtagccatcaagtggaaagtttgctcaacttgaatttttcagttggagttgtgtaagctgaaccaactgtggtatctatggtgttgggtatcatgtctgctgttattcgctggtcctctttaattagggcatgagcaagattaattttttccttgcaaattcatttggatcatctgctgctgagggcttcatctttaacatcatctcatccctttctaaaatgagttatccatttgtaaactgctgatttctttgggggcattgtccccataaacttttcataaagcatcaacgatttcatcattcttccacccaaactttgtgataaatttgatgtttgttcttgcttcagttttagcagaattcatgttgctttgatagaggctcttttcaaactgatgtcttatactcagtgcttcaaactgggtcctgttcaggcatttataacacattactatgagtttattttcatgcaaaaaaattgaaatccatgcatagtttttttcaaaatacacattttgcatgaactttttgaagatccctcatattattcaaatataaaagtgagattttaattattttgaaaatgtagtatttgtgtttttcaattccgaggtattttaaaatacaggcatgttgtaaaatgaacagaaaacgtaggaaaggttgaggtaggaagggaacatatataaagttactgttacttgacagataccatagaaggaattttccataataatccaattagagaaataacatgatgggtgcctgtttgttggaatgtatacagtagtccccctttatccatgcaggatacatttcaaggctccaaggttgcctgaaactgaggatagtaccgaatccaactgtcatcaatcagaacatatttctgctcatctcttctactcacaaatataaacattttccatcttaactaagcacttttcatacactgtggtcataacttttgcagtttgagtgtgacagcagaactagcacaagctgcttcttccttctccacaatttcaccaacagatttctttcttactgttgatctgagcaacctcagcatgtgttttttaaaaattaattttgttttaagttctgggatacatgtgcaggatgtgcaggtttcttatgtagttaaaacgtgtgttctggtggagggagaacatacttttgtaagtcaagaactttgaccctttcacttaaaggaaaccctttatggcttctctttgatatatccaagtcaccagtatcactattcttgcactatgggccattattaagttaaataagggttccgtgaacacaagcactaaatacctcagcagttgatctactaactgaactggctactaagtgactcatgggtgggtagcatttacggcaaggatgctggacaaagagataattcccgtcgtgggtggggtggagtgaagtaggatagtgtaagatttcatcatcttactcagaatgacacacaattgaaaacttataaattgtttattcctggagttttctatttgatattttctttagaatgtggttgaccatgggtaactgaaaccaggggaaagtgaaaccatgcataagcagggactactgtactatcatctgggctagggtggaatattcagcttaggggctgtaaaacagacttgctcacagatacagaaaataggggaatcatagcagggataatatgtggccatgttgggtgaaaacaggagtagatcaggggatgttgaatttatagctgcatgtatcagtagttccttctttattgttgctgtgtaatatttcattgtttaaatatgcaacaatttattctatctattttcctgttgatagtcatttaagttgcatccacatttggctataatgcataaaactgttattagaattcttgtataaaatttattttggccacatgcactcattttgtttggatttacagtatactagaagtggaactgctgggacatagagtaagctactgttgtttaacatttgtagaaactaccaaacgttttttgaaaatagttgtaccattttatactcccaccaataataagtgagaatctttactaacacttgatattgttagcttctttaattttagccattctgtgggtgtgtagtacttcctcattatggttttcactcttcattttcctcatgtgtaatgatatgaataggttttcttatgtttattagctatttggatatattttagaagcatatgttcaagtgttttggccatttaaaaatgggttattattttattttgattattaggaggttttagttcactctggatatataggtatttgtactgtgaatatttccttccagtccatggcttaccctcgaattctggtatttgtgtcttttgatgagcagtagttctttttaaaatgaagttcagtttatcatttttcttctgttatgcttggtgctttttgtatcttgcccaagaaatctttgctcttccaaatttgaggttttcttccaaaagttttacagttttagccctcacattataaatgcattcttgaccgcaaaccagagaagtgaatgtatggcctagattccacataagatctaagtgattaataagaccactttacagaagaaaagttctttgtacttttaattctaagctaatacctttgtaaatggcaaggtaactgaatgataacttgagctaaatctggcattgcagagagacctagtcttatggaccctagtttataacacaatgacttttgagtcttctcttgtaacctttcttataaataaagcccctttgaaagaaatataattctgattctaagtaatgtgatccagaacatagaaaataatgggaagttgcatagttcaaatgtcaaaacctgagcaaaacgttgcttgcatgcatatacaaattatgggtcagtttcaaattccaaatacagtaaaacataggaaaaggctcacatctggaatcacagcactttgggaggttgaggagggtggattatctgaggttaagcgtccaagaccagcctggccaacatggtgaaatcctgtctctactaaaaatacaaagaaaattagctaggcatggtggtgcacacctgtaattccagctatttgggaggctgaggcatgagaatcgcctgaacctgggaggcggaggttgcagtgagctgagatcgtgccactgccttccagcctgggtgacagagcaagactccgtcaaaaaagaaaaatggaatatatgaagggaataaactctttttgactaagaaagttttatcccagcatgagaatggtttaagatcgtgaaagttattcatagaatgcatagatgtaatgagaaccaaaagttaaaatccaaaggtgtttgaaaacaattacatgctccttttaagaatagaaaagagcccttaaaagacatgtaccctaaaacttaaagtataaaaaaaaaagattagtgacagaaacttgcacttataatatgaaaaaattatctctctgaaacaacaattcagcatcacacttaatggtaatatgtaagagttgttccttaagcagcaataaaataagaatgcccacaatcaacataatattgaatatatatctgtaaattctgtccaatgtcagtaaagaggcataattaatggaaggaagaagagaaaattaaccaattcctagaagataaatagtgctgggaaaactgtatatccacttgcaaaagaatgaaactggatccttatattacattgtacacagaaataaacgcaaaatggattacataccaaagtgtaaggcctgaaatcataaagcttctgaaagtaaacacaagggatcagagctatcaggaagagcttgacaaaaaagaaaagaaaacacaagggaaacactccttgatactggccttggcaatgatttttttggatatcaccccaaaagcttaggcaacagaaacaaaaataaacaagttgggactacataaaaatcttcttcatgggaaggaaaacaataaacaaaacgaaaaggcagcctacatattgggaggaaatatttgcaaaccatatatgtgatgagggttaatatcttaacataacttacataactcagtagaaaagaaacacaccaaataacacaacttaaaaatgagcaaaggacctgaatagatatattttaaaaaataatacataaaaatggccaacaggcatataaaaaggtgctcaacatcacatcatcagggagatgtaaatgaaaaccacgatgagatatcaccttgcacctattaggttggccattatcagaaagacaaatgatagcaagtgttggagaggatgtagagaagagaacccttacacactgttggtgggaatataaaatgatacagccattatggtaaacagtatagaagttcctcaaaaacctgaatacagaactaccatatgacccagtaatcccacttctgggtatatatgcaagagtaatggaattagcacttcctcgagatatctgtgctttcatgttcattgcaacattatacacaatagctaagatatggaaacaactttcaatggatgactggataaagaaattgtgacacacacacacaaatgggatattattcagtcttttaaaaaggagataatgcctagagaaaatttttacaatctacccatctgacaaagggctaatatccagaatctacaaagaacttaaacaaatttgcaagaaaaaatcaaccccatcaaaagtgggtgaaggatatgaacagacacttctcaaaagaagacatttatgcagccaacagacacatgaaaaaatgctcatcatcactggccaccagataaatacaaatcaaaaccacaatgagataccatctcacgccagttagaatggcgatcattaaagtcaggaaacaacaggtgctggagaggatgtggagaaataggaacacttttacactgttggtgggactgtaaactagttcaaccattgtggaagacagtgtggcgattcctcaaggatctagaaccagaaatgccatttgacccagccatcctattactgggtatatacccaaaggattataaatcatgctgctataaagacatgcacacgtatgtttattgcgacactattcacaatagcaaagacttggaaccaacccaaatgcccatcaatgatagactggattaagaaaatgtggcacatatacactatggaatactatgcagccataaaaaatgatgagttcatgtcctttgtagggacatggatgaagctggaaaccatcattctcagcaaactatcacaaggacagaaaaccaaacaccgcatgttctcactcataggtgggaattgaacaatgagaacacttggacacaggaaggggaacatcacacaccagggcctgtcgtggggtaagggtaggggggagggataacattaggagatatacctaatgtaaatgacgagttgatgggtgcagcaaaccaacatggcacatgtatacatatgtaactaacctgcacattgtgcacatgtaccctagaacttaaagtataataataaaaaaaaaggagataatgccatttacaacaacatggatgaacgtggaggacattatgctaaatgaaataaggcagatatcgaacaaaaaatactgtatttttttattattatactttaagttttagggtacatgtgcacaatgtgcaggttagttacatatgtatacatgtgccgtgctggtgcactgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttctgtccttgtgatagtttgctgagaatgatggtttctagcttcatccatgtccctacaaaggacataaactcatcatttttatggctgcatagtattccatggtgtatatgtgccacattttcttaatccagtctatcattgttagacatttgggttagttccaagtctttgctattgtgagtagtgccgcaataaacatacgtgtgcatgtgtctttatagcagcatgatctataatcctttgggtatatacccagtaatgggatggctgggtcaaatggtatttctagttctagatccctgaggaatcgccactctgacttccacaatggttgaactagtttacagtcccaccaacagtgtaaaagtgttcctatttctccacatcctctccagcacctgttgtttcctgactttttaatgatcgccattctaactggtgtgagatggtatcttactgtggttttgatttgcatttctctgatggccaaattgtctcagcccaaaatctccttaagctgatacgcaacttcagcaaagtctcaggatacaaaatcaatgtacaaaaatcacaagtattcttatacaccaacaacagacaaacaaagagccaaatcatgagtgaactccaattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatgaccatactgcccaaggtaatttacagtttcagtgccatccccatcaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgcctcatatctacaactatctgatctttgacaaacctgagaaaaacaagcaatggggaaaggattccctatttaataaatggtgctgggaaaactggctagccatatgtagaaagctgaaactggacctcttccttacaccttatacaaaaatcaattcaagatggattaaagacttaaacgttagacctaaaaccataaaaaccctagaaggaaacctaggcaataccattcagaacataggcatgggcaaggacttcatgtctaaaacaccaaaagcaatggcaacaaaagccaaaattgacaaatgggatctaattcaactaaagagcttctgcacagcaaaagaaactaccaccagagtgaacaggcaacctacaaaatgggagaaaattttttcaacctactcatctgacaaagggctaatatccagaatctacaatgagctcaaacaaatttacaagaaaaaaacaaacaaccccatcaaaaagtgggcgaaggatatgaacagacacttctcaaaagaagacatttatgcagccaaaaaacacatgaaaatactgtatttgtaaatgtcaaatagaaacacaggggcaggagtgggaagaaatgggaagaagaaggtcaaagcatgaaaatttgcagttaggtgaggtgaataagtctagagatgtaatctatggcatgaggacaatagttaataatgatatattctattctgaaaattttccaaggaagtagattttagatgttcttaccacacaaaaaggcaactctggaaggtgatggatatattaatttgtttaactatagtaatcatttcactctgtctatgtgtaccaaaacatcatattgtacactttaaatatatgcaataaaaatagaaagaaataaaaaggttaggcttgtatatctataaaagctaagtcttaaaaacaaccccttagtgctagaactaatgagttataaaaaatagttggatataaataaaaatttttaaaaacagtaccttttgtctgtatcagaaatcgccatttagaagatataatggcaaacaatcaatttataatagccgtaacaaaaatgtctaggatttatattatgaatatttaaaaattctgctcagagacaggaaagaagacattttaaaaatggacagttatacataccatggttcttgataaaagactgaatgctaagaagagatacattatttccaaattgtcctatacattctacataaatttaggaggatatttaaaaatttggcaaagcaaatcttcaataagttaatgaatatctgaaagaaatgtatctccattattagtacattgtctgctatgtagtaattgctcattaatttactaaataaaggactagtaaaaaatctatatttgttctgtttatgatgcaacaaatatttatggtgtaattggtaagaactaaacattgtcacgtgcaaaagcatgatgaaaagtgatgagttcttctactcattgaccttcttctgggggtgtggtgtggtcagataataaatatatatcacgaagaaaattgttatgaaaaattaataaggtaggtggaaatataaagagttaagagtgagcggaggtcagtgtagaagggcattaacttcttattagccttgcatgtgtttagtcttgtaatctaccatccatcatatattttaccctatatgaagttttattctagtgctttatgagctatagggagaagtcagccacatgtggtttgctttgatggaaacagtatacttatctgaacatcctcatgcatgcattatggtaatgtctaggaggacacgttgtggtgagagtcaccagtttgttgttgtggcggtattttctgattgcattcctggagctaatagcatttctgtaatgctctgacagagtttcagtcttccaaatgtagtctttcatagatgaaacacagtataaaatatcgtctggtatttccaacacaggagaaagagtgccaaacactgtacaatcatatttttaccattttaacaaatattattcaccacttactgggtagggtgctagggatatagcagtgaatgttaatacatggttttctgtgtagtgggaaatacacacaaataattgtgtttcttaagtgctgttgaaaggacatatggggtgctactgactgtgtataacacatatatacaccgggtcttgggagggtcaggacaggctttatgagtgaagtcatgtttcttctacttctctccatttccactctactaccaccatcttagttcaagctactctcatcttttgcctgacgtcctgcaataaccaattggttagttcatttttctctaggttctaattagagttctcttttcagaattcaaatctagccatgttgccttttcgctttcaaattattctatagctgtatcttaattttaggataacatccaatgttaatctcacattgcactactatgcatgaaggcatgaaaaagcatgatgcattcacagagctataatcaaaatcagatgattattaattataataataaggagcaaagtaagaaaaggctggagatgagttaggagagggaggtatggatcaagttaagaagcattttatgtttatgctaaagagtttacatacttcacagactgcagagatctactgaagcttacaaacagaagagtgatgtgatctgccttatactgctagaaagatcactttggtggctgtgtggattatttggggaaggaggacgggaaaattaggagaccagtgatcagtctattgtagcagtcaaagaaagaaatgaaaagagtctgaacaaaggtgatggcagtgggaatgaatgaaagggaatgcatttgtgaaatacttagggatgaattttacaatgtttgggaaccaactggtttcttcacactctaggcagaaggttcttttaaaattgttaatctgataatgtcacctagactgtcctttcctgtttatgactattaaaatcctacttgttcctcaagacccatactgaattccataccctacataaagcctcatctgatcaatccaatcacaagatcaggagagcttcttgcctctgaactactttaccactgcaatgaattttatcatgtttggttctgcattgaagtaatttgagcctttatttgcttatgcctaagggagccctttcagagagtgactggctgtatctaatgtatttttatatcctgtattgtacataatgcaagattttgcacatagtaagctttcagtaaatacctgtagaagttgtaccatttattaacaattactggatggtgattttattcagtaaaatggtttagagtagttttcttttgtttcccacagttaactcttacttatagttaagtaatttaatattaagtgacagtctttaagactgtaaagtaggctaactgaatttagtatagattctaggaataagcccagacttttgtactgacgtaatgtataatcatgtcttcatggtgtagaatgtcaagggaatacagggctgggaatcaggtcattccatgtttaaaaatatttagcctttactatttgtcaagtggtgtcctcatctgtcacatgtaagaattggaagatggaaatctttcttttcattttaaaagtctaaaattatatttttaagacgaagcacatagtacatgctaaagaaacacatatgtgattaacttcatataaaacaaatttaacaaggtgatcagccattggagataagtccttttattaatttatcataatttggttttctcactttcaatgaaggtatcttttctgtgttttttgaagattaaaaacttgtgagggtctggttttatcatgggtgaagtaagcgtggcaataattgtaagccaaatctttggctagaagatctagccaataaaaataataagagggtaacacatgaaattctgagaccagttactttttatacattggaattattttggtttaaaaattctgtaggttttggttatccactattattgtcataagatcttatggtagacgcacatgaaatttatcaccatatttgttcctataactgaagagttgcatgttttcatacaaaggatatgggcttgttagtaatgttgcatgttttatatatttgaaggaattttccaggtcatagaaagtatatctgttcttggggagaataattgctactccaatttcagtcatcctacctatcttgagtgttgctgttcatatttacattcttcctgtgcaatctcatctaccgcaattatttcagtccttgcctacatactaaagacctttcatttatagctcgagtctcaattttttctgagtcccagactaaaagttgtttattttctccctccacaattttttgtttgtttgtttggactctacaagtaatacatatttattacagaacacttagaaaaatagaaaattatatatatgcagggtaaataatcacataagatagcctctgttaacacctcgatgtattttcactctagtcttctgatacatttttaaatgtaactaaggttttacttattgaatatgatctagttatagtagtgtggttaagggtgaggctctgaagtctgccaaatataggtgtcattcaaactctgctacttactagctgtgtgaaatttggaaagtgtcttaactcctatgagtccatttcctcatctgtaaaataaagtgatatcactgtgtgggattgttctgtggattaaataaaatgtttgtaatatggttaagttcctgtcatatggtaaatgctcagtaaatggaagcgcttactgttttattatactatatatcatgtctgtacctccctgtttttcttattagattttgaatattttgacatcagtaaagacttgtagttataatagctgcatggcataagccattctgtggtacaaacaatgtcttaatattagatatttaggccaattccattttgggggtattgggggaatcagcccccaatatttcaatgtaggttcttttctattttccctaagtgtcagctggtctcagaaataaagagacagagtacaaagagaagaattttatagctgggccgctggaggcgaagtcacatatcgtcaggttctgtgatatccacttgagctgcaaaaccagcaagtttttgttagggattctaaaaggggagggggtgtatgaaaagggagtaagtcaaaaagatcacatgcttcaaagggcaataaaagatcacaaggcaaaggcaaaattagaatactgatgagggtctgtgtgccgctgtgcatgcattgtcttgataaacatcttaacaggaaacagtgttcaagagcagagaactggtctgactagaatttaccaggctggaatttcccaatcctagtaagcctgaaggcactgcaggagaccagggtgtatttcagtccttatctcaaacccataagacagacacttccagagcaaccatctatagacctaccctcaggaatgcatttcttccccagggtcccaattattaatattccttgctgggaaaagaattcagtgatatttctcctactcacacttccatctataggctctctgcaagaagaaaaatatggctctgttctgcccaaccctgtaggcagtcaggcctcatggttatcttcccttgttccctgaaaatcactgttattctgttctttcttagggtgcactgatttaatattgttcaaacacacatattttacaatcaatttgtacaatagtggtcctcaggtgacatacattctccgcttacgaagataacaggattaagagattaaagtaaagacaggcataagaaattataagagtattgattgaggaagtcacaaatgtccatgaaatcttcacaatttatgttcagagattgcagtaaagacaggtgtaagaaattataaaagtattaattttgggaattgataaatgtccatgaaatcttcacaatttatgttctgcctcggctccagccggtctctccgttcggggtctctgacttcctgcaacatgggggtattagttgtagtagtgccttccatatctgttataatttatcttttttccttctatttattgatttttgctctatactgtgtcaaatcctctctttactccctttaatgtacattttgtttgtcacattggtttagtttcctttagtttcctcgaccaacgtaatttatatctttcctcatcttatcttacttggctttctcttcctggctcattgaagtcatgtttccttattcaataaatagtgtttttcaatatatttccattgctgctttccatgctagttgtttttgtttttgtctgttcattctcaaaggaagaaagattccctgaaaggcctttgtactgttgtttaaaatgttttttgttcatggtctttatgtggctgactcttgttgtctagatctttacttaaatatcctctcctctgagaggtttcctttgaccatccaatctaaagtggccacctgtatactgtctattgtcacaccatcccaatttaattctctccataagactcatcattccaactattagatattttccttctttatttattttctatcccctttcactggaatagaagctccaagaggccaggcatcttgttcaacttgtttactgctttaatcgcagcacctacaaccatttcttacagacaagttactcaataaatatttgctgaatgaatgaataaaggaattaaccatttcccctctgtctgtgctcttgtgcactaatcccaccgttttctctgatttttatccatgagtcaatactaatagaaataaacgattgaataaataagtagggtagaagagacaagtcttccttacagaagaattccatattttatttgtgaatgtttgtttgtatatataccttctttagaggctggaactttattctccttccactggtgttaatttaatgattcacttacaaagaaaagaatgtggaatggaaaaaaaaatggtaactttatagtgaagaaatctgacaaatactaccagcagtagacagaatacccccgccccctgcccccgcccccgcccaggatggccacattttaatccccagaacctgtgactatgacactgttcatggcaaagtggacttgcagatgtgattaagttaaggtctatgagatgaggagattatcctggaccgttcaggcaggcccattgcaatcacaaggatccttataaaagggacacaggtgcgagtcaggaaaaggagatgtgatgatgggtccagaggttggagtgatgctctttgaagatataggaaggtgccacaagccaagaatgcaggtagcctctagaatctggggaaaaaaaataacaacaacaagaaaaccatctctcccctgaagctttgccaatagttaatttttgatttctgacctccagagctgtaagatcatcaactagggttgtttaaagccaccatttgtgatcatttgtcacagtggaaataagttagtatgccttattttcagagtctggcacaaaggcttcctaatatataccaggagctgtaatttctgacttgatataagcacaaagaggaattgatggtagtggtggtcagaaaggggcacacagtaaaaggtactagaactctggctgctttaaaaagcaacaacattgccaggtctcagtttcagtgctggcactggttttcctgactctgtctacaagatatttaacagtaagttgggcaaggtaggatcagaagtaactagctatttgttatttaaaattgaatattcaaatatttatctatatttttcttatccaattgtataatttatgctcattgagaagtatttggaaaaattataggaaagtataatcccactgcactgaaagcgctgttaatattttggatctcataaatacaaatgtttattcaacacaaagattccccagtattgtaaacatgacatatccaatgtccaatcccatgtaatcttagccctgagtacctgccttgtcatctatattcttggtattgtttgatgacaccaccattcactcaggtgtctgactcagaaactcgggcatcatcctggaccctttctcatccttcacactcagttagtctctaagtccacttctccttcccaattatttctccaattcactccccctgctgttttatccttattatcacttccttagatttggcccacataatttgtcagctagatcattaaaatatccttctaatctgttttttttttttgcttctagtcttagccctccccttctcccctgacagtttctctctctctttgcagccataatgatctttctgaaatgtaaatatggtcatattgttttcttgtttagatttcttcagtggctgccagtgtggcaaggtctcttatatggctcctgtctacctcaccaggcttttctcctgcacagagcatgcattgcagccttccccaacactggaagatgacccgttccctcatattgccacccttctttctggaatgctttctctcatatgttgggcctaacccattcctgtttatcattcaggacctctctgtgaaactttcactgaaatatatgccatgcctcttccaagcagaattaggtgtccttttcttatttatttatttatttatttatttattttgagacagtgtctcactctgtcacccaggctggagtacagtggtgcaatcatggctcactgcagccttgacttcccaggctcaggtgattctcccacctcagcctcctgagtagctgggacgacaggcgtgtgccaccatgcctggctaatttttgtattttttttagaaatggggttttgccgtgttgcccaggctggtcttcaactcctgggctcaagtgattcacccacctcagcctcccaaagtactgggattacaggcgtgagccaccacatgtggccaagtatccctttctaatggctcccctagcattgactctttttttttttaaattatattttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctaattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattaccattctaactggtgtgagatggtatctcatagtggttttgatttgcatttctctgatggccagtgatgatgagcattttttcattgttttttggctgcataaatgtcttcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagtttatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattcaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaatagcattgactcttatattttggtgttgttaggagagattgaagtcccagtactcatagtagttgtattggcaagagtcattataatagctaacacttaaatagcgttactttgtactaggtacaaaacctttatgcatattaatttatgttattctcataataactttatgaagtagatactcatcattattattcccattttacaaacaaggactttgaggcacagagagattaagtaaattgtctaaggccacacagtaaataagcatggatccagggttcaaatgcaggaagtctagctccagagtctttgcatttagccatatgccagtctttttccttccctggaatgcaaactccctgaggacaagggttttgcctgtcctgtatcacctctcctgtgtctcattacctaaaactaattcatggcagtaataaatacttctcatgatgatctttttagagagtgcaggaagtgaatgtagaggaatgtgtcctcctgtctcttcctagcagaattaggtgtccctttcttacagctcccatagtattagatcttatttctgtggtgtctgtagtagatattaaagttccaatactagtagtacattggttgtattggcaagagtcattgtaatagccacctatggcgtttaccctaaggccaagctagttctgcttattttgggtgtgcatacatttacgctgataggttaagtactattaatgagttggaagcctggaagttgataaaggtaattttttcttttaacagatgttcacttccctcctttttcagtcttttattttttccccttttcatcttcccagcaaacacagttacaaggtgagcgttagaaagattatgtaaaattttcaaaggctcctgaacaacagttgtgtaatgttctattttgggttacatgtgaccaggaatatggacccatgaaataattcagagccttaatgtggatgcttctaaaaatatatagccaaaggacaaagttttcctttgtctttctggttatcagtgctgtgtgatattttgaccccttccctccattcgacacttggttttctttgtaccattgctttgtttcagattaaaatgaaaagaaaaagattaataccttttttccctggaagatctaccttttcattggattatagtttccatgcctgtctttgggacttattaatagctatggcaatttaaaggctttgtgatccacagataggcatactatgattctcttctaagagtccttaatccaccattgagagaagggcaatgtgtcctcctcccttcctgaggccctctgtatccatggtgtgttatgaaatgcatgatcctgaaggtaaagatgttttcctatatcagcacagcacgacatagctgatatagatatgagctatagatagctagaataaaatcctctagtgacctttgcagtctgttttaggggaaacaaacaacagaagcagcagagtgaatccaaattaaatttaatgttgtttttgacaggaagagctgtgcctggatgtagacagtgtcatttctttttccctggcacattattgaaaatactaatatataactttgtccaaatttggctgagatcagccattgtccagggctggcaggtctctctctctttttttttttttttttttttttgacagggtctccttctgttgcccaggctggagtgcagtggctcaagtgattctcccacctcagcctcctgaatagctgggactacgggtgcacaccaccacgcctggctaattttttctattttgtagagatggggtctcgctatgttcaccaggctggcttagaactcctggcccacaagcgatcctcccacttgggcctcccaaagtgctgggcttataggcatgagccacctcacctggctgactcctacttttgacttctcaaacttgggaggctactcaaatcagtgggaggtcacttagaacacacttttctctctagattccctgaagcagtgctaagtctaataaggcctctagggagcgataattatttgatctctggcccccaatgcctgccccttaatgttacatttatcctttactcatgtgatatgaaggggaaagtatattaatactagctttcaagtatactactatactccttcccatttccctttaagggtagtttatttacctgattgacctttctgttgtaaaggcagaatgtgatactgagtgtggagtttgaaaaccactgttttctggtcttgactctgccaacttaacagtggtaccagtttctttcttcttcctttttttttgtttttagaacagaaatactttctcctgtcttgaaaattaatgagataatatgcttgaatcactgtgttctccctgaaaggtggaccctgaataaattcaagctgatttttttgaaaggagctgaaggcagagttaagtctatttgtttttctaagaatagctgtggctccacaaataacatactacactttttttagagaggaaaagattgtagagatagtgttaaccctctcaaatgtaaaatgacagggaatctgatattcaaaggtgagatcatttgtccaagttcatgtagcaaggtaaagggccaagacatgagtacccagaggtttggtttttctttttttttttggcacaattaagagttatttttgcctcagaaatctgcatttcacatatttaatgcaaaataaaacccttctttggtaaaatacattctgttagactttcactattgtacagtccatgtgatgaacttagtatttatagttaaattagtatagcctttaccaccatttttgtatgtaaaatactttccctcttatctaaatagttccagtagtttcttttctgtgggttggatagaaagtaagtattgatctaataatcactgggtggtagggagatggataaaaatagaatggaaactcaacccagtctgttctaaactttgctatgtgtgcaattctgatgtattatatggccttaaacatatatttaatgacacatctacatccaggcacagcccttgctgttaacaacattgttaattcagttacacttcactctcctgcctcagttgttgttttccctagaaaagactgctaaaatcattacacaatttctttccagctatttttaggcccatgtcttagttttctattgctgctgtaacaaattaccataactccagtgccttaaaagaacactgatttgttaccttacagttctgccggtcattggcctaaaattaaaggactgtgttcctttctggaggctgtaggggaaaatccgtttccttgcctttcccagcgtccagaggccacctatgtgcctttgcttgtgtctctcttcctccatcttcgaagccagcagtgctgggtcaaatctttctcacatctcctcacttgaacctctgctgctttcctcttccaatgttgaggagcacaactgaataatccaggataatctccccatctcacagtctttaacttaatcacacctgcatcatctcttgctatgttaggcaacatatgcataggtcccaggaattaagatgtggacatctttggggacccattattctgcctaccacaccctatatctatgtcaactataccatactgtgagttttcttttggagggtattaagataatggctgttttcaagttaaaaaattattttcaaaaatatttatcacaaatctttgtcccagtgccctccatgcaagatagtttccagccattatgaataattgtttaatattttatatatacagtcatctgttgttatctgtggggcattggttccaggaccccctgagactgcaaaaattcacagatgctcaagtccctgataacattaatacattgtaatcaaagcccattcaaattttttccagttatcccaaaagtgttattgacagcagaaagctcaacttcagaattatgcattgcaattaattgtaatgtctttttagtgtttttctatctggaacactttctcagtcttctcttgactttcatgaccttgacacttttgaagattacaggccagttaatttgcagaatgtccctcagttttcattagtcttaattgttcctcatgatattattgaggttttgcttcttcagcaggaattgcacagacatgatcttctcattgcatcctatcaggtggcacctgatattgatttgtcccatacaacttgataacttgattaaggtggtatctgtcaggcctctccactgcaaggttactttttcttttatttctaattaatagtatttctgatgaggttgagaatactttgagactatacaaatatcttatcccttatcagactttcaatatttcatttattgcatcaatatggaatcatagtttcctattttattgttataatccttgatttattttgatgccaaatggtctcatatttgtatgatccccttcaagctggtttatgtatctttttcacaagtctcaatcatccttccttatgtttggagtttatcttgtactttctgagtgcttcattacattccagttcatcttgtactttctctgcattagctctggaatcaggcatcatggttccttttagtggataatcatatctcgaaccaaaatctgtttgctaggagtgctcattgctattccagtattgctgttccaaggcccttttgatggagagagctaggaaatatttgtatacatgtatatacacacataaatacatatacacatttatacatatatgtttatatctttatccattgaaaccatgagttctcaccaataccttcaattttaatccaataccatagagttcattctagttttctcccttttcatgatttcacttctcaattggtaacattaagaaacatgtctcttattatttgaccagttccttcacatgtagccaatgccctgttgacacacccttgcctccccgactctgacttccagaaatcctggctgtagctgccacctccctgcatgaataccctcattttgtttgcatttcaccgtaccacatcagtccaccattgatgtagtcttcctgcaatgacaccttcctcatcttctcaagccccacaaagagtctctatggtgccctcttcatagggcatgcctactttgcttggtcccactaatggattgaactgttcaggaaggggaagggaaggaacattttctgtactttgacgagttgttgccacctttttccttacaaccatggtaaggattactacccttgtactggatatttactttctattgttgtagttcctataaattctgctttcctgtagtcaacatccacattttaaaattataatttatgagatttttgcttgtcaatttgagtccttttcttcagattaatattaatttgtttactggtttattattattactggtttgatttttgcctaataaggtgttaaaaatgaggcaactggaaataagatgattttcacgtaattatggtataatttatagaaacactactgctttctcataatactttttgttatttttatgttcttcatttaattttttttcttttcactaactaaacaaacagcagtgataaatataaactatcagcaaagctggcttagaagaaagagtttaaaaaaaatgagacaggatctctatgttgtccaggctggttttgaactcctgacttcaagtgctcctcccaccttggccctccaaagtgttgggattacaggcttgagccactacgcctggccagagtgaagcctttcatttttgaatagaggtattttaaaaacctattgcacagtaacctattcctggttatttagggttaggaacatgagttcaaaaagtctgacctccttagcatggcatagaaagctcttcacattaggttctcagatttcctttctagcctcagtttctgctgcttctcattttggtactctgtgctattactgtaccacattattttcccttcgccaagtgtgccacattcttttgtatttctgtggtagtgtgcgattacccagaaggtagatcaagcacatgcttggaacaccaaacagacataggtaccaaacaatgaggaagaaaaagagtatttgatgtttcatgtcatcatcaaggaaattagatctttgttggacttccttacacttaattcataatttagaattatttatattttgaaatacatgtgagggagcaccatagccttttctgtaattaaggcccctgtacgttattttaggcccttctctgtgcctttgcttttgctggatcttagcactgtgaaccctgcctctgagagaattgcatgatattccatcccacagcattttatttatttatttatttatttatttatttatttatttatttatttattttcgagacagagtttcactcttgttgcccaggctggagtgcaatggtgcgatctcagctcaccgtaacctccccctcccaggttcaagcaattctcctgcttcagcctcccaagtagctggaattacaggcatgcagcaccacgcccggctaattttgtatttttagtagagactgggtttctccatgttgaggctggtctcgaactcctgacctcaggtgatccgcccacctcggcctcccaaagtgctgggattacaggtgtgagccaccgcgcctggcctccatcccatagcattttattgcacatctatcataacacttagcactttgtataacaatttttaaatcatctctcctgaccaaaccatgaagtccgtgaggaaaatgacatcttcccatctagccatctatttcgtgcatctaacccggtgatttaggcaaagtagagactcattaagtgttgttaaactgaataattattgtcttgtttatagatgcaggtggtagcttttatagcagagattgaattatgtctctttaactgttaccgcacttgattcattagtatctgttcggatagaatttgacatgtccaggcagtccagtttgttaatataacaaactgttcagagaattggcagtgttcagaaataagaaatctgaaaaatctgtaagattcatatgcaacacgatgatttactggaggctttttttttttttttttttgacggggtcttgctctcacccaggttggagtgcagtggcacgatcttggcttgcacaatcactgcaacctctgcctcccaggctcaagtgatcctcccacttcagcctcctgagtagctgagaccacaggcatgtgccaccatgcccagctaatttttcgtatttttggtagagacacggtttcatcatgttgctgaggctggtctcgaactccagagctccagcaatccacctgcctcagcctcccaaaatgctgggattacaggtgtgagccaccatacctgaccctactggtggctttttcttccatcttgtccagtgttctgacaatcaggatttagccttgtatactcatgttcattcaattgcattagttctttaaaaatcgtagaatcttttcagttagatttggattagagttgtaggtactttctgatttgttcactttaagcagttcaaggagaaaacaatgaaaaattttgttgttggatggatatcacattggctcttttgctgcttaaatatcatctatccatggcctgcaggagccatagaatatcttaactcgttggggtcctattacgatagtcctgccccagactacgaaaagtttccaaaggtcatcttttgagtttgaagccatctgagtagaaagttttctaatggcagtggttcccagatgccagttagttcatggaagctggtttgttatggatattgtcacaggtctgcagtgatgtatgagaaacaacagtgtagtgattatctaccagaaagctaactttattgattacaaaggaccatcctttattctgagattgttctttacactttttgcttgttcaaatgctcttttgtccttaatttaatgaaattaaatttacgatgttaatcaaggactgtatctgtatctttatatgaaacccttgagacaagatatgtttcagaacttacattctttttggattttagaaaggtagcagtctgtatatcctatattacataacagccccagcagggtttgaggtgacaccccataatcagttacagtaatgttactgcagtgaaatataagaatatttatactaagtgagagaaaaagcctgtgaatagcctcatgtcagttcaggtcaagcttgactgccagatgagttcatatcagttcagattttgctgccaaatgagttacaggcaagaaaaaattgatttccaagtgtttgaattttgaaattgtggataaggggttgccttttaaaatgtccttactttgtaaaataaagttgagtatcctatgtaggaccccaaaatgtttttgaaatttcattggtccacaaaatccaaaacttgggaaacagctcttgaaagctattgaagtgagtataacattactgttacactcatccctagccaataataattttcctctctattttgtttgcaaggaaatacattgctgttggttataatctttggatgttgtaaaaatctccaaatatacttttaatcaaagtagattgaaattaagtttatcttgtagcaattttaggacgctggggcaggagagaaggttgcagcctgaatccatccacaattcccagtgatggattaggattctgtgatagggatgggttctagcttgacaagtcctcccggctgcatttgtttggccaaatagattagtgaggagattggtctgttttgggtaagggcaatagtaaatacctatgtgcacttaggttaactgattaatctttggcatttgtagcttaggtttctatccatcagatggggttaacagttcccatctcacaagtatgaaatgagttaggagctatggaagtactttgacaatgaagatcacattagcatataaaataataatcttaaagaagaagttatgtagtatgaactaatagaatcaaaacaacacagctgcacaattcttgtcctagtaaatttgtctagaaagtagacttggtaaaacaattatttgacctaactgggctataatttggctcttgcttaaaaacagtatttctccgttctatgtgccagttatttatttattggccctcagcttcagattcaccatgtgttgcctgctctgtgaaaatggacctgaaccttttgttttctatttatttatttatttatttatttttaatagattttttaaattatactttaagttttagggtacatgtgcacaatgtgcaggtttgttgcatatgtatacatgtgccatgttggtgtgctgcacccattaactcgtcatttacattaggtatatatcctaatgctatccctcccccatctccccaccccccagcaggccctggtgtgtgatgttccccttcctgtgtccatgtgttctcattgttcaattcccacctatgagtgagaacatgcggtatttggttttatgtccttgtgatagtttgctgagaatgatggtttctagcttcatccatgtccctacaaaggacatgaactcatccttttttatggctgcatagtattccatggtgtatatgtaccacattttcttaatccagtctctcattgttggacatttgggttggttccaagtctttgctattgtgagtagtgccgcaataagcatacgtgtgcatgcgtctttatagcagcatgatttataatcctttgggtatatacccaataatgggatggctgggtcaaatggtatttctagttctagatccctgaggaaccttttgtttttatcttttttttgttttgaaccttttgaatggttgcttccattaccacctgacactgaagttttgtcagtagagggtgctggaaaggcacatcaggaaggaagtactttgacaatggtgaccactttaacatatcaaatcataattttgaggaataattatatggtacaaacttgtatagtatttatatgttcatatagttgtttatataaaatttatatatttatatagttgttatatataatatgtataatttacatagcatttatatggttttgcttcatggttccctgtgtgcttgctcagcaggctgttttttgagcatcttcaccagtgctcagcttctttacccagtggtcagtagcttctcatggtgcccccagagacagttttatagcagagtatttctggtaggacactttccagaaggtgtattttgagcatgtcacaaagggtgggtttctgacagattccagctaatgagcaccacagcagcttctctacccttcattgtgctgtggctgtgccctctccaataatgtctggatctcagccttgagcagaagtcactttctttggtgctctttctcagccctaggggtagttgctcctgatatctgtgattctttgattcttgtgtttttttttagaatctctttacttattactagccaatttctcattactccaatttcctgttattccaaccctctgtcatagttaataatttcttatgtacaactctccctgttcaaattactatgcggtttctctctcctgagtagacccagacagttgcaaccaattaaagatctctctgagccaccatgtatcactggcaagccaattcttcagagatgatatcgttgtatctgtagttgaaaaaattcaaatatcttttagggaaatgtctcaaaatccaatgaagtttagctgttcttcccatggggtttctgtgtacctatgtatttgtctctctttctctatcttcatgtcccaccaccttaactgtgagttctcactcttctctccttctccatctatttgccttcatacacttagtttccaaccccagcattgcttttggcttccctgcgtctcaatttctgtcttggtgaggcagcgatataaaagatcataaattaatgaaatcaaggacatgaaagtgctttgtaattagtagagtaccatacaaagtggtgatattacttgtgtttattaaatagttttctcttctatgttttcaaatgttcaattatgttttattttaagagctttgtgggtgccttcaggggtacttacaaactagtaaaatagatacatcaatacatagaattattagacaagactgaatgtgctgggtgctaaaataggggaacaaatgaggaaacaggagccctgaaaattagaatttaattgtggtctgaggattcatggattatttccaaggagaatcatctgaccttgaaggaccttacctgcaatttattaaatgtttgtggcacaaatgagccttgcaatacgtactttacatatattctcatattgaatctttacattcatccttatattcttaaattattttatgtcttagactgatttcaaaatattttgcttgaagacagatttttgttcatttgttttatttttaattgaaacttacctccagttatgtgtgaaaactcagtggcagtaaaatctacaagatagaacattatgttgcttttcaggtattttctattttcatattcattcatggatacctacattttaaaagatggttgaacacttttcacctgagaactagagtaaatatatgataatctctatatttaaaaagggaaacgttttgtttaaaaattgatgactcagtctctttttttttttccataagagagtgtgtcagtaggcttctaggagatggcatactttatgaaaaaatgtagcatactatttaaattagaggtggttacgctttgaatgcaaagtatcctgtcaaatcacaggatgagtgcatctcccagtggaagatgttgcaaagtgcaagtgagtatgagtcttcccgaaagcatttgtctttatagcttggattctatgagatgcccaccaaagacacttaattttttatcttagaaagtcaagatggatgagtcttcagatttattaggaacccttctttagttttgaatattttgtgatgaatccatactttatctttttgcagatgagatggaaatgtcctgtttctttggcaaataatatgtgagcatagcacatgtagctttttttttttttttaaataggctatgatttgatcagtgttttctgaagtattatgtgcgtgctactggtggtatatgtacccgtagaaatagacagactaacacaatttgaatatatttgttacttattttaacgctgattaggaaaaaaagcctggtatatcacacttgtcatttcttagatactactgaagttaagactatgcaggtaaaaacacctcacccagaccaagtgaattactggtgcagtgttcaggcatgcccaagaatgtattgctgcattcttttcatagatacagcaacactctaccagaaaatagtagtatttaaatatacaaagtatttataacatacataattgcaaattggaatcggttctatgctctttttttgttttgttgttgaggtcagtatggatcaatggataaaaattgaatttttaaaatgtaaaggtgcagactgtgagggaaatcttattaggggatgattttgatgaagttagtcatgtagctttagacaaacttgaagaccaaatttagcaaactgtctgaatcatctgctactgttacagaaggaccaactgcaaagaaaacaactatcacacaaatttgatgaaagtatttgaaatttgtattttcataagtatgatgagaatgaacctctttccttgtatgtcagatgtgtagagacacacattctggtgtgaaacctttcaatcctgtgcttttttgaaacacaaagtgtgctatacaaagtccacctgagaggttccttaaaaagttgaacatagagttatcatatgttcacccagaaattcagaaactcctaggtgcatatccccccaaattaaaaactagtactcaaacaaatgtacacccatgtgcagggagggactattcacaatacccaaaggtggaaagagctcaaatgcccattaactgatggatgggtaaataaattgtggtatgtacatataatggaatactcagccatatagtatattagaagtatcagtacttctaatatactagtaaatggtggatgagcctccaaaatattatgttagtgaaaggagccaagcacaaatgattagatactatatgattcaatttatgtgaaatactaaaatagataaatccatagtgacagaatgcagatgcaaggggctaggggcagggaggagagaatggggagcaactgcttaatgggtatgggttttattttggagttgattaaaatgtttcacaacaagatagaagggggtggttgcgcaacattctgaatgcactgaatgccactgaattgtttacttgataggtgcagcaaaccaccatggcacatgtatacttatgtaacaaacctgcacattctgcacatgtatcctggaacttaaagtaaaataaaaaattaaaaaaaaatcactacttttatcttatgtggatttcacctcagtatggaaaaaataagacttacccagtagtgtggtatgtgtgacattttatggggaataggatgatgttaggttgtgcataagcatttcttattacaggagttaagtatgtatttttacaattgtcttctttttatgagaaattattagtttcctatttgcagtaataagttttcctttaaagataaatgtaagttttaaagaaaaaataagatggtactgatatgacacatgaaggcagttcacaaatgaatgaaaaatggcagcttcaaagagacattttgttttatgttcaagccaactaactttaatttttattatgttattattataattattattgttttagagacagagtctcgctctattgcccaggctggagtgcagtggcaccatcatagctcattgcagccttgaactctatgactcaagtgatcctcccacctcagcgtccctcacaggcatgtaccactactccttgctatttttattttttattttttatacagatgaagtctcactatgttgtccaggctagtcttgaactcttcccacttcagcttcccaaagtgttgggattacaggcgtgagccactgtgcctggccaatttttagtgagaacatattagacactagttgctgtttatgaaagttgaacgagatgtgacttttgccttaggaaaaacttccaacctaaaggtgataagccaaatctataaataattcaaggaagaagctgaatgtgcccagtgagactggaacagaggacaaacagactgaggccaagaccaggtacctgtttggtttgattaccagtaccatttcagaaaatgctagaataggcttctgggtgtagtggctcatgcctgtaatcccagcactttgggaaaccgaggatggaggattgcttgagacctggagttcaagaccagcctgggcaacatagcgagaccccatctctaaaaaaataaaaaaattagtgggcattgtggcaagcacctgtagtctcagctactcagaagactaaggtgggaggatcacttgagcccaggagttcgaggctgcagtcacctataatcacactactgcactccagcctgggtgacagaacaagaccctgtcactaaaaatgggaaggaaggaagggaagaaggaaagaaggaagagggggagggaggaagatgctaggatatataggaagaaattaaactaaactctatgtacaagtgcaaacaaaaccccaacttaatattggcattcgtggttgatggaaagatgggagttggtgggaaaccattttagagcaaaatttgcttttgaaattagaaacagggagaaaaattacttaataaatgcagcaggccgggcgtggtggctcacgcctgtaatcccagcactttgggaggccgaggtgggtggatcatctgaggtcgggagttcgagaccagcctgaccaacatggagaaaccccgtctctactacaaatacaaaattagccgggcgtggtggcacatgcctgtaatcccagctactcaggaggctgaggcaggagaattgcttgaacccaggaggcagaggttgcagtgagccgagatcatgccattgtactccagcctgggcaacaagagcgaaactccaactaaaaaaaaaaaaaaaaagcaacagataatgtaatcaagtttcatatactgtggtcctttttgcctctacctttttctctctcagtaacttggaagtcctctgggcttcctctctccctaaaaatctcacatttaaaggtagcatagtagagggcttgagaatatatgctctggagctagactgcttgggttcaaattccagttccaatatttacagatcgtgtaaccttagtcatgtcacttgatttttctatgtatttgttttatcttctgtaaaatggggatgttaatagtaactgcattataaggctttggtaaggattaaataagttaaatgattaaatgtggtaagcatttataacactgcttggcacatggtaagtgatcaaacaaatgttagccattatcatcatctccagtcagtaaatcctgtcaattttgtctcctaaaagtctttttgaatgtcacccactaccactgccttagtttaagatcttatgttgtcacaattgcaattgtgccttaactagtcttgcacccgcaccctctctcctaaccatcccctctgtctcacttgactgcctgacatactcttgcttattctgaaatactcagctcagatgtcacctctgtgaaactttccctgatcctctgtgctagtccacttagggctctccatgtgcacttatatcctttggaacatatctcatttatagcatagcttatatagtactgtgactgtaactgatgttccgtgggttgtgtccaccttgaaggtgagaaactgggtttacttagttttgaacttccaccctaaacacagcccctggtacaaagtagatgcttattaaatgcttgggtggattattgaatgggctctgcctgtagaaagctagtttacagtcttcatttgggaagctaagttgaacacacctaagaataaataactatgaacattgtatagtaactgctgaaagagtttagaaagaaaaggggagtgctgggggtaatcaaattatacttcaaaaaggtagagcttgatttagaacttaagaatgggcagaacttgtgtgaacagagaggcagccacaatctactatgcaaaagggatgttttatgagttgaatgggtggtgacagaaaaaaaggaaaaaaaaaaagcccagccttagcaaaacagagaagagaccagtctaattagggtgtgtgtatgtgtgttgatggggggaaggtatatgttgaaaactacaagtagatcataacctataaacagggtgtgttctaaagatttatttacaaaccatttgtttggacatgacacataatatacatggtttctagccagctcaaaatattgtatttaacctacttagtagtgaactatcccagggacagtgctccagagcctgggagcagagagtcaggaaaggtgcgatggattctgggctagaagacagagtgatagagaaattgagatttgttgttctcctatgaccctttctgcacctttttttttttttttacatctcagtttctctaagagaaagtttctctatccctcaaggcaccccatgctgctaacttccttgaaacagaaccccatccaaagttgctagggctctaaaaggctctctctcacctccagcctgcctcattccctcagggcaacagctctttgctatttgaagaaacttgactcaactcattcatgccaatgtgtgaataactgatagccacctcatcctggcagctgtacttactttaattttaacagccttcttgttagctcaaatgaacctgtaattgctggaatttctggcactggtacagagcaaacaatgtgggaggggggtgagggttacagagagagagagagagagagagagagagagagagagagagagagagagtttcactgtaggagaagatattttgagataaggaaagctttggccaagagctttgcctaattttcctttcttctccacctccctcccccaaattgttcttgtgtattcctcttcacaggtttactataggctgcaagttgtttattattattactttttaagaataacttctgtagcagttctgggtatggtggtactgtgttttttagttgtgtgcaaatctgggattacctgtaatgggaaatagggttgaatagataaggtggggctgggggttgaggggaccttgaaagtggagtctacaaatacatccatagaaataaggagtcatggaaagtttttgaataaaagcttaagatgatgaaaccaataaaggtggcaaaatgaattctaaattttgaattagaaatgatggagtattatgtttactcttggcttgggattggtttatacagaatcatatttctggttaccatttttcatggttctgggcattcacctttaattgttagtatctctctccttggctgtctgttctctgtggctcctgagccaatcttccttcaggattaatatgctcctagaagcttttatgacttttgtattaccaactagcacataagggcttatacattctgtttctgtgtcccaaaattcaagtctaatgttagcaaaacacaactctcatttataagacttttttttttttactttttaatgaaaatttccagcctttccaaacataccccaaaaacacactggagatagtggttaatgatctgcatcagttagccctcagagctgcaggaacctccacacccactccctaacctatgcatgttaaaccatgttgtagataagctcttccctttggggaaccccattgtcttttattctttatattgttcattatgtaaatattcttgatatttctcctccaccagtctgcacaaaggagaagccagaaaatggggtgagaaagggatttgagacatttccttaagcctaaattataattctctcattggaacaggattcatagatctttaatcaaatatgtttatttttctctgttttgaacgttaaaagggcttgttcgcattgggccctcttgtgtgtcatttgtatattttgctcttgactgctcagcataccatttacattaccaggtattggtgatgtgcagtgacttgcttggttgaatttgctatttcatttttttgctccatgtagtggagcagtgattgttaaaattggattttgtggtttactctttcgtcatgacttgtagcaacagtaatttaataggatttaacagtccaaagaatatactttttgtccttttcatttaccagtccacaaaatgactgcttttaggagatattgtttcatttttcaatattccctggcctaggtggtaacaaactaataaaatgcattcatttgctttaccaatcctatcttgacttagaaagttgattactgacatttcccttccttatggtagttaagtgttttccttactcagttcagttcagcagtcacctattgatccattcacacccccatcctcattcttctatcataaagttattatatacctactatgctgggccccctgccaggcacacatagggtctgtcatgcaaacatcaaaaggagccatttaggtatgctatgtgcaattgtaacattttattttttcttatgattcaaatcttagttttgggaggaaaaggccctttaatgatttcttatttaattatcatcagaaaagtgtagttaggcatggaggagggaagaacctacctctgctggcttgatttcaccaaaatcgcctcctataattgggttactatgtgacaggcactgagttaggtataatacaaacataaggaaggcccaacctcagttctcaggaatttatagtctagggagacatagaagcagttttaacccaaagagagaggagctataatattcaaagtatcacaggaggatagcaaacccattacctgtatcttctaagggatgtgagggaaagtttcactgagggaggtttgcttgaacacttaagcatgactagaagtttgcttggtagagtagaagggcagggaattccaagtggaatcagatgtgaagtcactgaggcatgaaggagtatgacatatttgaaatgtatgccaagaaattgctaattactagatgaaagagaactctgtggaattggcattgggaagatatttctggtacaggtataggttgatcatttatgtaacttttgtcatatagctattctgtagcttccattaactattccttacttctcctctcctccagccatttatgtgaagactttttttttttttggaggggaggtgtttaggagtcatatttgtagtttttccttaaaatgaatattaatataaatattaatacaatacagaggtgactaataaacaccaaattaggtatcaggagacctggcttattgttttccacttctctcagcggctatgtcacttgagccaaggcatttaacagctctgtttcttcatgagtaaaatgggaatattaatgcctgcattgcctacctcaggatcaggttgaaaatgaaaatgaaactgttaaaaataaagaggtataataaactcttttacttggaattctgctggctgaggttaaactgacatttaaagcaagtaaaatactttgtggagtatctggatagaaaaattaggttggaaaataattcttacttcctcattaaccctctatgtctgccctttagtctttgaaatgtcatttagcttatttctatgtttccaaactaacatgataaaaattttaaacttcctaatgttctggcatgtatatcttggccctttcaaattctcagtgtaactattaaatagcaattgatttaagagttaggtgagtaaaatataagttggtatatttcgtagtcaatcttgaataattcatacctattaagtagtttgaattactaatgagatactgtctatcatttcttgttccatatggtggtaggacacaagttttgttccattttagaaatgtataagagggtcctgattcattcaattaggattgggaggttatgagactttggccttctgccttctttgccatttttcctaattcagtgacaatgcaggcagcagttattagtagcagcaaatgacatttccattcattttatttcctttgacccccatcttccccattagattgagtggtaatctactgaaatctgataaatcacttgaaacatgaacttctagactataggagcatgagcaattgcttccaatataaatactcctggctaacccttctttagatcagtggttctcaaaatctatcactatggatatttcagcaggacagaaaattctgtaaaccacttaagtcatcctgctctgaaccatcttacatacatcagaagaaagggaaagagtactgctatggatgagataacacaatggtattttacatggaatgtaactgaattatttatactagactagtattgatcctgtcatcataatcactattatatgacacttgtggaattccaagaggtagttacccctcctccctttctgcctttgcaacttagagatgaactagttatgtgaatttggataaaacacctattctaatcaaaatataatataaaatggttgttgagatttttctaccaggccctaaggaaataatctgtcaatttgtctgtttttcacaaaactaaatgaggaaatggtctggcttattttctctttgttttaaaatctatggtgccattgatacccagtttaaaaacattcttctgaaggtgctgttgattaaatcattttaatgtcccccaagtactgcctgtttttgaagattatttggaaaatgtggcacattcaccaactcacattctcctcttattctgtacttgctttttttccttataagttagtggaaaggcaactggtcagttttttcactcaataaaaaagaaggaaggtgtagacagcttttatctgggaatgctttaagtcattgagagaatatttttaagtgttaactactttttgaaattattggcagaatcttttaatccattttaacataaaacagttgactaagatggaaagatttttattgtttacataaaagaaatcaccatggtttttgcatcattgcataaatctaagagattgtgcatacataaaaaggatgagacaaagctgaatgttaagtgccaaaatcaacgaaagcttgcgtacttactgggtatttgacactgagcataatggaatgtggttccacagagagagaatactaaatatttagacccaaggacatgtttctctgatagcttcttatcctaatctcctagctaacattattaaccctttttgaaacacctctttcttacacttagatttcctcctattaaagctcacccttggagattctaaaccttctatacccaagcacctacactcacccactcatctctttctgagatcttcatgaattccttttgtttattatatggatctttgggtgaattatcttggtttactatgagtagtaaagcacaatcacaatttctctccacttacagctctatttttccaaaggtcacagctccatcattcagctcttctgtcggtatccctttctcatcgattccctggaatttttgaaccagggctgtgaggtatacagccagcaatgttgcatagtactttagagttgctgcccaacacaggtccatctctcttcacaattcatgtttgttccttttcaggctcagagtggtgaaggaagttactaagattagcgtgcactatgaagtctgggaggtgggctttcagggacctgcttacttactctgaggctctgacctttgccttagtgtgattttctcaccatcctcttttattttgtgggcaaaggatcaaaaagatttcttcaacattgagtgctaaacattagcaagaatgcgtggtttctggtccctgtaatgaaagaatatttttaaaaccatagactcaaattaccatgtaagatatcacagaagcaaatggaatttgagctggatctggaagaatgggttgagttcaggaaagtggagtttggaagagatttcatgcaagagggacctctggagcaaaggcgagaaagaacaaagaaagcttttgacatagagaactggaagttggtgttatgatttactacagtaaactggaagagtaggttggccggtatgtactgagttcttagtgctaggcttagttacttgattaattatttgattgatctactcattcaacagattgtttctcatagcccacaggataaaatccaaacctgttttctggcgtgcatggtcttctgtgatgtggtttctgcataccttaaaatctactccactcaacactatgtacccacttttcagtaatattgaactcttttcagtcatatcgaagaatttgctgatccctgcaacatgttgtattccttcacatgtttctttctttgcacaggctatttcttctagagttcacttgatgtatgcttcattcttcagcctcagttgcaacggaatttttgttattcctctgctgctgtagaatgctaggcttatattactaaagcttctacaccatattttgtattgtcagaatacatgcctgcttccctcactcagcttatgagcttcctgagggccagggattgtgtctggttcacctttacatccacaccacccaacatagtacctaacatgtagccaattcaataaatacatacttactgtaaaattattcattgatcatttactttacatcatgtgtagttttatttttaaaaagcgatctagatggaatgggattgacaaattgaagacgggcaatgcagggagatgagttatatgtatttttgaagtagctcatttgtttaaaaaaaacagtaggggctagattcctgggagattgataaagaaaaaaagataggacttaatgactggcaactatgggcaagagagagggaagaattaaagataataaaaaataaagataatacaacaaatagcaggatagtgacccttaaaaaaataaggttactttcaggtaagcatgtttttttttctaagttggatttcctggtgttagtatttgtctcactccacctttgctccaaagatgaacactttgttcctgttcagtttaccagaactaagttcaagatatatgtgcttctcattttcatatctggccagcagtttagatatgaaatataaatagttcaactacactgactacaatttcctatcaagggaaggtatgcagtacataggtttttttttttttttttaaatatataaagcctgtttctgcttttgggagctacaactgaagtgttgtaccaggcagatgcactggggtgcgctactatgtagcagagcctagctgtgcatcacagctcttaactttaaaactccagagaatttgatgagagagggatccacaagaacatgacaaatgatgagagttcaaaccttaagagaaaaatgggcttattggtaagagacctttcttttcctttatttactgctgttacttactcattaaaatagcaagcctgttatttccatatgtggctgtgaagcgatatacaaaaatcaattttagatgtattgtagaattcaggagacatattggtaaccatgcaaaaatcataggaagcatgtacaaagcttgattttgaataagatttctaagggaattttattttacttcagactgtgttatagatttatttatatagcttaaatgtaatgcaggtaagaaatatctatatatacatatatttaaaaagttaaaataaagaatagtgacttatgtagaaatacataatttcactcagttgccagaaggtggcataccagatttttttaaatgcacaaagaaaaggaataatattaatagggatataaaataagctgtatttaaagacattttgatgcattttaaagcaaagaaataatataattgttattttttggtagggcttaattgtaaaacatgacagatatgaatttgacctattatagctttttatcattcaacaataatgtttatgtgtatagcattttaaaagtatactttcaaatagtactgtcattaaggagatgctgttttgaatttatcattccaaaaaagaaaaaatattttccacctacttttttcataggaagttattagatttagtatcacattttggataaggtctttgtcaaggtctttctaaagatattattaaactatgactttgatatagttatggatttaataatgcagtagtgcttgtgagatgacccagaaaaaaccaagacagtttattttgaaaaaaagtgagataaggctaatgcttactttctatatgctgataacaacataaatgaaataaatggaaataaatgaaattttatattagagctcatcaaacatttgccagcatactttaattttttaagagagttgactgtcaacagcctatactgtagtgcttctgtagtggtctctatttttaaaactggattcctgaggcagtaccagaagtatgtctatccaatgttgctttttgtattagcccaaaagagctagatgtatgacagaacttaacaaaaaccaaatcttctggttaggagacagtatatctatttatgtgtttttattaattacaagcagtatgaaaataaaaagaattggtagtaaatgaacctagaagaacattagccatctgttctctgaaagcttgtaatatgtgtcatttgctttcaggtttttatggcaaagaagtatatcagcaaagaattgacctttaggcttaaaaagctacaaaatggcaaattattccaaggggcgagtatatatttactggaaaagtgtctccttgtgtccaaatttggctagtttagtcttttagatcaactgccaatcattgttatgcttaatgcccatctttattccagactttctgagacattaagaaagcttctaaaaacaaataggatcttatggctttctagttaagggtttttaaaagttaatttacatagtttaaaattgttatgtgtggttttaactgttcaggatttataaatatggtttattaatttacagctaaaatgctgtcagggtatgctttgaaaaatttgaactaaatataataaaactacaattaaccaggtttctttttgcactccactttcaggagacggaggcaattgtcattaaaacaagccgatttcaaggatatattcaaaaaatcaacttcagggtatgtccaggggtctacatttttcctcacctttttttttttttcagtgcgaattggttttcatgaaagaccctgagaatactagaagacagttatcaagtatagttacagtaatggctagggcactgtgtttattaggaaaaaagtatgtaaatcatgctgttaaaaatgccacgcatcattgtattgtgccttatattttccaacatgctttcacaaacataaattactttggttttcacgacaacactgtgagacgggcaaggaaagcagcattttccctattttacagatgggggaagataacactggaggtcagaaagctaaccagggacacagctgcagttggaccacagatgcctagctctgtctcttctgccttcttcctcatggaaaaagtttgaaacaagtttttaactttttaatctgtattacacaatcaagataatttgttttctaattgttgtacctcacagtttcccacttcgcatctgtctgtctgcctctgtgcctgtctgccagctggagaccttactttcagactctcccagacctagaaggatctggagtgtgggagggcaagataatggatgtacagtttgctatgacaactggtgttgagcagccagtgttcatatgctaaggcaggccagggactgagaaagaagacaatcttactatagctaagagatattcagcaggaattagcaaccttgactttaaagcagtgtttctctaatagtttagtagacctggtgtgataatcagctgtagtacttgttgagaatgcagagtactgggccccaccttcagatatctacattttaaataatcacctcatgtgattcttatgcacactaatgtttgagcacatctgccttaaaggtaaagaacttttcttttggtatatgtattgcagcatagagaaaagaaccacttttctctcagcaacttctgtgttccatgtcaaaccatattaaccagggcagtggggagcaaggggcaagcaagagtgatgaatgacagatattatttgcacacattgctggatgtacatctgaagcatgtcacaatagctactgttcattgtggtgactttgacgtattttataaaggtttgtgtctattttagacatgaggggcagaaagatttctgccaaaaggtgaaaaataagtgagttttgatattttaataacatctcccagttgtttttattgtaaagtaatttaaaaaactgtatagaaaactaggctattcagggttctggtagttaagggtttactgtaacaatgtatttacactaatttgtgtttcctatgtgtatatctagtctgcctgattagattataatggtcttgtggccagggaacatgtgttcttttgtgtatttgtaacatctagcaaagtcataagttattgatacttattgatgactgaaataactcactgagcatgtatctcctttctaggggttttgggctaggcagagtaagttgattgatttcatttgtgaagttaaaggagacaatcttacactgtcagtaatggttaatatactaagaagttttcagttgaaataactgtattttagttgacagatgtgaaagtgtggtcctaattaataaatgtgctttttccctgtttagagtatccattcaagctcgatcttgcctcttcaccctttttggaatacatgttatgttgttctgtgctttacaaatctgaatctgaaaaattgatatttctagaaacccctaaacataaatatttttgtttaatttctgaacagtatcatagaaatttaaacaaatgcctagaccctgtagtggaagattcataaaaatgctcaagtgtctctgacttaaatcaagctgaataaggaaataaggaatgaatgaataaatgtatgctagctaaagggaaaatgtagcttcagaattctatgagaagtaactgattatttaaaacatatatttgattttgaagacatgaagtggttctgaacttattagttgaagtagacagacatagaaaggaagtcaagaaacccagatttagattacctctagcttaaatctagattcaacctagaagatgaattctgtttttattcaaaatggaattactttggttagtagtagaccatgagataaaggaaaagaaatgatttccctttcattggatagccattgcatccaaataataaagctaaacctaatgccaaaacaagctgtgattattttacaacacatgaacacttgatgtggcatgtgctaatgatgttgtacatcataggattttaattgaatttctgtttgcaggcacagcaattttaaattacatacttttcagctagagtctacaatttagacctatgaccatacacttggcatctttcagtataactgtctctgtactctttagctgtttgtagaatttaaaatcgctaaagagaagaattctaaattggaaaacgaaaaggatctggaaatagtcatgaaaatagaagtattgaccaggttgctaagtctcttggatagtggcatagtgggcaaataacattaccataaggacatctttaagaaaactgttgggtttcatattatggcaatgggtcacaaggttcaagtttgaaattgagccttttttgaagtgtaagattttctcattcattatttggtcaaaaccttttatttttagatgacagtagtttctgtgggcatatgtatatgaaattcagttttaatgattaaacctaggaaatggtaaaagttaaagcaattgaatataaatggctctttctcatagaaaatttaaatagtgttaaatagtcttaattagtcattaggattagctttctgtgaaagtgctgctggttagcaaaatgttattttgattactctataagtatttttaaccaatatttataaataggaagaggaagagattggataaccaggtgatcttctaacctcatttttggttataacatttatgatgcacatgtgaatgttgtaataactttttggatgtaaatatacatttttcaaggtagtagtactatttcattaatttaaaattgggatgttgaagaaaatatactcttctaaagatctttcagaaattcagacttttagaaaagtataggtatttctgaaataatatagaatatggcaaatgttgaatttctgtaactggcatgtcttttgagatttggtatgtgatatgcttattactgaaaaaattttcaaccatcataaataaacattattagaagttgtttattcttaccaaaatagtgcaggatttacaaatataaagatttcagtattccttacattgtcttcatgccactttggcagtcttgcttctatatttgatgctaccaaaattaaaaaaaataagtgaaactatttggaaagcttcatatgaatgtattttcattcaatagagccatattcttaactgttcagttgcactgtacattttaagtggctttttattttgataagttcacagattcaatcagaaaagctaacaatagcttgactattttatttactcaaagtagtttaaggagatacttaggaagttgctgagagatgactaaacaggtgagtgatcactatttcaggtgatagagatttttttattggaatatttattttatttaagaaagtatatatatattctggatgatttccttcaatatatgcttatttttaataagatagtatgtttctacatattttttcattttaaggagattatagcctaaaattatcaaattaacagataaatatccctcttgacctctgcttttggtaatagcaggtttaacaacagtgttttaaaaatctttcaggatatattctggcttcaatatataattctgattttcactcctctgtttataaatttccctttcaatttactcaacaaatacttattgagtgctttccaacgggccaggaatggtgctagattaggaagatacaaagatttagggattccttcttgaaggacacataggaatttgggaaagacatcttgggcagatgaagtaaaatagctatagcacagggtgtggtaatagcatggcctctttttggagcattggatatgttacccctactgatgatgataaatcgtctctctgtattgctcttaccaaacaatttaaaaatggtaatctaaaatcacatatgtaaatagtacatagtatatatacttaaaaactattgatttgccaggtgcagtggctcacgcctgtaatcccagcaatttgggaggtcgaggcaggctgatcacctgaggccaggagttcaagaccagcctggccaacgtggtaaaaacccatctctattaaaaatacaaaaaattagccgggcgtggtggcgcatgcctgtaatcccagctctttgggaggctgaggcaggagaattgcttgaacctgggaggcggaagttgccgtgagccaagatcgtggcactgcactccagcctgggctacagaatgagactctgtctcaaaaataaaaaaaataaaataaaataaaaaccattgatttccactaccacaaccccaagcatacacaaacatcctggtttggagtttaaagcatttttttttttaaacagatgggaatactttgaagcatacacgggtagaaaaaaaaaaaaaaagaaaagccataaagagtatagatagtgccagaaaacaaaatgaagaaggaagggcaagaacttctgaatttcccattcagtgttactcctttttacagccttagtgaaggagtaaagttagtcataatctgtggatcatcgggtccccaacaactggatctttgttctctgctcagtctctctgtatttttgcccactcatcccagctcctatcttagccccataacctctttcatctgacacccaactataaaaagtattatgtaaatatcaggaattactaccactctggctttcctttccccttacagccagccattaccttcctcacccctattgtcttctcctttggatccattacctagtgttcctgccttttcaacacactagcatctcttattgctgttttttctctgcccaacatggcacccttcttatcttaaggaaatgttacagataggaagaattactgcccttcacattgcttatgccatcatggtgtgaggaattctctacgcatatacatgagtgtgtgcctgcataacattgtttgtattgtttgatgattttgactaatttatatttcttgatacctttgatataaatccaaggcatagtcatagctacaaaagggaatgtctttgtagattctttgttggcctactaggtttcacacagttctgttaaagaaatttctaatgtaaaactttccaatgtagttgtctttgagaaacatctgggattttccattttttattgtggcaagactacatatctgagtatctagtaagaaattttaaatgtatctgatagtttcctgaaacaaataaaggagacacacatgcacgaatatatagtcatatatgtgtttaagagatacacacaaacacacatgcatgtaagtgtataagtgtacatagccatgaatgtgaacaattttatttcctgtaagaaggaacccttaatgtatcaagaattttgctttgctgtccagaattttgtgtgtgttttaaagggtttaaccgtcctatttggttgctatccaagtacttttactgattggtggaacataaacaaagcacacaatttggcatgatctgcagtcttgtctaagcattgtgaataacatggatattttagattaatctgaagagacatttcagaactgaaaagattacacagtgcctgttcatacaaactctggctagggctattagtctttagctgtacctaccacaggattaaccaaaacttgcatgaaaaagtagataatttcttaggggacatcaggaaaaaaatggagcaagagattagaaacatgatatattagttcatttggtgaggtggtactggtgacaaactatactagtcagttagcaaattaagttttactataaaattatttaggaacatatgcattgagaaaaaaaatcagagtattggcaatatatttacgttttctcttatactgtgactgcttaaattatattttcttcctgaacattcttaaacatcttctggaattaagattttggaaatggttcttcatgcacagcttttcttttatggtgtttttctcccacttctatttttcagtgaacatataattggaggagttgatatctctttgtaatcctgtttctttagaatacattgagacatttatagagtgtggttcacttcaaatagaaacatgcatcttgtggaatggtctcattgggaagaacagtagggattctacaagagtcctatactaggagattgaaatttggtttctagtttctcttttgctgctagcttgtgatacaacattgggcaagttagcttctctgggtttcagtgttttcgtttatacaatgagggtactgagaaaaatgaattcttagagtcctaaaatttcaacaaatcttctccttttacattctaagagttggctctttttgtagccttggccaagacccatcattgtcctttgtttgttacgtctctgaactgtgcatttcacaggtattttttaactgattagttaatgttcataaaatgcgtcgaagagcttttatgtatgttgtctttctctcctgttttatgcaattgtacataatagaagccaagtgttctgtaatcaaaataagtgtttcctacgatgtgaccaagggttttttgacatttgctattctaaatattaaagtagtgggacactgagcctgcataaaattatatttaaaatatatgttgaatcatttttgttcattccataggtgaacatatttttagttctagaatgtaatgggaattataattacactccatagttatgactggattctccaccagggtagtaacatctgatttgtttggatgctgccaacttgtaattaggatgattttacctggctgaagtttatttctaaataatatgtgaggaatagtgttgttaagtgaattaatagtgtaaagtgttgttcatgaactgtatttctgattaaagggattatttttaaggactttggcataatagttgtttgctcatgagaggtaattataagtgacttaataatttattaaaggaaaagtaagaactgaatatatatacatctccaccatcagatataatgcttttagggttttaggtgttttagagtgctgaggatggggtgtagggaggcagccttactttcttttcatgctgaacaaatattaaaattattggggtaccacaaaaacaaatattaaatattaagtctgcaaggaatctagactgaaaaattgacctggaagattcatggtattagatagcttctttggagcccaatgaaattcgacaaaagtatgttgttttttttgaatcagttgattgtttatagaagaataataacttatagaaggatattcttatagaagaataataatctttacaataaaatgatcttcacttgtttgtggtggttccctttttgggaatttggaaaactctaccttaacttgcctgttttccactcatcaatgtttgagaagtcttcatagacagataaactcctggaaacacttcactaccatgttttttacacaggtttttggatcttcattctcagaaggtgaagtagaccaggcacggtggctcacgcctttaatcccagcactttgggaggccaagtcgggtggatcacctgaggtcaagagttcgagaccagcctgaccagtatggtgaaaccttgtctctactgaaaatacaaaaattagccaggcatggtggcaggtgcatgtaatcccagctactcaagaggctgaggcaggagaattgctgcaacctgaaaggcagaggttgcagtgagcctggattgtgccaccgcactccagcctaggtgacagagggagactccatctcaaaaaagcaaacaaacaaaaagattcataagctggaaaatgattgagtctcttttctaaaacatcacctccttactacataatatatagctgctttatgttttatatttttaaatgtttgcaaatgcttcgggttttgaaaatttgtttgaaactcactgtggaataagacatttcaaacttgatgtgttcatacatgtgtgtggctgtgtgtgtgtgtgtgtgtgtgtgtatgtatttctccttctttggatttcaaacaagttgcccctgctgattatacctgaggcctttttgctatataaccattaaggattattgcagaaagccttctaatgtaaaatattgactataatttatgtgtattaatggcaggttaaaaaaaacttttaaatatattttggccactagcgcattgataaatattcctttctctgactcatttgacaatttctgtgagtctgttttgtgtgcaagtactaaaaggagttggatatgtaatttaaccctttaaaatgcttgactgggtttttgggggctgtttcttttgtatgataggttgaataaaaattgtatgtaaggtaatgatggctgacataattttaatatttacaaagttcatatattacttgtcaatctttcaaaataagctttctctttccatatatgtatgtatgtgtatatgtacatactgcatgtacatatatgttttgtgcttcacaggaaaatagtagtttgtctttttgccttgatattggtctgtatcttaaaaggaaggcatttgtgattatgttagttgatttcatgctgtatttcttatatactaaatttggtattttggaatttttgaaaatagttccttactgtagaaacattcatgtgtgtttctaaaatacagatgaaaaagcctcttaggggactaaatctcaatctttaaaaactaggaataatttggaaagaatattcgaacgctaactatttaagttggaagcatgagtttattgtttggatacagacttgaaagtaaatatgagctttgttcctgcagtgattttttaaaaataggtagttgctttcatgtcaatcatgatctgcctttactaagcttgcattgatggaaatggataattctgtttttaggtagaagcagaagggtactatgattgtgaattgcctatatcagaagtaaaattcttcagcctgtaaataaacagttcagcataatactcatttaacctatattcactttttagaattgtgtagaaaatttgtgagtttgttttggtgctttaaacagaagcttaaaagtcactttcagggcatttacaacgctattttctggcagtattttgaaacaatatagatgagccctttatttgccattgctttcatgaaatacctcaagctgcctttgacagcagcttcaatttttgaacctccttgacaatcgctaatccctataggttaccggacccgctgttgagctttggagtggtccctgctggacacctgcttggccagcagtgttggtctttcctctaggcaatttgtgagctgtctgcgggggagggaggggaggagtggggggggtggtgaacaagaggggaaaggggagagaaggggagggcagtattgaattagattgttgatagcgtccctctgaggactgctattaagagcatgctactctgtacttcgctgctgcagaagagagagtgatatttgtgttactacagcatgttgtaaatgtgtgagattttgctcatctcagcttggaaataagaatagggaaaggagagcaacttgaatcagaagctactagaagaacctgcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtaggtatgttgttgtttcattttcatatgaaacccatctatgttttttcttgctactattggtcagaaatcaggttaataggtgcagaatatagtacagtgctgcagtatccctgttaaggtagaacaatggtattgcaagcttaaaaaaaaaaagcctggctgcttttattaaataaagctgcattgtatggtatgcacagtgcagtcctaaaaaaatatactgcagtcaacgcttttctggcactattgttgagttggaatgattgaatcatcatattgctttaggggacagaagaatttaaggaggtaccttacagccctattttacagattggaagcatcggtttaagggcactggcagaatcctttgcttgttctccgcggcagccactgctgtgtcagtacagtgtggaatggaagtcttagttggtagtctgttatggaaacgctctttactgttattgtagtaccgtggtgacaacatgccattgaaatggaaaacgagctctcctgctatctggaaattcccagttcctgtgcttaaaacatccaggtcaactccactttctccagcatacatgtaagtgagagaaaataggatattaaagtgggatttcattcatgaatctaccttgtggcaaaatgggggcgggggagcccccaaacagcaacatccaaaaacctacaggattaaaaacctcaagcttgcttacatttaaagatgttggcatgcccacacttcatcattgttttgtttttctaaagtttatgtttatttaaagtgtttaatggtaatctaattaccagtgtgaaagtacaaaggcatacctaaggaattgcaaaagaattaactttaatatttaacatatgttggatttgtttgaatttttgaatatctaaaacacttaggatgacttcttttgtgtaatggcattaaaaattgatgattgatggtggtgtgttaaatatggtaatgcctctttactattttttcatgaattaaaaacagagttaacattgatcagaaaatgagtcttttaattgagacttttatactttagttgtgtatgaatattaatatgtttgatagtacatctttctcagttttatcattcaagttctgaagtgtaagtttgaatttgtgcaaattatatctctatgagcagttatattatggggattgaaaaagtattctacaaatgtctgttttaaaaatgtattttaagtaaatacgtactgaagtgcactgggaagtctttctagaagttttcaaaatttttgaaaatctttttaaatttgcagtgttgctttaaaggcaaaatccaggagatataataaaatgttcttttaaagtattgttcatgatcctttttggtggaggaaaaccgaatctttttttaaagaaaatattagtacgagaaaagcttttgaaaagaatgttttaaatttgagtgttatttttaaaatatttatcagtaggaaaaatgtggaaaacttctcctgccttagtttaattgtgtatttagagctgtggtgagttgccattttttaacttagtttttgttttatgtgaggtagagatgcacaattatatctatctctttctttgaaaccctttcagatgctgaggaagtgtggttatgctctcagtccaaaagaagcaattccctggaaagtgttgaaaaatgaggccatttcagagttaaatcctgtggtcattttattttcagattttttaatgctcctttccgtttatgctccaggatatttttatctctttgggtgttaaactttatgaagtaaaaaaaaaaataggctagtttgtaaaaataaaccagctatatttgtttttcaaaaactgtttgtcaaaagcacaaattaatggaggtgacaagttaatggaggtgagaagttaatggagctctttcacataattcgagaaaataggatgcttcctgactttatgcatcttaactggcaagaaatgactaaagatttaccaaaagcaactttattataaaaacaaaacaaaacaaaacctcactaaaatcaggttacaattataatggttattaatgtttctaatattcctactatatttgattgtctaaaagatccaaattgcagcccttattgcccctgatttgtcgatttttagagatggtgaaataaatccccatgttttattaaattcatgccagccacaagctcagatacaactcaacacaacattttaaattaatcactttcttccttttaagtgcttacctctttgacctgatgatatgagtgaatcaatttagaagatagaacctacaaaatataatagatcttgcatgttgactgttggttgttggtagtacacataggtagaatggaaaaatatattcaaagagcttatggtaggctgaagtattttgacattgtaacagactattttgacattacaacactctatattattgaattggtcttaacttatttttctttttatgtatattaatacttaatagtaagtaaatatgcacagatagaaatttatgtgaaatgtagcaagactagcttggggagtttaaatcaggtttttaaatatgttgtttagtttttgaccattttagatcacagttcattgcctcacttggccaaaaataaaaacatcatgtttaacatgtttttctcatcagtacttctctatattcctcaacacatttacacacaaaatgatacttaagtatagcataattccacttcaaaaatgataaagactgaattagattactgggtcaagtaacattatatttgttctcacaattgtttggctggcaaacataggtttaaatggttacttgtgtcttttgggtctaaactctttgcactgaaatagaattgttcaattctgactcctcaataaatcgtgatatataggaaatttacctgtaaaataatgtataagtatttaaagtagtattttgaatatagaattcttcataggtgatataagatctttttgtacgtatgcttgtgtagcatcagtattggtttgtaatgttttatcattacttaccgtgctttgtcaaatatacattacgtggttttcattgaagacttgagtactttgtcaaagactgaaatttcaatatgaagtattttaggtagtagtaaaaatgtgttatagtgattgagcatgtgtgggaaaaatctaaacgctccatggtctctttctaaacccagtgtatgtgctgctttgctgtagctcttccattgatgctacagatagggcagtactgctgtgctagtgaaggctacaatagagaacattttacttactgcaaacatcgagcagcaagactattacttttttccttgtgggtttaaagtccatgtttgttttctttctgtttgtttagaacttgaatgacagttgaaatgtcccaacatttttaagttttctttatgatgaagactatagtatttgtggcaatattagtagaaatagcatcttatatagtataaagcacttaaaaaattttgctgtaatgtcatactagaaaagtgggatatcttaaatacgaaagattcaggaaaataatacttcagtctctagattgattgatgatcaaatagtctttattgggtagacatattctttcagctttagattttagcattgcagggtggtgtgccatctatgtggatttctgaagggattgtcttgatagaaatagagtgcttggtgacatgtgtttgctttgcactctgttcaacagtaggttgaagttcaaccttagcctgagggaggatctcctggccagtgtaaactgcattagtaaagactctgcccctgacaggtgcaaaccatataaattactctgtcatttagcctaaattaataaagctgaaagagcaatcacatctaagtgtttttatggtgtttaggtattcattgttttaaaacagcaaatggttccttcaggcaaatattatagggttaatgccttgttagatgctaaggacacactgaaatagaacaaaattagcactagtgatcctttcatcttttcttttccagcagcgagttttgacaataatagtgtggcaaggaggaaggcaattaggtaagaattaaccagtgaaatataacagtgaattctagcaagacagaccctgtgagttgttttccttagaatgttacctttctcaatctaaaagacaatgaatgttagtgaactagacttgttctcctttagtccctgcacttacattcagttagcttcctatttatgattttttgatatgtaaaaaatatttttatagtaaatgccaaaaaacacaacattctatagcaattgcctctgtaatgtcttcaataaaattcagtacctggcatttcctgagaaaatattgtgtatattgtataaatgctccttgtttgtaggtgattcacagcacagacataataaaaatatgaattttctaaatttgacatgtttctatcccctaagattgtcttttttttctaatttagtaaataaaagaaaactttgtggttacagaaatctttcttatctagcaaaatacttattaaattgataatcatttgtgattagagaaatctttcttttctagcaaaatacttattaaattgataatctcaaaatagaaaagaatgtttagttgctttgagaacataaacttttacttgctttgtgtctacttaattttgtttttattacttatgcacaatttaacaaaattatgtggaaaaataacacaactaacacctaagataaattttgtgttagtctgcaacttttgtggcatgttctttgggaatttgcattgtctgagcttgcagaaggactaggttgtcatttattaatggaaaatcatagagatagaagtgaccttaaaagtcatttagaaagtccaaaccccttttaacacaggaactcattccatgacacctctcgaagatggcattgcatgtccttcttgaacactgtcactgacaaagggctcactacctcaccaaggctgcaccctccattcatggacagcttttccttgcattgagcaaaatcagttccttgtatcttttctctcccgttcccaatgcagccttatagagctatatagaaaaaaaaaaattctattacatacacgcttaggcgtcttctcatgtgacatggttttcagacccttcactcttcctggttgtcctcacgtggatggttttttcatgttaatctttatgtaagacactacatttgaatgtgatgctccacatggggcccaaatagaagacaattctcttcctttaagcagaatctctgcttgtcttaaagggcctgagattatattattttttttaattataggattcacactgtcccctagtgaatttacagtttgcaaattgcctttttgaaggccttacaatcagattgcttgctcctcactgtctgtgtttattcttttagcttcttcagatcttttagtctgaggaagcctggcatgtgcaaatgaagttaacattttgttttaaagcctattgtgtattttttaaaaagacctcttgaaatcatttaatataacagaaaaatattgcacacaagacacttgcaagacaaagagctagtgttcctgtcactttcagatatttcaaagacattcactggtcaataatttatctagattcctttttttatacttagtgtatcttccaagtaatcgcttcccccattgcaaagaaaccactttctacagagggaagagaggcagaatttcatatctccataccatcatgggaagtacggagttactgagaatttcatacattctgcttgaaacttagaatatttagttgagacttaagtatggccaaacttggggagacggagcgatgagaaagaagtatgggataggcaagtatttgtgctaataacttgcagttgaagagttaagaattacaaacaacatacatgataaaattttagattgacatggctgccatgatgtattgctttatatcctcaagactttgagaaaggcggtataaacatgagattcttggggaatcagtacataaataagttactgagtaattcattttagaaaatgctcagttctggatattagccctttgtcagatgagtagattgcaaaaattttctcccattctgtaggtagcctgttcactctgatggtagtttcttttgctgtgcagaagctcttgagtttaattagatcccatttgtcaattttgtcttttgttgccattgcttttggtgtttcagacatgaagtctttgcccatgcctatgtcctgaatggtattgcctaggttttcttcaagggattttatggttttaggtctaacatttaagtcttcaatccatcttgaattaatttttgtataaggtgtaaggaagggatccagtttcagctttctccatatggctagccagttttcccagcaccatttattaaatagggaatcctttccccattgcttgtttttctccggtttgtcaaagatcagatagctgtagatatgtggcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggcaatgtgggctcctttttggttccatatgaactttaaagtagttttttcccattctgtgaagaaggtcatcggtagcttgatggggatggcattgaatctataaattatgttgggcagtatggccattttcatgatattgattcttcctacccatgcgcatggaatgttcttccatttgtttgtatcctcttttatttccttgagcagtggtttgtagttctccttgaagaggtccttcacatcccttgtaagttggattcctaggtattttattctctttgaagcaattgtgaatgggagttccctcatgatttggctgtctgttttctgttattggtgtataagaatgcttgtgatttttgcacattgattttgtatcctgagactttgctgaagttaggaggagactttgctgaaggagattttgggctgagacaatggggttttctagatatacaatcatgttgtctgcaaacagggacaatttgacttcctcttttcctaattgaataccctttatttccttctcctacctgattgccctggccagaacttccaacactatgttgaataggagtggtgagagagggcatccctgtcttgtgccagttttcaaagggaatgcttccagtttttgttcattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgttgttagttctgtttatatgctggattatgtttattgatttgcatatgttgaaccagccttgcatcccagggatgaagcccacttgatcatggtggataagctttttgatgtgctgctggattccgtttgccagtattttattgaggatttttgcattgacgttcatcagggatattggtctaaaattctctttttctgttgtgtctctgccggactttggtatcaggatgatgctggcctcatcaaatgagttagggaggattccctctttgtttattgattggaatagtttcagaaagaatggtaccagctcctccttgtacctctggtagaatttcaaacaaatttacaacaaaaaaacaaccccatcaacaagtgggcgaaggatattaacagacacttctcaaaagaagacatttatgcagccaaaagacacatgaaaaaatgctcatcatcactggccatcagagaaatgcaaatcaaaaccacaatgagatactgtctcacaccacttagaatggcgatcattaaaaagtcaggaaacaacaggtgctggagagcatgtggagaaataggaacacttttacactgttggtgggactgtaaactagttcaaccattgtggaagtcagtgtggccattcctcagggatctagaactagaaataccatttgacccacccatcccattactgggtatatacccaaaggattataatttatgctgctataaagacacatgcacatgtatgtttattgcggcattattcacaatagcaaagacttgaaaccaacccaaatgtccatcaatgatagaccggattaagaaaatgtggcacatatacaccatggaatactatgcagccataaaaaatgatgagttcatgtcctttgtagggacatggatgaagctggaaaccatcattctcagcaaactatcacaaggaccaaaaaccaaacactgcatgttctcactcacaggtgggaattgaacaatgagaacacttggacacaggaaggcgaacatcacactctggggactgttatggggtgggggaaggggggatggatagcattaggagatatgcctaatgttaaatgacgagttaatgggtgcagcacaccaacatggcacatgtatacatatgtaacaaagctgcacgttgtgcacatgtaccctaaaactttaataaaaaaaagaaagtgctcagttctttttcaatcaccttgtatattaagtttataacattcagcagttactcaactgtctattatgtgccaggcataactctgctgaggattaggggcatagtccttgtgatcattcaaagtgattattttttatcttccatactatcttcattcataagcaattaaatagcttaatttattctcctgctgtgaaaatttggaaccaagacaaacaggttaaataaattcttgcttactgtactttcaatattgataatggatttaagggcaatggaaacacctcagaagaaaaatttgtctggactaaatgaggagacttgaactggaggtagataacacatgttaaagtgcatattgcacaggatggaaaatgaagcaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaaatgaagcaatttatgtttaaagttcatagtgtctttttaaacaacaagaatggaatactattctttacattggacagggaataatttactgtttgtgtgctttatagcacacaagtttacatatattaccttccaagcagtaataatttgatctcaaactctaagattgaatcttagtttaaaataaaattatattgtgttttcaattatactaaaatatttttcccagcataacttactatgatgaggttatctgttgtttttacccatttcccccccacatttatgtcatgctaaggcaagaacatgcccagtttgttggagaggatttcttataatatagttcaatggagtaatgaagtaacttatcttcaataacaaaaaaataaaaacaagtttcagaactttagattaaattttaatctagcatgtataacagatattctaaacttcatgagacatattccaaatttttaaaatgtcctagtttagcatagttaaatgtaatacaatttattttcctctattatagaagtgctaagcacttaatttcattcctcccaaaaagccctgtaagtgtacatcctctcactattttacgaataaggacacaagttcagagaggttaattgcttaatgttacacatcaaattacaagttgagccaaaattcagatttagggccacgtgatttcaaagcttgtaatttctccaatgccttttcatttttatagacttttgctactttcatgccatctattaattatataataccttactagggttagaagaaaagggaaatatggtagatgggaaaagctttttgaattgggtggtggtataggaagaggttagaaagctttacttgcttactgtcaagtggtgaagttgaaggaaaatattgaggcaattatctttacttgctcatatgatatcgggattaactccattgtctcttgatgtttccatagttccttgaagcactattccatcttcattgattacacacatttcccacccatggtaattagctgccacggacagtgctgtagctggtgtactctttttagcacgttccaagggttctaccccagtcagtatatttagtactttcctgcagacattatcctcccactgcttaattgcatgcaaatactcaatgaaaaaaaaaaacccaaacctctatgtatttcttttctattgctgccatatcaaattactgcaaacgaatggcctaaaatgtcacacatttattatcctacagttttttttttttgagatggggatctcactgtgtcgcccaggctggagtacagtggcatgatcatggctccctgcagcctcgaccaccggactcaagtgatcctcctgcctcagcctcctcagtaactgggactacaggcacgcatcaccacacccagcttattattattattattattatttgtagagatgaggtctcgctgtgttaccaggctggtctcaaactcctgggctcaagctatcctcccgtctcagcctcccaaagtactgggattacaggcatgagccaccatgcttggcatattatcttacagttttttcagatcagaaatttggtactggtctcacggggctaaaataaaaatgtcagcaaggctgaggctctaggggagaatctgtttcctgctcattcctgtcattgacaaaattccgttctttgtggctgtaggaccaaggttcctatcatcttgttggctataagttaaaggacaatttcagcttctagagattgcttgcattccagccccattcctccctcgttaaggccagcgacagcaggttgaatccttttcacattgccttctggctcactcttctgccttcctcttccattttttcaggactcatgtaattagattaggctacctggataaaacaagacacgccccatttcaaagttcgtaacctttatcacattttcaaagtctcctttgccatgtaacaacatatccacagattcctggggttaagatgtggacatctttaggaggtcatttgttgtatctacaatactctagttgaacacaatcatgttgggcttacacatgcgttgtagaaagtgttccaattaacccaagtggttctacaaattttgcattcctgtaactaaaccatatttattaatctctggatcagtagttttgttcttgaaaattataatagtttaaacattacataggcagttctcagcccttgcaacaatgatttcctggaaatcttattaaaaagtggaattatccagtaacagaactataatctggggttgtgttgaaaatatcatgaaaacaagtttctcctattagagcttttattgtgctctacattttataaaataggcacaattgttttgattacatcgattttgcaagcatatacaatcatataaaatacagatatgagtgaaattgaagatgctagttatttaaaaactattttttttgaaaattcagtctattttgagatggttcacatagcccaagtctcttattaaaagttaatagtaatagtgctaccttttgaataaaatcatgaaattagttttcttaataaaatttgatgcaacaagcggaatcattcagaataactccactgttatcagagccatttaaaaagtactaaagtgtgtgcatagtacaagttggctgatgctgattgcattttattgcattgaaaaaaatttcaaaggactctacatttctaccttcccaaaacattttcagtttattcaaaagactgttcaaaatcagattgaacataaaggctaccagaaaataatagttaacaaccagaaggtctttgcatgtctctggaaattcaaataatacaggttgttgagaaccttaaaaatcttcaaaacatagtactgaattagctagcagtggcatatgattatgtggttgttgctaatgcactttagtgtttggtgtttggcaggtgcagggggcaaatattgaaattttgagtgtcaggtaacatctactgagtgaaataagaacagttaaataacaggtgaggactgtctatgctactcagtcattgaccattatgtttgattcttcagcaagttatggcctcagaagtggcatttctaaacttggaggtgcatccaggaaagttctgatctcagatctggttaccaaactttctagacattgtctggctcctattatggcaggtgcaggggcttgatggtattttaatttattatttttactttttttttgtagagacaggatattgctatgtttccaagactggtcgtgaactcctagcctcaagctatccccctgcccccaacctgtgccccgcaaagtgctgggattacagacatgagccaccacacttggccttctgatggtattttaaatttaaaaggtttagattgaaaatattgtgttttagagcactaaaatttagagaaccaaatattatgagaatgatgaattggagtggcaagctcagttgagtgtatgtgggcaattgggcttaatttgtgcttatgcgatccctctgtacctaactgcactcccttcttgcttcccacatttaagtctctcaccgcagctgtttctaaaagttctaaatgaacttgcttaatcatttacaagttgccctgtaacatcttttattttcacttttttttctggtttcaaaaatatagagcttttcactgatcaatgagataagaccttgacatcatataatgtgcataattatcttaatcagggttctttcaatccacaagctgataggaaccttagaaatcactcttttggtcataccatttaccttgaaagagaatgtgatattaatgcttgatcacttttcctccatctgtgtacatttgtatttgatgatttaacccagtcttaatttatatttccttttaaaaataccatttcttcaactgcattaaaattaatattaaagaccagctctacaaaatcttaactaggtttctctttattaaatgtgattatatcagagctcttctcttgtctgacagtgaaacatgttcttaattaatagtctgatctagctttagtttgggtggacctacaaaatatttgaaatacaattttgaaaagtatatggatgacactaaattgtgaatcattgtccaatagataaccccttagcatcaccaaattgaagtgattttctcattcgttacgatcactttcctacagagggtgcgtgcatgcagtcatttctgaatgattcacagctaaacaaagttcgtgaaactggaaacaaaggtttggttttaagtagactggagacttggttcattaatatacttttcatagaaatgttgctgaagcatatagatagatacaattagagtgttttttttaaatgatgtgcagtactatcacatcatcaagagttttgactttcttccatataattaaaattgcagattatgtttttgaatagtgaatattgtgtgattgctgatccagccctgcagatagcctgatctggaacaaataaccctttaaaataatagtaaggaaagttgatattatttatttatttttatttggtgcttatatgctaaatatgaactgatacccttatggattagagaaaaaagttggcaatcgttttgttattgtggtttctatgaattatacaacatgatatttgttagtaaagagtggtaagcatttattataattttatatcatttaattatttggaaagtaattgttttttattatcatctcttagcaagcaagtatcctgactgctctttgttttattatcatctctttgcaagcaagtatcctgactgctctttgttttcctatcatctagtgtggtgcctggcacatagcagatgctcaataaatgtcgattttataaatgaatttagagaatagtttttaggtctgtacctctgtgcagatcacttcacatgaaagtgttaagtttattcatctgatatatgcagtaattgaatatagtagttgtcccttatgcatgatttccaactccttggaatgagttacccatggttaaccatggcatgaaaataggtgagtacagtatgataagatattttgagaaagagagagagaaaaagagcacattcacataacttttattaaagtatattgttataattgttctatttattactagttattgttgatatcttactgtacctaatttataaatcaggtagttatgtatgtataggaataaaacgtagtgtatatggaatttggtatatccatagtttcaaacatccactgggggtcttggaatgtatccaccgaataatgggggctattgtgtatcatggtcttgttagagaataagttatgactgtatttcctatgaaaagaactaatcaaaaatccagattctgttcattgttgctgagaaataccatgatactggcacagactgaaagtaattttactagaagcaatctactagtgaccaaaatactttagtcatggttcatcaaattgtaactgataaggaaaataaggtttttttaaaaatctgttctacgatagaaactactctcaaagttaagagttatttgacttatttttgcatgctgttcatcataatggagaaaactatttgagatatttatgttttgaagctaatatgcttttacttaaatgataatgtgttttgtgtgtatagtttgataaaagaaatcactgactaggagaaaaagaagacctgactagggtttaggagaaataaattaaaaattaacactcaaaaaagtatttacatttatgtcctgaattttttatacttaaagggcttcaatctaaccataaaggtttagctgatattatatttaaattaaatgaattttctttgtgttaaaaatgattaaatacaatggcttttacacattacttgtttagcaagagacaaaaaatgcatagctgtgaatatgtaaaagcaatatattccaaagcaaaacaatttgtagtttgtaagtaaatttggattttcgtttgttctgttgtcattaaacaaacatttattgtgaataatttgctggactgtgcaattagttaaggagggtgaggccaggaagccttgacttcaagagtgtaggatttggcttctgttcggcaagcagtgactcactgaatacctttgagcaagggagtgcttttctgagctataaatacaatcacagtatgtataaagaccattatgtatgtgaaaattataattaaatccaggtaagaggtaatacagacaagaactgtggtagaggcagtgagagtggatgggggttgaaggataggagcattctagagagagattcagttgaacttagcagttgattggacatgggaaatggggaagaagcaagggtcaaaggtggtcaaataattttggtgagagcaattgccttttagaatccaaatattttatctatagttcttttgaatgtataatatcaggatacatcggagatttctgaaatttcttctgactgaccaacattttaggaatggtcattaagaaatatgtatgtagtcaaattcattaccattaagcatatctttgacatatgaaaagattggattttgaagatgtaaaaatgatgattgcttcaacaagtatctcatggagatggagtgagtgagggtagtagcattttccgactagctagggaaacttttaacaccttgactccctgctactctcatctacatggtgactcttctccccttttgtctgcttctcatctacactgagagtcagaaattatagtttggggtgtgaaacactggtttaaaggactgtataaaaggaaggaaaggaatacttctcttttttcatttatctcacacagattaaggtaagtacttcattactacttcataattcatagattgcttctgcaaaacacatgtacacacaatctgaaaacgctccagttatcttcaatttaaaattcccatttaaatgaccaggagatttgaatgcttgatgcctactatgtcatttttatcacaatggtatgttctacccaagaacacatagccttcttttagccagagaacatggtgtttctacaaataaacatcttacccctaaagagacaaattccttgatgatttataatttggaatagcccctccccaaatcatcagtctgccttccagaaaaacattataaattttgtaaataatttttaatattttaggtaatgatgtatagttgtgacacataaatattttgcccaaatgaatccttctttagaattactgcaccatggataaacacttatggtagttttggtagagcaatttttgttattcacattagcagagttgtctgtggctagatactgaaattgctctgtgatatggactggaatattatggtgatcttaattaaactggctttctaggagtgtagtaaaatggtggaccctaaaacattttaggtgaaaaaccaggaaccagttctagagctaaagaccacatatatactcttggagtatggtaactgtgaatatgtagataggtgagtgggctgtaagtaacagtgaagactttttgcatctcctaacaacctgagagcttatggccagcaatggatatgtttctttatgggaagcatagtacaaaagggataaactgaagtcttataataaagttttgtggaaaaaaacccttaatggtgaggcagatatgcagaaaagggacaataactttaatgttaaaaaatgatacttagagtctttgcttccattgagccacgtatctgtgatgagcttgaaagaactatcctaagagtgattctcagactcattaggttgagagcctgtcttctttttttgtattattctcccctgtcttaaaaatactggctgtcatattgaaaacgtatgactgatttgatactaattttttcctacattcattgaaataattagagatgactccaggccattacaaaaatcaagactgagatttggtaaatttattacgggctttgaatacatagagtcattgggactcttagggctgccaactatatttcttaaaacatggaatgcaatggttactactttgtgagtcttactcttaggttttttcatgtttccccttaaaagataaataaacattctcttaagacctggtcatgaattactgactttgtgaagttgaatagaactgggaaattcaggaaaggataggattttcaccaccttttagcagttgattaatgaatctcctgttcccaaatcgatttatctcagttatttctaattggttttgagtttgtggaatctgctttaataataaactctaaaattgggtaactcagatgtttgaatatttaataaaaatcttaggaaggtgaaacacagttctttcttaacgtgctttttgattttaatgcaccttagcaaaagagtcaaattttaaagttgatgagctacagataatgggagtaaaatgacaccttggttaacaagtcctctggaagcaaagctcctagaaaattggcctgagcattgaaggggttggaatacccattccagtttcttcatttttggattaaagaaagagaaggcaagctcactgctgcagatatagagacttctcaaagggcaggctgggtgctagctgtagggcgaagcatccttctagagggcctatgcttcaccagaggattgtaactatttcctctgtgcactgggaaggggactcttgacagtgatgggagcacatgctgtttctcctagcccacttctacatattgccatctccctaccaccattatcacatgtgcattctttcacctatgtggttttataaaagcaaggaagatttgaattcacttgtttgtatagaaggtatggaatcaacatttagaaatgcattcatcttctaattatttttaaattacttcattagaaataaaataattatctcattcagaaaatagaatggattcttacataccttatctacctaccattcatccatccatgtatccctttatccatccatccatccatccatccgtctacctatctaccaatctacccatctgcttatcttgctttcacacaaatataagaaatgtggagaatgagaaataatatataaactaagctttctaaatagaaaacatttttggtcaagatgaattggacatgatgcagtttaactggtatataaattttaaaagatgaagggacactaaagtcttgaaatatggtaagcagagggagcaaatattattttgaagttctttaaggacaagattgagatattcagtggaaatgccttttgatttgggtaattaactttcatcctgttatagttatctaatggaatatcatttgtctagcccaattcccttatctacgtcatagtgttatatctgttattgtgatggttggcattagagttcagaatgtgttcttttaaatgttgatatcagtatgtgaaattctccccaaatttcatctgagttattttctaggatttactacctccctaccccataagtgttgggagaatagcatgaaagatttttagtgttggtattgtttttatggaaatagaatggtaaaagtaagtgatcttcagattgaattaattaaaccagaaaattacttgcctataacagaatgtatctctctgatatcctccttgtgcttataaattaagcattgaaatgctaagtgacttatagcctctactgtctgctatttttaattttttaggcttggtataaatgggaacaatgtaggctctggattcagatgtgggttcaaatcatagttactagactcatggtgaggccttaaactctccgagcttcagttccctgtctttattttattttatttttttattttattttattactattatactttaagttttagggtacatgtgcacaatgtgcaggttagttacatatgtatacatgtgccatgctggtgcactgcacccattaactcgtcatttagcattaggtgtatctcctaatgctatccttcccccttcccccaccccacaacagtccccagagtgtgatgttccccttcttgtgtccatgttttctcattgttcaattcccatctatgagtgagaacatgcggtgtttggtttttttccttgcgatagtttactgagaatgatgatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatactcagtaatgggatggctgggtcaaatggtatttctagttctagatccctgaagaatccccacactgacttccacaatggttgaactagtttacagtcccaccaacagtgtaaaagtgtttctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcaaaaattttctcccattttgtaggttgcctgttcattctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccattgcttgttttcctccagtttgtcaaagatcagatagttgtagatatgcggcattatttctgagggctctgttctgttccattgatctatatctctgttttggtaccagtaccatgctgttttgattactgtagtcttgtagtacagtttgaaatcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttaggtagtatggccatcttcatgatattgtttcttcctacccatgaacatggaatgttcttccatttgtttgtatcctcttttatttccttgagcagtggtttgtagttgtccttgaagaggtccttcatgtcctttgtaagttaaatgagttattacaaggattaaataggatactagaatgtgcctggcacagtgcttagtacacagcaggtgctgggtaaatgatcttattcctatgttaaaacagacagaagctatttattaatactgttctattttaaatgtgacagacatatgcatataagaagcctgtgcaatagctttttatagcctgtgcaatagcttcttatagccttggaaagatagcagctattttataaaatctcatctgtaactaaagagttccattagtgaaatgatttcaggtagacaataatatatttatgtcattaaaaaaactacaaataactaacaaaagctttatctttcttgattcctttcaggcaaacacctcattaagaagatatattctttaaacaacaattaatttatgccttattaatagatgttactttcaagctcactcttgttggtatttgaaaaagaaaaaagagagagaagttgctatgatatttataatttctttgtgtaatgatactataaatgacattttagttgggggacaaatctttcaatatttgaaattttaagtttttaatttttttcaacaaaaatgccaggcttattttatatacattagtttacttcatgagttggaaattttgttcccgattttttcaaaacatgttcctttgtttcataatgaaagttgagtatgtgtacactcaaacgtttgtggtatcattcagcttttgtttgggaagtgtggagaaagagaggagtagaaaagctattaatatctttcgaattcaatgcagtatgaatactttgactctatcttaaaaagccaatggaaaatggcttctaccatcttaagtttttaatttatttctcaagggtggaaggaaataccttgacagatttagccctgaaattcaaatgagtatgagaacaggtggtgaaatttcttctccacctgccatgcaactttatcacaagaaatgtttcatttagcaaatgctgctgctagcagacacttctctgtttcagagcagaaaaacaaatggatggaaagtactttgaggaaagactttttcttgattttctttttaaattgtgagtgtgagcaatatgtattttattttcctgggggttgggtagtggatagtcagtgccttgattaaccaacctgttttgttgtgttgttaaaccattcatagctttcttgtttttgttttcattttgttttgttattgttgttgttcctgtataccaacccactgacaccaactttagttaaggtaatattattaatctggggaacttgaaatatctatattatacttttgacactaatgcaagagactttcttttttttcttttcctttttttgagatggagtttcactctttcacccaggctggagtgaagtggcacagtctcggctcactgcaccctccgccccccaggttcaagtgattcccctgcctcagcctcctaagtagctaggattacaggcacctgccactgcgcgcggctgatttttgtgtttttagtggagacggggttttaccatgttggctgggctggtctcgaactcctgatctcaggtgatccgcctgctttggcctcccaaagtgctgggattacaggcgtgagccaccacgcccagcctgggactttcattcttttgttgcagtgaaattgagtttttagcatatattgttagatttaaccttttttggtaatgaaatgatggcagttaaagcactatgaaacaaatgagggaactaaatagaaaagtgttgttcatatacttttacctttctagcttttctctaattcatttcttcttttttcccttcagaaattacaaacagtacaggaaagtgtagagaacagtcttttattcatagcagtatcaagatgttgctttttatttgatgtgagctagacattaatgtaccagtgcatgaattggcacacataacctctctaccaagaaaagttaagtgcttttattgtgttttcatgatgataatctcaagaagcaccaaaatgttcccttttccttgacaatgaaatttgaccacacctgggtttctgtataacatgaactgctatttgcaatgatagaaaccaagaaattgaagtacacattttataattgatcaagatgatatcttattttttaaacacaatggtactggtttcagtggattgtcgtgggatttatttaggtatggagattgaggagcattggaagattatttgtggcttttgagtcaaatgatgcaattaagagatgctttttccttcctcatatagcattccaacaaacatatttactataatgaattctaagagtatatggttctctatagaacgtctaccaaattaaacctctacagagggattcactgaagaaaacacatttaagtcagatcagcagagcactcttgctttggcccacctaccaggacatagataccaggacacaattcttcattgtcatgttgcttgctattaaaaaaaaaccacatttgtccatttagtgagttttaaatttcctttgaaaaaatccatttggatgaacaattctatgcagacagtagtaggagtttatgacatgtttgcactagcaattttgagagtatatcttgtactctgataattttgcaggtttaaagatagaatctttgtgcatattctggaatactgatgaggttgaacatttttgtatctgctaaccattggcaccttgatctttgtgaattgtgtgctcatatcacttacatgtttccgttcgggtaattttaaatatgtggacatttcgaggcaagattacaatgttggcagccctttgttaacatatgacaatggcttaggctttttttccttttgtctttaaatgcagtgcagagaaatgccacagtctgtgtatgtttggtttgaccacgtttacaatgctttcagtaaaatggtcagacagtgcctccatctctaagctaatactcatcaaaaaagtagttgttttctttgagcaagcacagttgagtgattcacgtacactttgtgaaagattgctcttgtgctttatggttggtcattgtttcaagaataagacgtctgctgtggtgattgggtaggcggggggtggcatgcaagcaatatgcagactataatattgtagggaaaagagaggtttaatttttagaaacaaaattcgttaatatagtctctcccatgaataatcttgtagggctggtgaaatgggactatttagacagaatttgccagattctaacttaacatgtaaaagtggatccaaataacaactgttttatgcagatttaggaaattattattcttacatgagcttatgtaaaacaaaagctttgctgcataattttcttataaacttcaaagccattatctacttttttactcttagacttgagttttcaaattgatgggcctgtggagagcagagatattctgttaggtagccttggaagaattagtgataattaataatcctgctgtgtttcatattgctagcattacctcatggattcaaccctatgactgggaaattatttaaatcatgaaattgcttgagaaaaattttcatgagacagtaaattcctctatattaggatttctcacctttggcacttgacttttttgcctaagaacagctttgacctagagaactgtcctgttttgtaggatgtttagcagcatccccagttgtgacagtgaaaaatgtctgcagacattatgaatcatgggggtggaaggaggggcaaaatgcctcctgctccccctccccacattgagaatgacttgtatgtatattgtatttaactatatgagttgaaaaaacatcagattaaaaactgttattttttttcttggaattactcagataatcattcctttaagcatagattgatataattgtggcttggggtttgcagagaagtgttacctccttgcaatgttgaagaacagtgctcttcacattcaatcaataaacttaataaaggggagatagatgggaatattgaatctgctaagaaggttaacatggcatgtactgttaccaaagcagaaattagtagggagtgttttgaatgttaaaaagtcaaaagatactgataaaacatcatgaaaaagataattttagtccaggcttcttcagcttttgaagtaattaattaaaaaggcaagcatattatgttggcaagaaagggctgcattttcactttttgctttctgtttttaagagcaagagacaaatgacaaagtaaataagttgttacttgtagtttactcaaaaaagcaatttccgggatatgtcattgtggcaatgtgaattcagctttactcctatcccttttacatctgcagtttcataagaatgataattgatggtcatttaagcactgcataataaagaaatgtctttggaatgatctacagaaagaagattctgtattcattcagaggacatatattaagtctttcgtgctaggctctgtgcagggaatacagaaactaataaaacagtctgcttgaatatcctattaatataatctggatgaatagacattttctggttagggataacagtcaccatcaatcaatttctgacttttccaattgattctgtaattttaaacgtctgtccacaaaagttgtttaaaattgtgtgtgtgtgctatatatcataaatataacttaattctctttaaagctatctctgaaactctggtggaaggctatatccagtttcttttatgctttttaaaatcttaagttattctcttctttattaaatatctatcagaattgaattaaacatggttatatattattaattcatttttggttatactatggctctaatatcattaagaagaattgatgtcatccttaaggccagaatttttgctaattattgcaagatttaaaaccacttagttggtgtcataattcaaaaagcagaatctttagtatggtctttttcttgttaaaactgatcaacttggggttttaggtatgacaggaaaaaaaggtgaaacctttctgatattggatagctcagttagacagttagaaaagcaaataattcaaaattgaggaaattacagaaaaaatgaagagttccagcacttgaaaatctgctctccttcttttttcctaatgtctattttagcagtctttttagcagtctgtatcatgaatgcagaaccaaattcatgagccatgggctccccactcttaggcaggtgatccagagattattttagcaatgtatacctatggagaaacacaagatctcttctaaggaatgatgaaaggttattaataatggcacatttttagtataacctgagatttttaaactatcaaatgtattgtcatattctctttgcatctaagtgacctactgactaaggttctcctattcttacttatgccccttgaaaatactattgctgcaatacatgcaaatacagaattgcctgtatttatatttttagtattcatttctttgaaaagatggaaatgtgactagattgtagctattaaacaatcccaaactggtaagtgagagatactgctagaaaaagaaattatatcatgtgaaaaattttgttcagttggggttgattagaactactactaataacagaagataaagtaatgcattaatatataacaattaatcttttacttttattaatgggggtttggagtgggaatcagactagacctagattcaaaccctgggccaaccactttaataagtggtttctgacccttctttagtctgtgtataaaattattggcaagtacctgctatataatgactattcaataaatggtagctatcatttttatcttttcaaaattaggtgttccaaattaattttaactatatgcagcataatttgatggcattgctatctaaatagtaacatatcaacagtaattactgtggcctttaaaaactctgtgactataattttgaaccaccttttaagttgatttctcagttatcatctgtatattctgtacttggaaaccattttacaaatatacatttcttctaagataaagagtggtacaagcgtataatatagtgaaacaatattcaccatattgcatggtcatatgattgcaatagtgactgattatttttctaaataatctcattgtaaattgtacaagttttaatttccccttctttcttatgtaaaaaaactttcagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacaggtaatttaagctgtctctttggtagtgtttacgtagctttaaaaaacccaccatggattttgtgatgcaggatgtcagtagtggaggaggttgtgggtgtgtatgtgtgaataggaaatgtatggtaactattttttgctcagttttgctgtgaacccaaaatggctctaaaaaatgaagtttattaagtaaagaaacaaaagacaaaaactaaccaggagagaaatcttgatggaggaatgcacacattcctgaggttaaaaaatcctcagaatcaattttttgtttggtttgtataaaggacattttgccagtatgccactttcttacagaataccatatctgatttcattccatagcaatcaaagtaagtattacaaggtccctacactgaattttcctagttcctcattcacagcctgttttactatcatctttgtaatggttctaaagattatatttatttggtgtcccaactcgcattggtagtagtaactgtgggagaagaggttaggactgctggatgcaaaccctctgatacatgtaataagtaataactaaaataaaagcaggggacagaaacacagtagaaagccaaaagaacatgaaacacagcaatctggagctatttagcacggggattagaagcttaagtacttctgacctttgtggacattttctgacttctgtgggcattgctgaattagagagcaatatggtactggatgtccattaatgtcttctaaagatagttaaattatattggtcctcttactacccttaataagataaggaaaatttgcctttctaaatgcatatttaaaagaaatctccccagatggatttcatgcatatccctgatcaagaaccattatagtaaagctgtatatagaatataatataatgagggacaaggtttatacttgctgtgcatcctctgtgtttaaatgtaatttcaccggatttcattttccttatctccaaaatgtgactcttgactagcatacctctaaatttcctgctagtttcaatctttgaattcagtaaaatcccatttccccagtatttccgtttctaattggagctggggtctatctaaggttcattgtcctgtgggtcatcaatagatatgtgagtcaggaacgagaatctttccatctcctggcatcttaaagctgtgtagggaaaagggaagatggccgaatagaacagctctggtctgcagctcccggcaagatcaacgcagaaggtgggtgatttctgcatttccaactgagcccccactggtgatacccgggcaaacagggtctggagtggacctctagcacctctagcagatctgcagcagaggggcctgttagaaggaagactaacaaacaagaaaggaatagcatcaagaacaacaaaaatggcatccacacagaaaccgcatctgaaggtcaccaacattaaagaccaaaggtagataaatccacaaagatgaggaaaaactaatacaaaaaggctgaaaattccaaacaccagaacacctcttctcctccaaaggatcacaactcctcgccagcaaaggaacaaaagtggacagagaatgagtttgacaaactgacagaagtaggctttagaaggtaggtaacagcaaactcctccgagctaaaggagcatgttctaacccaatgcaaggaagctaagaaccttgaaaaaaattataggaattgctaactagaataaccagtttagagaagaacataaatgacctgatggagctgaaaaacacagcatgaggacttcatgaagcatacaaaagtatcaatagccaaatcaatcaagcagaagaaaggatatcagagattgaagatcaacttaatgaaataaagcaagaagacaagatcaaagaaaaaagaatgaaaagaaacgaacaaagcctccaagaaatatgggactatatgaaaagaccaaacctaagttagattggtgtacctgaaagtgatggggagaatggaacaaagttggaaaatactcttcagggtattctccaggagaacttccccaacctagcaagagaggccaacattcaaattcaggaaatacagagaatgccacaaagatactcctcaagaagagcaaccccaaaacacataatcgtcagattcagcaaggttgaaatgaaggaaaaaatgttaagggaagctggagagacaggtcgggttacctacaaagggaagcccatcagactaacatcagatctctctgcagaaaccctacaaggcagaagagagtggggaccaatattcaacattcttaagcaaaagaattttcaacccagaatttcatatccagccaaactaagcttcataaacaaaggataaataaaatcctttacagagaagaaaatgctgagagattttgtcactaccaggcctgccttataagagctcctgaaggaagcactaaatatggaaagaaaaaactggtaccaaccactgcaaaaacataccaaattgtaaagatcattgacactatgaagaaactgcatcaataaaggggcaaaataactagctagcatcataatgacaggatcagattcacacataacaatattaaccttaaatgtaaatatgctaaatgccccaattaaaagacacagactggcaaattggatagacaaggcccatcggtgtgctgtattcaggagacccatctcacatgcaaagacacacataggctcaaaataaagggatggaagaatatttaccaagcaaatggaaaacaaaaaacaagcaggggttgcaatcctagtttctgataaaacagactttaaaccaacaaagataaaaaaagacaaagaagggcatttcataatggtaaagggatcaatgcaacaagaagaggtaactatcctaaatatatatgcacccactacaggagcacccacattcattaagcaagttcgtagagatctacaaagagacttagactcccacacaataagagtgggagattttgtcaccccactgacaatattagacagattaatgagacagaaaattaacaaggatattcaggacttgaactcagctctagaccaagcagacctaatagacatctacagaactctccatcccaaatgaacagaatatacattcttctcagcaccacattacacttattgtaaaactgaccacataattggaagtaaaacactcctcagtaagtgtaaaagaacagaaatcatagcagtctctgaaaccacagtgcaatcaaattagaactcaggattaagaaactcactcaaaaccatacaaatatagggaaactgaacaacctgctcctgaatgactactgggtatataacgaaattaaggcagaaataaataagttctttgaaaccaatgagaacaaagacacaacataccagaatctctgggacacagctaaagcagtgtttagagagaaatttatagcactaaatcccaataggagaaagcaggaaagctaaaatagacaccctaacatcacaattaaaagaactagagaagcaagagcaaacaaattcaaaagctagcagacgacaagaaataactaagatcagagtagaactgaaggagatagagacacgaggaacacttcaatatctcagtgaatccaggagctggttttttgaaaagatcaacaaaatagatagaccgctagccagattaatgaagaaaaaatagagaagaatcaaatagacacaataagaaatgataaaggggatgtcaccactgatcccacagaaagaaactaccatcagagaatactacaaacacctctatgcaaataaactagaaaatctagaagaaatgggtaaattcctagacacatacaccctcccaagactaaactaggaagaagtcgaatccctgaatagaccaataacaagttctgaaattgaggcagtaattaatagcctaccaaccaaaaaaggcccaggaccagacggattcacagccaaattctaccagaggtacaaagaagagctgataccattctttctgaaactattccaaacaatagaaaaagatggaatattccctaactctttttatgaggccagcatcatcctgataccaaaacctggcagagacaacaaaaaaagaaaatttcaggccaatatcgctgatcaacatagatgcaaaaatcctcgataaaatgtaatccatcacataaacagaacaaatgacaaaaaccacatgattttctcaatagatgcagaaaaggcctttgacaaaattcaacacaccttcatcctaaaaactctcaataaactaggtattgatgtaaagtatctcaaaataataagtgttatttatgacaaacccacagccaatattataccgaatgggcaaaagctggaagcattctctttgaaaactggcacaagacaaggatgccatctctcaccactcctattcatcatagtattggaagttctggccagggcaatcaggcaagagaaagaaataaagtttattcaaataggaagagaggaagttaaattgtctctgtttgcagatgacatgattgtatatttagaaaatcccatcatctcagcccaaaatctccttaagctgataagcaacttcagcaaagtctcaggatacaaaatcaatgtgcaaaaatcacaagcattcctatacaccaataatagacaaacagagatccaaatcatgagtgaactcccattcacaattgctacaaagagaataaaatacctaggaatccaacttacaagcgatgtgaaggacctcttcaaggagaactacaaaccactgctcaaggaaataagagaggacacaaacaaatggaaaaacattctgtgctcatggataggaagaatcagtatcgtgaaaatggacatactgcccaacgtaatttatagattcaatgctatccccatcaagctaccattgactttcttcccagaattagaaaaaagctactttaaatttcatatggaaccaaaaaagagcccgtgtagccaagacaatcctaagcaaaaagaacaaagctggaggcatcccactacctgacttcaaactatactacaaggctacagtaaccaaaacagcatggtactggtaccaaaacagatatatagacaaatggaacagaacagaggcctcagaagtaatgccacacatctacaaccatctgatctttgcccaacctgacaaaaacaagcaatggggaaaggattccttatttaataaatggtgttgggaaaactggctagccatatgcagaaaactgaaactggaccccttccttacaccttatacaaaaattaacttaagatggattaaagacttaaacgtaagacctaaaaccataaaaaccctggaagaaaacctaggcaataccattcaggacacaggcatcggcaaagagttgatgactaacacaccaaaagcaatggcaacaaaagccagaactgacaaatgggatctaattaaactaaagagcttctgcacaccaaaagaaactatcatcagagtgtacaggaatcctacagaatgggagaaaatttttgcaatctgtccatcatacaaagggctaatatccagaatctacaaagaacttaaacaaatttacaagaaaaaaacaaaccaccccatcaaaaagtgtgtgaaggatatgaacagacacttctcaaaagaacacatttatgtgtccaacaaatatatgaaaaaaaagctcatgattactggtcattagagaaatgcaaatcaaaaccacaaggagataccatctcatgccagttagaatggtgatcattaaaaagccaggaaacaacaaatgctggagaggatgtggagaaataggaacacgtttactctgttggtgggtgtataaattagttcaaccactgtggaagacagtgtggtgattcatcaaggatctagaaccagaaataccatttgacccacaatcccattactgggcatatacccaaaggatttataaatcattctactgttaagacacatgcacaggtatgtttattgcagcactgttcacaatagcaaagacttgtaaccaacccaaatgcccatcaatgatagactggataaacaaaatgtggcacatacacaccatggaatactatgtagccattaaaaggatgagttcatgtcctttgcagggacatgcatgaagctggaaaccatcattgccagcaaagtaacacaagaaaagaaaaccaaacaccagatgttctcactcataagtgggaggtgaacaatgagaacacgtggacacagggaggagaacgtcacacaccagggcctttcagggggtggggggctaggggaggcacagcattaggagaaatacctaatgtagatgatgggttgatgggtgcagcaagccaccatggcacgtgtatacttatgtgacaaacctgcatgttctgcacatgtatcccagaactttaagtataaaaaaaaaataaatccctctaatcctctaatatatgaaaacgagtcttcggctatttttgtttgttatacatatgaggatagatttttaaggtgctcaaaaaaaagctgtgtaaatggtttacttgttgatttttcaagttatgggaagagagaataaggggtcaaacagataggaaaagtatgtgaggaagaagtgtttttggtatactaaagtgctctcgctaaagaaaaataagaaatacctcactactatactcctacctaatgtaatgcccatagtagtcatgagttaaagccaattattgtggtcctgctaatttttaaaatttactagaaaccgaacaatgattgccactgtagtgcagtgagagatatttaaagcaatggttctcaaattttagtgcatgtcagaatcatcaggagggcttgttaaaacactgaacgctaggtcccaaaccagaattttttaataaaaaactctggggataaggcccaggaatttgcatttctaacaagtttctagatgatgctgcagatcaaggaacatagttttaagaccattgttctagaggtgggaccttcttccaccgagtcatggccttttcttttctccctatatattttatggaggttataaattattgttacaatggataaacattagagataacttaaatatctatcagtaggtgaatcgttgcatgaaatatgttgcaccaaaactatgcaatgctgtgcagccaccaaaaagagtaatatctgtacatattgaatggaaagaatataagatactaaaaaaaagtaacagggaaaatgtgatacatccatacaatgtaatatgatccagctattttaaaagatgaagtactaatacatgctatcatatggatgaactttgaaaacattatgctaattgaaagaggctaatcaccaaagtccgtgttttatgtgatttcatgttttatgtgattccatttgtatgaaatgtccagaataaagaaatctatatagacgtaaagtagactattggttgcttacagctagggaaattggggggatatgagagtgaaagctaaaggtacaggatttctttttgcagtgataaaaatattctaaagttgactctggatatcattgcatatatctgtgaatatactaaaaccattgatttgtgcactttaaatgggtaaattgtatggtattcaaattgtatctcaataaagctattaaaaatgtaacaaggcaatatgtattgtataatcctttttatcagtagaaaaattatacaatatgtatacacatgaatgtgaatgcatagcaaatggtatggaaacactagggaagctgaggaataatgtcatcttttgctctgtaaaatcctataatgtttaatttttatttacaatggaaatatttttctgcataacctctgtaataaaaaaatatataacagctgacaaaacaagtgtaactgggtctcagagcccttagctctgccatgccttagctcattggtccaggctgagaaagaacagtgatgtgaaagtaacctgaaattttgtgttacttgaagataatttttcttcaactgattttttatgttgttacaatatttcctgtggtaccatagagataccactctatgttgctattaaaacccttctatgctctatttaaaagtctattaaaaattatgttttcacaaattgagatttttaaggccaagcactaacagggaacatttttgtatcaatcttaggtgtggtgttgtcaagagaacaagctagagaagtgtttaatgtgtaaatgttatcattgttttaaaattagcaataacacatactccggcttcaaaaggcattgaaagtagctgtcaggggaactgatccatggggagaaactgttgtaataagcctcactctgcaggattacccactgccaaattgtagtgagaaggacatgggtttcagccaaaactagaattctaatcgtgccccttattagctagttatgtgactttgggaatgtcatttatactctctggcccagctttttttatttgtaatctgggtaagagatttgaggattaagtgtcacaatttatggaaataaggtgcataataaatattcatttattttccttccacttgaggtaaatggagaaggtctcacagggaatagagctgatcagaagttatgggtataccacagggaactcctgagcccctgcgtcattaatggaccaggctctggctatgggatgtggttcctctcagactagggtctttcctctttctctttaagtctcacctagacagagcagaacagtgagggtaggagtcatggtgtctcccactggataagattgggcagatggatgaggccacttattttctgccaggactattgaagaaaacagaaaatagttaatgaattaaatgattatgtattaatatgtgattatataataaaaaaagaagttatgggtataccgaataaggtgtccatctggttggcttgagcaggcggttggcttgagcaggtctagcaggttactcatctccattaaatggcttcagcaaactaggctgtcaaagaaaattcctagaaagtcatttgatacctaacaggcttggattcctagaatcttgaacaagttccaggataatccatgactgagttggcagggcaaatgacttttactcaagtaagaaagattaactaaggttagcttaagtagtgattggtaaaatcaaggattatttcatttccctcactccttggctactactacatctgtggttatttctcatggaaaccttctattctttcacttctccctattattccaggttgtcagcatctttctcttactgtcctatcatatggtaattcactgaatgataactttcctagcaccttcagtttttaaaataatagctttattgagatatgattcacataccatataattcacccatttattgtgcaaatcaatggcttttagtatattcacaggattgtgcaactgtcaccacaatcaattgtagaacattataatcacctcaaaaagaagcccatatttgttagcagtcactccccagttgcccccaactcttttctcaatatggcaactgattggtttggctctgtgtccctacctaaatctcgtgtcaaattgtaatctccagtgttggaggaggggcttggtgggaggcaattggatcatgagggtggatttcccttttgctgttctcgtgatagtgagtgagttctcaagagatctagttgtttgaaagtgtgtagcacctcccccttcactctcttcctcctgttctcaccatgtcagatacgcctgtttcaccttccgccatggttgtacgttttctgaggcttccacagccatgcttcctgtatagcctgtggaatgatgagccaattaaacttcttttctttgtaaatgaccagttccaggtatttctttatagcagtgtgagaatggattaatacagcaaccatttatcttttctctgtttctgtagatctgtctattctgagcatttcatataaatggaatcatacaatatgtggtcttttgtgactagtttctattacttaccataatgttttcaatgttcatctatattgtggcatataacatgcttccttcctttctgtgttcaaataatattccattgtgtagatattttgtttatgtatccattcattgataagcatttttttcatacattttggcttttatgaataaaagctatgaatattcatgtgtaaatgtccgtgaggacatgttttcatttctttttggtatataccttagagtggaattactggatcctatggtaattctgtctaattttttgaagaactgccagtgttttccaaagtatctgcaccattttatattcacactggcagtgcatgagggttttaatttctccacattcttaacagcatttattaactgtctttttaaaattattatagccatccctgtagatgtgaagtagttttgatttgcatttctctgattgctaatcatgttgaatatcttttttttttatgcttatggccatttgtatgtgattctggaagaaaaaaaatcttattcttgttctgtgccaagtcaccaggaaagaagaaaacaaaccaaaacaaaagaaaaagaaatcctttacccatttttcagttgggttgtttatctttttattactcagtagtaagggttcatacacacatatatattatattacatatatgtgtatatatatattttacatatatatgtattctagatacagatcccttatctgatacatgatttataagcattttctccaagcaccttcagctttatggtcccttcttgttctgctaattgctttgccattctccaattctttatccattcagccatataatctttgcttctgtattatcttggcaaagttagtaggagagagggtcaaggaaaatgcctagaagggtttggatttttcactattccctaaacatatattgtgtgttcatatgccagtgcatttgtacacattacctctccctggaatgcccttacttcacttttcctgtctgataaacctcaatttatttataatgacctttctttctttttaaaaattatttatttttagtttagattcagggggatgtgtgcaaatttgttacatgggtatactgtgtgatgctgaggtttgggcttctaatgattccattgcccaagtagtgaacatagtacccaataggtagtttttcagcccttctcccatttctcccttcctccttttagaatcccagtgtttattatttccatttttgtgtccatgtgtacccaatgtttagctcctacttataagtgagaacatatagatattttagtttctgtttctgccttaatttgcttgggataatggcccccagcagtatccatgttgctgcagaggacatgatttcattgttttttatggctgtatagtattccatggtgtatatgatccatcttaaatggatggtacctcttctgttaaacttttcttgacccaagcagagttagtagcttcttctattcatacattttatctgttataaatatcacctatcagtgagctcctcaaggtctaggatctaagttgttgtttctgtatgcctatgatcagtacatgatgctgcttaataaatgtccaccttttgtattattaacatactagttatcattaaaagagatgctactttgctataaagaagctttttagtttgatgtactctcatttgtctatttgcttttgttgcttctgcttttgaggacctattaaaaaaatccttgcccagcctaatttcatgaacatttatcctgtattttcttctagtagtttcaaagttttggattttacttttaagtatttaacctatttatagttggtttttgtgtgtggtgagagactaatttcattcttccatatgtggatatccagttttcctggcaccatttattgaatagactgtcctttcctcatgtgtgttcttggcacctttattaaaaaaatcacttggctgtaaatacatggatttatttctgggttctctgttctgtcccattggcctgtgggtctgtttttatgccagaatcaggatgttttgtttactatagctttgtaggatattttgaaaccagacagtgtaatgacatcaatttttttatttttgctcatgattgctttggctcttcaggctcttttgcatttccaaatgaagagacaacctacagaatgggagaaagtacttgcaaactatgcatctgataagaagttaatatccaaaatgtataaggaactcaacagcaaaaaaaaaaataaattatccaattaaaaatgagcaaaagacctgaatagacatttcatttctcaaaataagacatacaaatggccaacagatatatggaaaattacacaacaacactaattatcagagaaatacaaatcagaaccacaatgcaaaatcatctcatctcagttagaatggttattataaaaaaggcaaaatataacaaattctggtgatgatgtggagaaaagggaactcttaaatactgttggtggaaatgtaaattagtacagcaatgataaaaaatagtatggaagttcccaaaaaactaataatggaactaccatatgatccagcaatcccattactgggtatatatccaaaggaaatcagcatgttggagagacattggcacattcatgtttattgcagtagtgttcacaatagctaagacgtggaattaaactaaatgcttgtctacaaatgaatggataaagaaaaaaattttatatctacatctatatataaatgtgatacagatagatagatacaatggaataccattaaggaataaagtagaatgaaatcctgtaatttgtggcagtatggatgaacctggaagacattatgttaagtgaaataaatcaggcaatgaaagagaaatactgcatgttctcactcatatttggaatctaaaaacgttaatctcatagaagtagggtaaaatagtggttaccagagactggggagggtaggggagaggagaggactgggaaagattggtcaatgagtacaaagctacagttaggaagaataaattttggttttctgttacacagtagggtgactatagtaaataacaatgtaatatatatttcaagaaagctacaagagaagattttgaatgttattgccacaaagccacaaagaaatgataaatattgcagatgatggatataataattaccctgatttgttcattatactatgtatacatgcattgaaacatcacattgtaccccataaatatgtacaattattatgtgtcaattataattaaaaattaaattttaataagaaataatacatataaagagcttagccctgggatagagaaagtgctcagtgtctttttaatgctattattgatgttgtttgtgaaataaattaatttggatggcagcttataaatcactttcatatatactttcctcattgatacttgaaaaaaatgctatgaggtacaaaaggcaagaattgttatctccattttatagataaggacgctgaagctcagggagattaggaggcttgcccaagttcacatagccagtaagtgataaatactgagacagatttgatgatggtgtagttttgtatttttatttctactagtcttgctctaaattgtcttaccttttaaaatacaatgtctataaatattgtgttcattaactataaatgtaaaaacatgtattagcaaaggctaaaagatagtttggaatgaatgatataataaatattttattcttgatagaaacagcagaattacacagaatgtcttcttgctggcttgcctttcttccgttcacctactgaaaagagaaaaaaaaaatcagggagaaaaatgttaactgccagttgaaaacatccctttcatccttaagacctggaggccataacgagggtatcatgcttcagctggtggcagtgtatattaattacagaatacttaggtatatggaaacaaatcatttcctgattactggcgatactcaaacctataaaggtggaaaatgcctcgttactctggctatgtgggcctctagttgatattttctcattttaagattggtgcctattggactgctctttttgtgttttcctcacttatagctatttactttctctcttcatttttagttctaaagtcaatgtaggatatcattttatagtcttatcctctagctaatagaatgttaaagaaatgggttattgtaagagcctatacagattaacacgtgttgcctttccctgggttaatttctctgaatgtttatcctgaggtaaatgcttgggttgctgataatgtcatgttgatgaagtatatccttttttctcaacattatgatcataaaataaacaactttaaaaatataatgttagtacgttgttaacataagaaacaggcataatgattaagataatttacattttataaaataagagttcaaatagtctagattcttgtggtttttatgaaaatgatacttttaatttcttttcatttcctgaatggcagctagaatatagggaaatgagtccatagtttttcttgggcatagctcttggggcactcaggttggggtacaataagttattcttattcttcgaattgactgtgcatctttaggataaaagttggaagactgtctgccgctttccctttttaggccacttcagtgtgttcttgtcctgctctctcaattgagtatttttggttatttgctagtgtcgaagtgatagagagggctatcacataccaacttgaaagtcaactatgctggaatacataatttgaatttctgattgttgctagtatacagtaatacagtttgttattaattattgatctggcattgtgcaaccttggtaaactgacttatcagttctagcagcttttttggtagattctataggttttcctatataggcaatcattttgcctataaataagcctgcctgcctgcctgcctgccttcctgccttcctgccttcctgcctgcctgcctgcctgcctgcctgccttccttccttccttccttccttccttccttccttccttccttccttcctcccttccttccttccttccttccttcttccttttcatcctttcttgccctccctttcttttctttcccctttcttcctttctttttctttcctcttttcttttttctttccagtctgatgccttttttttccttaccttattgcactggataaaacctctagaaaaatggtgaaagcaatcagtctttcaccattaagtatgatgttatctgtaggtttgaggaagttctctcgtattcttagcttgctaaaaatttattttaattttctaatttttttttgagacaaggtctcattctgtcacccagactggagtgcagttgcatgattttggctcactgcaacctcctcccaggcacaagcaatcctcctacctcaggctccagagtagctgggactatatgtgtgtgccaccacactcgactaatttaatttaagttttttttttttttttttttttttttgtagagacgatgtctcactatattgcccaggctagtctcaaacagctgggctcaagcaatcctcctgcctcaacctcccaaagtgctgggattacaggcatgagccaccacatctggcgagtttacttttttaaaaaaacaggaatggatgttggattttgacaaatgccttttttttctgtagtcattaagaaatgatcttagcatttttctttttcagtctgttagtatggtgatttatattgattaacttttgattgtgaaagcaaccttgcattggagttataaactcttcacttggtcatgatgtatttattattcttatatatcagtaaatttggcttgttaaaattttgttgaaaatttttacatctttgtgcccgatggattttgatcttggctttctgtgattgtcttgtctggttttagtattagaataatgctggccatgtagaataacttgggatatatgctctcctcctaatattctggatttgtttgtggggtattggtgttctttcttccttaaatgtttgatagatttcaccagtgaaaccatttcatcttagagttttccttggggaaacaattttaaattaaaatttaattttatagtagacatgtagctatttagtttatctgtttcttctaaaactttagtagcttgtgtctttcacagaatttgtccatttaaactgagttgtcaaatttattggcatgaagttgttcatatttccttattatccttttaatacttatagaatctctagtttatgccacttctattcatcctggcattggtaatttgtatattctctctttttctcacctaatccgtcttgttagagttttgtcagatttatggatcttctcagaggaacagcttttggtcttattgctttttctgtttttctgttttctatttcattgatttccactatgatctttattattgcaattctcctgcctaatttgggataaatttgctcttctatttctagttttttaagaaggaaacatctttcataggaggtgtttcttcttttttaatatagtcattgactgatataaatttcccctaagtagagcttcatctgcactccacaatttttgatgttatattttcatttagttcaaaatgcttacgagtttttcttttgatttctttatgggttatttagaagtatgttttagtttcaaaacatttggggattttccagagatttttctatttttgatttctaatataattaagctggggccagagaacatattaataatttgtatgacttgaatccttttaaattttttaagactagttttatggcccagaatatgatctatcttgtaaatgtttcacatatacctgaaaataatttgcatcctactgttcttcggtgaagtattctgtaaatgccaattaggtcaagttggttgatagtgttgtttcagtatccttgctaatttctgtatatttactggtttttgtcacctttaaaatcaattattgagagaatggtattgaaatctccaattataattgtaaatttgtttatttctatttgtagttctctcagtttgcttcatgtattttgaaactctgctattaaacacacagacatctaaggaatttatgttctcttggtaaactgacctttattatgaagttacctgattaatttttggtactatgctctgagatctattttgtttggtattgtagtcatgctaggtttattttaattagtgtttgctttgtatatcttttaccatccttttacttttatttttgtaaattaacatacagtaaaagtcaattttttattagtacatacttttatgagtttcaacatatatattgtttcatttaatctccagaattatgacacagaaccattccatgacctcagcatactccctcctgttaccccttggtagttatacccaccaccatccctaaaccctggaagctactgatctgttttctgtcgctttatttttgtctttttggaaatgttacataaatgacattatatgatctgtaagcttttggggctggtttcttttacttagtataatattttaagattcattcattttgttgtctatgtcaatagtttgttcctttttactgttgagcagtattccatggtatggaactttgtgaggtctcttcttcattctcctccacctggaccatcttccgaattctttccagttgctagggctctattttggccctttggcctgaaagctgggaccttattttccctgctctgccacacagttatcatggctgcacccacatcttggcccaaagacaaagagagaggaactgaattgaatattcaccacagaaagacaatcactgcttctctgaccaaggagaaaggttcctcttttacagggttttaggcatctgccacccccactgtcaccattgtcactcctcttgctaccaatgccttgaaattgccttgggatccaggccaggccgggaggggcggggcggggcgaggcgaggcgtcctctccaagctctctgagctttgagaatcttcttctctttaagaaagaagtggccgggcgcggtagctcaggcctgtaatcccagcactttgggaggcagaggcgggcggatcatggtcaggagatcaagaccatcctggctaacatggtgaaaccccgtctttactaaaactacaaattagccgggcgtggcggcatgcgcctatagtcccagctactcgggaggctgaggcaggagaagggcgtgaacctgggaggcggaggttgcagtgagccgagattgcgccactgcactccagcctgggcgacagagcgagactccatctcaaaaaaaaaaaaaaaaaaaaaaaaaaaaaaaaaaaaaagaagtagggggcttctcctggagctttttctgtctgttgacaggtgactgtttccagcttacgtgatgccctaagtccaggtcggggtagactgggaaatataagatagggggtggggtgaggtggggactcaccatcagcttggtgagagtttgcattctgattttctttcttaattcatctgctctcattaatatgtggttttcatttacttttaagctttgtgaaattgcaccaggccagcatttattctagagcaaactttcccccagtactgaggcagaatccttttgacgatggtgacagtgggggtggcagatgcttaaaaccccagccttgtaaggtttccactcatggtttgaatagaaacgacttccagccctttgtgaaccttggagagtattccttgtgctcttttttggcggttctttctgcagacaaagatgtttatcattactcgctggaatccttgagggtgactgtttttcgagctctggaatcctctctgtgtgctgatctctcttcttatattctgtcctatctgccttgatgtccccagactctcagctctaggagaatactaggttttgcctgggttcccactccctgcacctctgtctgaaatccataggcagtaaatttagacagtcatagggctcacccaatttgtttcttatctttcacagatccctttccttcaatgtttttaaactttttttccatatatttttgtttgattttaaagagtttcaggacgtaatgtaaatcgaatctctcttactggaaacataaatttataggatataattgaataagtaatggtgaaatccaaactaaaaatgcctaattattttagagatgattgtgtgagagatagctttacaaaggaggtggaatttgggcaggtgtggtgactcacacctgtaatcccagcattttgggaggctgagacaggtggcggttggggggcatccttgaggccagcctgggtaacatgatgaaaccccttctctacaaaacaacaacaacaaaggaggtctaatttaagctagtctttgaaggaggaaggatattccaggtgaaaaaaaatttttatcaccaatgtgatcgtttggagaacaacctgataagacgggtcagagtatatagggaactaataaaaaataaggttgggatcagatcaaagaagtctctgcaaaccagaagttgtgctatattgcagtgatggaaagtctttacgtttttaaagtctaagcagtgttatataataatgagcacagagtttaaaattaatataaacatttatgtccagcctatatatttgttttaacttaagtgcatctgttcctttttctgtcctttgaataaaatgaagagcagcctcataaaaacatggctggtattgtttttatctaatacattacatttacataacactggagtaaggccatttcttaactttctttagttccttaatctttgttcatagaacatattttccattataattttaactactcttttcaggatgtgtttcgttttttctctacttaaaatgacaatgatcaaaactagatataatatgctagtaagtttgttctaatgtagaatttagttgaattatttgtttatcaaattccttttaaatacctgacagtatcaatgtagctttttttcacaatagcattatatttcacttgaaagctattgacatccaagtaatttttatacaaattattcatagcttgtctggtttccatgttataatcctgtaatatcaagtcatattctattctgttttaatatgatcattttaaaatttatcaaactcattagatgtttcagactttctttgtttcctggtattagatatgtacctctctctatttaatagaggttgaagttttgatacattgggtaagtttaatacagtgaagagaaaaaacatgtttaaaaacattaaacattaaacattaaaacattaaacattaaaaatagcattaaaatgctattttccagcatcaaaatagcattaaatgacgctatttttccaggatatggagaagaaaataaaggaagatatggggagatttatagaagaagaaagggaaatattaaagaaattgaggacagacaaacccctcttaaatcaaacccaaggcacagagacagaaaagtagagaactaagataagtgttgagatagagagactggaaagatgatgagtttaaatcaacagaagcagttttaaggacattctgaaaaactaattagaaactgaacaatttgcctaaagcagagctgcataggtatatggtatactagcatatggaaacagacaaaaatgttcatgtaaatctttcaagaagagtgagtacaagtttggtgaaagaaaatgattttacagtaaaaggacttatttcgagtgtgcaggaatctttgaaaggcttcttaaataggggaaaagatttatgagtgaaagcaaaaagtagatatatagaaggcagatgagaattttggaagataatgaacctctctctttttcttttaatgtatgcatacttcactagaagattagagaataaaaggtgtttagagaaatgactgccttcttgtacacaacaatgtgtatagtcagaaggagcttctctttagacagaactgggatatctggaaaataatatacaaacaagatgtttagaatttgtttgaaaacaatctgaattgacagatatcatttggataaagatagacataacgtagaataaaattcactaatatggaattggatagtggggtcattcatttatgcatataaaaataaaggttatgaaatgtttagaaagggacactgtatgttgtgaaaataaatgtaaaaccttacaaaagcagataacttgccaaaggtagatacattaagcgtggaataaaagacactccgaatttgttaaaaatgctctaggtgccttaacttcttttcttttgggacaccagattatactgagaaaggttaaaggattttttaaaaatgatagtgtaaagggacacaaaatgataaaatctgtgaaaagaataaaagctcccggtgtcttagctgagcaaagctgtccagatcttgagcattgattacatacctccacaagcagtttgaatggaatatggacaaaacaagaaattacacagctgacgatacatgatgcacaagctactcctcttttcagagggaaaaaaaagtaatatgtagtaggaatggaacatactgacattattcaattccaattgtaaaatatttgcaggaatattttaaaggcaggaggctagcaaataagccaagaaggttttgtttgtttgtttgtttttgttctttagtggaagaaaataatggatcagatacaatcattgcttttgaataaataatccagaatttctttataaagatattgtctacgtatgctttagagaagaagaataaaaaactatttgataaataaacataaagggggcatacagtacctagactcatctcattagtatcttgacatctcttttttatgccaatgcccaaggtatgttacttttcccaagaaaaatcaaatcctttaacttgccattagctattcaaaactttaaaaataaatatccttcgaaccaacaactccagtcctgagaatatctcccacagatatacttagacagctaagtgtatgtacaaggaagttaattgcggcattgcttataactgcagaatttgagggaaaacctgagtgttcaactaagcgggaatggataaataacttatgacatgcccctactgtagattactgtgcatgcactaaaagaatgaaataaatcctgtgcactgagatagaagactatctgtgttatctgctcaagtgaattttaaaatgcacaacagtatgtatagtaacccactttaaagaggcctttatatattttaatacaagcataatgtagattatgatatatagagaatgaggtcttgaagtatgcttactaaactgttaacagtggttacttctagtaagtgaaagaggtagcctttaagtttttaacttatatccttctgtattttgacttcaaaaaacatacaagcacatatttaattttttaaacctgaaatttatatgagggataaaacaaacacaagtttgggagccaacgttttctccccaactcctggttcactaccttttctcttaccttaacctttaccactaccacaaactaccacaaacgaacacaaacgaacactttaagcacaactcattttattattgggagaggtttcacaaataagttcctggtttccagttaacttgttgcaaagtttacatcctacccaatgtgactacatggctttaaagttaccagtggtagcttctgagtaaaattttgtttgtttgttcatgcgttaatggaacatatattaagtaccaacagtatgccaaacactggggaattcaaagatgctagtctctcaactgtttcagctgatgcttgactatcctctcccacaccctagtgtcctcattcactgcttcccaatactctacatttgaaaggtgattcccacaaatttattgcaatttagaccccatatatcaatgccgagatcgcgccactgcactccagcctgggcgacagagcgagactctgtctcaaaaaaacaaaacaaaaaaagagctgaagtgactcttctcatgccttcagcatgagaatattcccttaaaattggcatctctttttataagatgagctattattattttacttctacttttctaaataacagagacagcagacgaattagtaatggaaaataaaaatagtggcataggatatataatgtttgggtttacaaagaaaaaggggcatttgtgaaagatttgatatttgttaacataaacatgtcaatcattgttggaaaaagaaaaatatgatatataatcttgttttaaagtgtatgtataatgtataaatatttttggaataaaaatattcatctctttccctagagggagagtggctggatcagatcatctctttgaagttccagttctgtaattcaagcattttctttaaaaagctttaaaattaaaatgagaagcttaactagggtttatactacacatatgtgtaggatcaatatttttaaaactgcattcttaatatgttatgccttttgctctttaaatctgtgaaacaaaacatagttttatttgaagtcattaaaatatgaaggggacagagtaatcaatgctgttggttcttactgtattatattattagaaagcaatttgtgtattttgtgtatctgtcttcctggttttttataatgaaacatttctatctttgaaactacagactcaatcttgccaaaatgttcattttttgtatcattgttaaattgcatattgttcccttttggtgtactttagtagcctgttacaatctttttaaattcgttattcttaatcgacaaataaacattatatataatttgtcatgtaaaacatgatattttaatcacatcatggtaaatggggtatccatcccctaaagcatacatctctgtacccacaaaaattaaaaataaaagataaaaattgaaaaacatgatgttttgaaatatgtgtatgttgtagattcaacctgttataatcttaaaagtgattgtcattcttccaacttatatcaatagaacaactgtctatttgtcgttagttgagaccatcagggtgtagtgaaaaagctaatcaacaaggattcttctcaccagagctctgtcactcctctgaattgtggctgctagcctgttaattctccactaaacctttaggcatttggagacaattaagtctcatgttggggtttcctgggcttttttttgttttttttcaaacaaagataattaagtctcaaacttgaaacttgaaagatatttggccaggcagcagcaatgtactgagtataggcttctcaaagagatgaagtaatacaattagtagaaagaactatcgtgtacttaatacagttgctctctacttttctttctcaacctcccccaaaacaaaacaaaaccaagatgcttcagtcaagcactataaaaggactattaaattatcgcgaaaaggaatgttaagacagtctaatactctcattctgcagatgggaaagtagaagtgcacattgtaattatttttcaaaataaggtaaaagctgataattgtgtaaataagcaaaagtatatactttttccttaatcgtttttaacctaaattagtcttaattttgtgttattcctacagtgaaagaaaacatgcattgtcacatatcaggaaagttgtgcagttattttttcttctcccgaatattctgttggctttatgttccacatatgttgcaccacattaatattcaaacaattttagcacacgaagatttgtaacctcattttaccttgattagtgactcaactcatgttcttgttgtagggctttgaccagcttcgacttgaaggattgctttgtgatgtgaccctgatgccaggtgacacagatgatgctttccctgtgcatagagtcatgatggcatctgctagtgattacttcaaggctatgttcacaggtagtttgccttttaaaactctgaaaccacattaaaacaatatgaaaaatccgtgtttaaatcttttttatttctaacatgaaatttggttcttttggaaacagcttcaaaagaagtacacaacagtatgtatggttttcggtggtgctgttttaacatggaaaattgatgcacttttttcatactgtccatctttatctcacagcttttctttttcaagcttatatctagtgggccatcagagactctgtgtcctcctagtacaatctctactctatgtcaaaaaataggaagtgagaacattttggaagcacttgcatcatatatgacctccattagtatagagattatcttttttaagtactttcttttaacagtaaaatgtgcagcagactgactctaatatgactgcttatataagataagactttcctttgattttattgcatctaattagcagcagaagtgagtttgaccataattatccaccttcatttaattgaatgtctttttatttaaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtaagatattttgaaatctgatttttcctgtggtagactctgatgtagcctgtttaggactcatgaaatctgctgtgcaggaatgtgaaacttgccattagacagatgtgtcttgttgtatgtggtctgtaagcaaggtgagattgaaacaggtgcatttttatgaaatagaatcatttaataaaagcctctgtgttggccgggcatcgtggctcacgcctgtaatcccagcactttgggaggccgaggcgggcagatcgtctaaggttgggagttcaagaccagcctgaccaacatggagaaagcccgtctctactaaaaatacaaaaattagctgtgcatggtggtgcatgcctgtaattccagctacttgggaggctgaggcaggagaatcgcttgaacctgggaggtggaggttgtggcgaactgagatcacgccattgcactccagcctgggcaacaagagtgagactccatctcaggaagaaaaaaaaagcctctgtgtaatcaaatgacatgagatactaataatgtttgatgaagatatatactttaactgtttgataatggtatgtaccataatctggttttattcaccttaatgactatacaagcaggcttcttaaatgtaattgaatggaaaagtaatctgagcttctagaactctttaaaatttcttcttttaataagggagctagatcttaagaagaactaatacctatgggcaaacctgtaagaatgtaagtcttgattccatagaaacatatcacctactgaatagtgtttagccattttttaatagataagataggacacatacaactaccaatcgatggagtacttaatgatagtcacccagttcctgaagagagtgttttattttagttgagacctttaaattttacttctggggagataaatggctacattggacagaaatattgccaagacttccagaggtcttggagcttgtttttctgattaagaattctggcaatattaatttttggtatattttctaactcattatgttgatggatatgttttctataattttttaactcatatgaatcttaatataggtaaataattgctgttagatctttacaacttacattttttgaacatggaaccttctttaaaacactaagtttcaagagagccatgtccttaattattttattattaaggtacttaactatcttaaaagtcagccaataactaatttaactggcctattgaaagtgtgttttttgtatgtttgattttagaaaactcagactgctgtctcacaattacttataaaatttgaactaattgctacttttaagggtttttatggcagcatggtgctatattgttgacttgtattgtcttctttattgcgaaagtagcccaagtgaagttggttaattcccatgctattgcttgcctccattactgaatttaggtgctaaattttatttaaatttgatcatgcaaggcccattccctcaagagctattaggatctcacctctggttgtgtcactggcatgatataacaacttcatttcaaggaaaaatgaatcatattgaatgtgattttcaaaatgcctcaagtccagaatttaatttagtagtaacacttaaagcttgtacttatagactcttaacattgctttacactgatcttagcaacacatggtcatcctgagccaaattaaggaaagtgccatgatttctttggaactaatcattaacaagagacattgttggcctatcctctaatgcagaagtttagtacttagaacttcaggtattgattgtgatcaattcctttacctgaaagaaaatgaccaaactggataatacacaatacaaaaaagttatagtaatattactgtcacaataatagaaaagaattttgttctagataactgtatttaaagcaattttatttaaagatgagaccatagtcactttgtattgctaatttccagtaattagactgttggttccttaacctgtgttgaaacatttattataattgtttaacaatttagaaatgtcttcatttttataaacacttaatattgccttaaatatcatgttcattttttttttttgcatcctttgcagacatcctaaaacctatttctaatggagaagaggcttctctgtagcaaagattacttgtgatagagtttactcctacctctcagttttagaattttcttgcctatgaacttttaggaattacctcttttctttgcattattctaccttacttgtccttcatccttttttgcagaggatatgtctgtatggttttagagtagaaatctcttccctctcagaatccattgtaatttttgagaaaatctggcagatgattagttccaggaacatgcaaaacccaagttttcctttacccttctttcatgcattctgtttttttagttaaacctatgttcagtcttgctctatttatttcccctttccttctcagcaatcaagtgaaaaaggaaaaatagtagcccagtgtattttctacttataaaaactgaacatctcaagatactatattttttaaaggaggattttttgaagttcttccatgagctaagttattatagataaattttaatataatgttctcatgtttaagaacggtgtgctgaaataagatgttttagaggaaataggctttatgtttttaatgatatagtgatattatagttcacataatcaaaacactatttgggtttgaacttttagacagaaaaattcccttctaatacaattctgttctatcctattctcaatcatttgtgtggaggaagaagaacagtggtacgtaaagtgtgaatcagtaacagtggtatgtaaaatgcgaatcagtaaagaacctagaaaacatgtatgtattagttttaaatgataactctagatacattagtaaagccacactcacctttggtgggatagagataccagttttctataacagagcatcagtgttaatggaacaagagccaacctcccttctaactttgccatcatttgcagtgttacttagtggtttataggatgtggcatttttgtttttgctatgttattttcttggagttatggaaaagaggacaatgaaatgaatacagaaggatgacaatgaaggatagatatgaagcatggtaggtaaaaatttctgtaaaactaaaaccacttttatatactatgaagataatggaaaattgcctttgtttagtcatacctaaaaattacattggttttgtccttatgacattgtataactacaacatgttaaatactgtgcccattagctagtgtttttttttttgtttgtttgttttgttttttgaggcggagtgtcgctgttgttgcccaggctggagtgcaatggcaggatcttggctcatcgcaacctccgcctcccaggttcaagcgattatcctgcctcagcctcccgagtagctgggattacaggcatgcaccactgtgcctggctaattttgtatttttagtagagacgagctttctccatgttggtcaggctggtctcaaactcctgacctcaggtgatccacccgcctcagcctcccaaagcactgggattacaggcgtgagccaccgcgcccagccccatttgctagtttataagaaagttgtgtaagttttgtttatcctttgtttgcaatttgaaatttttagcatctagcatttgccccacggaacttttgttatggaggattttaggctagttcacaaaacaacctaatttaatgttaggttgctgaaatagggcatctgtaattgaactcaaaagattacaatttaaatatacaaatatatagaatgaacaaaacagaataaaggtgagaaagaaatcactttatgtttgtataaaagcattttttaacaagagaatgagatatgtcattgggctttagacttggggataatctttcttaaaataattttttaattgtgttttccccccttgatgcaggtagattactggtttcacctgcacatttgttatcagtgatggggtggagagcttacaatgaagtagagagaaagtttattgaggtgactggaggtgatgaagagttggagacaaaataaaggaggtacataagtgggaaggagacaagagagaggaatagggagaatatgtttctctcaaaagaaaaacaaaaagaatcagaagtcattggagaagacagttccttttgctttgcctctgttactaaattactgaggatttcctgcatagtacatatatttcacatttttcatttaatctaaattgtatttacccgtaaagattaacagacatgttttttaagatttttttttcacttttgagggcaatttaatgcaagttagagacaaattgtatagataattaaaattaaaaatgaatcaaaattatttccctccccaccaaaccagtcttgacttccttattgacagggctgatattgggcaaatagtacatagaaggccatccccgttgcttatggtcggccatccattctgattggttgatacccatcttttgtggtttttaaatattctaaatatccctcctataaccttgagcacccattcttgcctatctgctatctgggactctgtctgggaagaagaggcctagcctgggctcaaacctcttcaacctcacaaaagccattgtaataactaacattgcattcaataaaggaactgcattcaaagtgcaaataaatagagaattgaatattttgggctggagacaccagtggcattcacctcaaatagcatttagaaactgaagaaagacaaagactgaaagagagagaggtgtttattattcaattatccctttgttcttaccaaagtgtctcttctttgtgtcctgtgatggtctcatctgtggaaggaggcttgagaaaagatacctgtacattctctgcctgctgaagtaccttgttggatttcttcctagtcttattctgtggacatggtttcattctctgcattgattgtactagatatcaggctgtcattttaataaactagatagcaccaagtagaatttggcgcattgaatggctaaggagttccccaaatttttgccagatttcttagtctttgcatttcccttgagagtacaaaagcagatactggctggtccgagtgcagtggtgtttacaactaattgatcacaaccagttacagatttctttgttccttcttcactttgactgcttcactcggctagccagaaaaaaaaaaaaaaaagcagatacccatttttttctaaatgggaatttctttgtataaaacaccaatcttttaaaaaaagtcctagatttcagatgaaatcttccattaaaatagcaaattatgttaatgacagtgttttgggtacatcagttataatttgaatagtacagcagcagtgaggaccagtatgttattgagaataccacttgcaatattatgatgttggaagtgcctttaggatgactatgactgttgtttggttataaaagaataatttataataatttatatcaaagaaatgtaaatgagcagttgattattttaagaacaattttataggttcccacaggtgcttgaagagttttatccttttttgttgttcttttttttttttttcttttttttgatggagtcttgctctgtcaccaggctggagtgcagtggtgcggtcttggctcacagcaacctccgcctcccgggttcaagtgattctcctgcctcagcctcccaggtagctgggaatacaggcgtgtgccaccacgtccggctaatttttgtatttttagtagagatgggtttcaccatgtgggccaagatggtctcgatctcctgacctcatgatccacccaccaaggcctctcaaagtgctgggattacaggcgtgagccaccgcccccggccttgttgttctttttaaatgccaatgtagttatttggattaacttctgttataactctgtttttaagtgaaccttctttggaattgtggccaggttttcagatgaaataaaagatgaactcagatgaaatttctacttagaaatttttaaaataagctttaaacttcatattttatattttcaatgtgtattctattatatatgtaaattgcattataagtccaattatccatttatggatatccaattatccatttatccttttatgtatccagtggataaacaaacacatgtatccatttaaaaatactgtctaggcttaatgtttggagatttctagctgagtcacttttaagaatcatgatggagaagtggattaaaatgaaccataatagaatattatgtatttctctgggccattgtttactataattccatcagttttggtctatttatattgttaattattactgtagactttgcttctttaatttctatattctatgattaatttttaagctttgattacatatacttgctaagaattaatttcctattacatatttttcttgtctgtgtctcattttgaaattaataaggttttagtaatttgctacattaattcaacaggtatcctatttttaattgcatctatcatcgtatctttactttttatatttttgatacttgtagtatttagcctttgttgtatactcacagtatagtagctgttgtatatgagctatagaaaatacttagtcttgggtaccccataaatatatataccaactatgtgcctacaaaaattaaaaactgaaagaaataaaaaaagaaaatacttagttcttctgtcaagaagataacagttcggaaggttatggaatacctttctctggtgattttaaagaaaaaagtaggcagctatttgtattggttagatggtctgtcaaagtcttttctagtcttgtgtgtctgtatatatgaacgtattgatatacagaaggtattttccaaatgcctgtaaataaaatttaagtttctttctcatgttattctagcaatcgttttctcactggataaatttgaagagggaaaaggtgaaggaattaaataccttgatcccatttctgaattatacagtttggcttttaatctttaatcttgctctgttttacatgctataaatttagatttcagtttggtgactggcaactggtagtatcattttgtcttcttaaagtacccattctttgttgttttttagtaatcatatcaataatgatgagaatttgcatacttgggaattatatttgtgttgtcatcaacttttgcttaactgtactaataaacatcttcaaaagtataaatcaccttcactctggggacgagataattcttacttgtcttgggaagtgaattcatgacctcaaattccttccactcagggtgaattgggaaaacaggtattgactgtaactccatttacaaaacttaaatttttgaaccaccgacctgcagctcctcaaattggattaaatggactttttattaaccacgttagaaatccagggtatttatacagtgttatgctgtctatttctagagactcataatttgttaacttatttttctatttttttatgttacagttatgtgttaggtattttaaaaatatgtagctactaagtaaaataagcaattaaacatttttgtaaagcaaatcagctacttaaaagagcacaaattctttttgagtaataaatcaatgatagactggataaagaaaatgtggcacatgtacaccatggaatactatgcagccataaaaaaggatgagttcatatcctttgtagggacatgaatgaagctggaaaccatcattctcagcaaactaacacaggaacagaaaaccaaacaccacatgttctcactcataagtgggagttgaacaatgagaactcatgggcacagggaggggaacatcacacaccagagcctgttggaggctgggaggctagaggagggatagcattaggagaaatacctaatgtagatgacgggttgataggtgcagcaaaccaccatggtacgtgtaatacctatgtaacaaacctgcacgttctgcatgtatatcccataagttaaagtctaattaaaataatctatgaaaataacaatgtgtgtgtgttaaccttagagatttcagtgatattatatcctaactgggctgtcattttatgcggaggagtaatgtttttagctttgtttcagtttttaaagaaatgtcaacaggaggattattttattttctcttaaccatctgccaaatctgttaactatacaggtgtgaggttaacaatacattgataaagtttgtgtgatattgaggacacataacctgacaaaattttaaaaacaaccaaacatttaagtcttttgcctgtgatctgtgtctgtttgtatacatacacactggcattttttattgtaggcttgtttttgtggtttgttctttgtattatatttgctaatattatttttcctatttttcctttgatgagtcagttattagagcattgaaaagaggttctactgaggaaaggcctctctgtcacttctcttctttgtcagcttttcactttatggtatattttgctctatggtggggagatggttctgggctcatgttgacgccagagagaaacagaatgtgctgaaagtaagagtggctaaggaaagctgtgttgcccagatggaagcagtcatcacagataccaaaatctcatttacatgagagatttgttgtagatatacccctctgcccttaagaaagacatttccttgcttatatttccagataaataatgttgaaaattaatttgccctagggataattatcttattaaattattttcattatgagtgataactttgaaggaaccaaaatgaatgatagtaatgagtgatgcctatttacgtgaaagggaaatctagggtttgggtattagagcttttctgttcatggatctgctagctgtgtggtatttttaagaataatgactaagaagtggattgagatgaatcataatagaacaaccttctattttcccaagtttccatctggcaggaattttatcagtattttgggggtgggggtgggatacatttttgaggagagaagagtaactggtttggccatattccagttataacattgtttcttagagtagcttctaacttactgactttgatcattttcttttagtcagccttctagtggattaagtaaaggtggtttgcaaattatctgtttgtagatcattgatacatttagataagaatcctatttgtatctatttgaacattaaaagcataatttactcttattctagaacaggtatttgtgctatcaagatgtgattgccatgaaagtagtcatgttttaattttttttaattggcttaataggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcgtaagtgcatttatattaagcatagagacaaatttcttcactcagaaattcttatcaaatcataaaataagcagtcctgtaaaatcagataaaaatgtagttagggttttattttaaaactatttttctgagaaaatattgaagaccatctttatgccttatctgggcatatatcgttggcaagggaacaaattgtacgttacaaatacatcagtatattgtagcatatttcacctgtgcagtatatatggtcttcatcttgaaggttcatctaaagagtatacttagctcatttaaattataataaggtcttggatagaagtttggcatgttttctcattttctgcttttaaaaggccatatgatattttactgaacaggttacaatccttcattacagaaaactttcattgtttcttcttttacaaaatatgttacctattagtggccacaaagataattttctttatagattaaatgtacaaagttcaacattatccaaagtttgttcactgtgaatattatgatctatgactgttttaaaaataattctgttgacgtaatatcagatagttttcttttccataagcccatctggtaagctttatttgatggtcacctttttgtcttcccagtataaaattggtcataaatgtactttgatgtagaatactttggctatgtaaattaacccaaaaaggtaaaattttattatttcagataaaattgggatagtataatttttccaaaaataaaggcaggaagtccacattttatgttgtgacatatatttgtcattaccattattgtttggccttgttttcaattattttattctctattataaatagagtctgtcacagggaggggaacatcacacaccagggcctgtctggggttggggggctaggggagggatagcattaggagaaatacctaatgtaggtgacaggttgatgggtgcagcaaaccaccatggcacgtgtatacttatgtaacaaaacagcacgttctgcacatgtaccccagaacttaaagtataataatataaataaataagtaaataaataaaaaatacaaaaaagacagaaagacagaaaggaagaaagaaagaaagaaagccagatgtggctcatgcctgtagtcctagctgttagggaggctgaagcaggattgcttgaacacaataaataaataaataaataaataaataaataaataaataaataaataatgtccttgtagttgaccaattccaggctccatagagctgggaaagttcaaaatattggcattggctctggataagttcagagtaattctcagaatctttatttttcaatattctaagaaataaaagatagtttaatgtatttgagactaagctatttatcagagaatagaataactgttctcagcttttatactttcctgtttataaaaccctttcttgttagtgacatggtctttttcctgatcttttctacccaaagtttttttttctttgttgttacaatgatatttttttctaagaccagattttctagattgttggactatgtcgcatgatcatgaactgcataggttttccaatatattttaataattggacttttaaaagcagttaaggcataagtgtccttagtgtacaattgttctttaggcctcctcagtcaacctacacacattattttcatgttattatactattttaaatttgcggtatctggaaatatctagaaggtgcaagtagtgacttggttgtttcttagaaaatccctgtataagataatgttttcttaaatattttcttcacaaataacaggtcattaacttggtcagtcttcttttctcaaaggaagtagctccgtttttcaaagtcagtccttgcttgttgatattatcacccctgttaatatgcggctacttagctttcaatatatagttcctaatactaattaaaagccatattcttctgggagtttttaatcttcaggccaaggagagtcattacataaaaccaagatgctagaggcttctttctttgaacctatcccaactctctttcagctgctcctatggtatacccatctaggaactagaaatagaccacactgttgggcaagtggctcatacacaggaatccttgctcctgaccttcagaaaccacccctccatctctgattaaaaacagtcttctgtgtttcattttgaaagggaaaagaaacaaggaaatcatgcttttcttagggtattcctaaattcatatttaggctttaacaataaaatttctaaagcttaacctaaggataatgacttaaaaaaatttcccctctaatggtaaatataggtccattttaatcttatttcataaactgcatttaaaaaaaggcacatgtcattataatacaggcacaaaccatctattccaagaattctaattctagttatcatccaattatttgatattttattccatttgaaatgatctatagattacaaatctataatgacctcatagatttgtaacctataagtagctaaacttttgtagaaaatgattgcgtcccttaaaatcagcatacccatcaaacgcattctgtactaaacattttattatataatatattggaagtttaaaaaatattttgtgattgacttagtaagtgcattcaaatttagagtcttgatttcaggagaaaaaaggccaaaaagagtcattagataaagccaagaagcaagaggtttcatttgtttctgatccactccaccccctttgagttctttctatgttatactcaaatagaagcaagaagtagattgtcttgtcacgtcacatcctgtattacggaggtaaccaaacttgatgaaacctgccttgattactattgctcccaaagaataatattaatgaaatttcctgaattctatccatgatcgtgtttctctttatataaataaaaaatgaatttgtgttagttggcatttccagttttcttggacccattgtttttgcagaatagcagattttgattctaaagaaactcttgcctatatttctgaatgttcctgccagaaactgaggttttaacatttcccctaccctacaagcgctttttaaaaatagaattcctccttcaacgcacacattaacatctgttataataaattaacattcccattgtaactgattaagttgagacattcatatgcctatgtaaatagaaggaggtgatgggaatgggtggcaggaagaggggattgatgggaaagtcatttaacaatttaataggttgattagtaccagtatatcacttcatacacacagtaactattgcctgtatataattataaaaagaaaaatttgatgggtacaaaaatagttagaatgaattaataaggcctagtatttgatagcacagcagggtgactatagtcaataataatttaattgtatgttttacaataagtatgagtatatataattggattattcgtaacacagaggataaatgcctgaaaggatggatactccatcttctatgatgtgattattatacattgcatacctgcatcaaaacatctcatgtaccccataaaaatatacacgtactatgtacccacaaaaattaaaaattaaaaaaaaaacagtggcaacatttgcaagacagtttagatcactttaatgcattaggccttttaaaatctttccatggggtacttggaccaaaggaaacctaagcccattgttcatcaaaaaaagactgtgtgtgtgtgtgtgtgtgtgtgtgtgtgcacgcactagcacacgtgctcacctggtttagtgctgaaatataattccttcaaaatgctgctttcctttgacactggttacaatgggaaactaggggaggcttagagtagctgtcacttaagtgtaaaaggagtcagttatttctggcatctttcaaaattgtgtcatataagaaatcaatcttctattgaggcttcctatattgaagaagattatgacagctccaatatctttcacttcagttaaatattaataagttaaggtttcaaataatgaaataacttatagaaaacatgttagatgtttttcaaatacatgcacaataaaactactaaaatttattaaatgcctctataccccccaaaggatttgggggtttcttgatcactcaccagcgttctatgtttctagagtccatctcccctgtatgacagccatcactgtttaaatgattttctttaggctgatctctttcctaatcttaaagaacaaataaattccacatcctcttctgggaccgattctggattcctatggaattatctcagaaaataagaactcctgatatatgtgagataaccaacctaagtataattcttaaattggagagattctttaatgtaaacactaggccaccaaactactgaagttaattctctagattaggggccagcaaacttttgtaaagggccagaaagagtctatttccagctttgtgggccattaaatctctgtcacaagtaatcaactctgctgttgtagtgtaaaagcaaccctacataatccataaacaaatgagtgaggctgtgctccaataaagctttatttgtgaacatgaaatttgaattttatagaattttcataagttacaaaatagtcttgattctttttcaatgtgtaaaaaatgtaaaatcattcatatttttatcttttgggccctacaaaacaggaagtagactggatttggcctatggactgaggtttgctgccacctgctctagatttttccagttgcctctttaccatttccaactcttatagactacgattgaagcactgctttgtggctccaactctttgccttgcatcatcccttactccctcttcccatcagagttgttggtactaacctatatctgagtgtcgtgtaaatatggaaaatggaaataagagcatgtgtatctactttttaattagatgtattttattttaaaataaaatactattgattttactgataacaatagcaactctgcatggagaattgcatgacaataaaagttgacaataaaaattaaatgcctggaacagctaaaggagatgcatttttagctggaaaaaagcttaagaatgatggactattatatagtaattttgttattggtggttaatagctatcttgaactgagggcctcctgtgtgagaaagtacaaatggattcttataaccactattaggggaaaatgcaattaagtcactgacagaggaattatctttctacataggaaaatattaataataataaaaagtgaataagtattcaaattctaactccactataaaaagaataagaagaaactaatggaaatcacattggaacagtttgaattaaacataagaaaggacagttacaatccaaaaatttcaaagtttaagtcagagtcccgcattaagaaaagtgtaaaactatagtgaatcctgtctttggcttcaagcagatgaagatgatatctggaagtctttttagaccccgtttctgataggatgtgtggtttaattacttctaaaagcttcccattaatggctttgctaatgccaagtaccaatcaatgcactaggttttctcttatgtggcgagagagagagaaggagagagagagagagagaataataatgtaggattttgcttgtccgttaggtaaaagtcatgccaaaggcaaatagaaatgaacatttgaaaaggcatccagtgactggaaatagtaaaaaaaaacaacagtactggggcatgtggcagtttaacttgttattaattttagaaatagggtttaaaagaaatagaattggcaaggatccaggcctaaagcaatgaacaaagccaacaaagcagtaggtaaaaatgagaatagtaaaagcctttgaaataagactgaaaattcaaagctaaagtaagtggaaaaggaagtcagtagagagatacaagaagtggcatgatataggtgtgcttggaggagaaaagcatactttgcgtagtgaatttgatgatgaaatgaaattattgaatagagcggaaaagtagtctctctctctctctctctctctctcgctctcctctctctctctctctgtgtgtgtgtgtgtgtgtgtgttttgcctgtcaccatgttatttttttttaagtagagaatctcattcaaaggttgattcatcaggattgcatttggttgcaagtagctaaacctaattccagtggcttgatcaaattgtcctactcaataaacttctgcttacccgtcgctgcccagaactatatcatatggtggaccaaagcttcaagggaacctgctaaattaaatttcgtttttagcttggtgtagtgcttccctaagcagtgttgtggttctgttagtttaaaaaagtagggttgggggacgcaagaaattggattagcagttggcagtgtctgcaataaataatatgaacttttcaagtcaatctagacctcatgcttttgatgagttctcttaacagcttctctgccttttaaaaagtgattacattttccatctttcttggtgacattgttctgttcttgaggttataacagactgattgaaagatacttaagtgagttgaggtcacttctccaaaatacattatgttaaaagatgataaatacattactgacaggaagtattcttaataaagatcttcatattatgccgccaaccatcttcaggttaagagtagtactggctgcaatgatggtgggtatatacgaactattagctttaaagtataaatgtagagaaattattatcagtgtccattttgtagtctgtatatgaattaaagcagtgggcttcagaacataaaccaagaagtgtgtatattttcattctcaatgtaaaagtttgcttcttatgtattaacgtttgtttctatcaacatggggacccagaattgaggagtttttcatttcttttgatttttttcatcctttcttcctatgtttttagagcaaagaaaatggagaaatgtcaaattataaatatgtaagcagattacagaataaatcttagtgatttctgcaatgacagaaatttgttagattcttacactatctagtctaatgtaacatgtactaatggtttatattattaatatagtctcaataattactgtaagagctcccccaaagtcttacacatatctatcatagctataatagatatgtttcaagtgtttggatattattactgttccacttaagagaaaaataattaattgctaaatttgaagttaaaaataattttcttttctttttttttttaacagccacagtagaatgttacaatccaagaacaaatgaatggacctatgttgccaaaatgagtgagccccactatggccatgctggaactgtgtatggaggagtgatgtatatttcaggtaaacaagtatcatgtgaacacaatataatatataagcttttaactatatggttatctttccatatagtggtagtaataataataataattcaggcgtcaggagtttgagaccaggcgggccaacatggtgaaatcctgtctctattaaaaatacaaaaattaactgggtgtggtggtgcacgtctgtaatcccagctacttgggaggctgaggcaggagaatctcttgaacccagaagacggaggttgcagtgagccgagattgcgccactgtactccagcctgtgtgaaagagcgagactccatctcaaaaaaaaaaaaaatccagaaaaacggagaatcaaaatataatttatgttgattttagaaactatttttgtgtgtatttgcatatgaatgtcttgggcattctgtaaatttataagagtactagtaaaccaatcctgttgtaaggtataacttagaaaaaattggaaagcattcaaattttgctttccagtccccatgctctgtattctgataaacaccattcatagtttctgtagcaacaattaattcattttatttaagatttagctaaactatgtgaaggagtgtatcattatataacatataagttctcctatgcataaaacgtgcttccaatatgcataatagtacataataatgttcattctctctttcagtatagtccataatatgggtttccttcttccttagcattatagggggattctactatggtgtcattgcataaatatttctgtgctgattatctgtattttatgcacatgaagatatatttttctgttaaaaaattctgaaatggctatagtttgttcacagtgtcccagtagcaactttcattctcaaattgttggtgtttaaatcaatctactgtagaatttctttctttttttaatgcattttctgctttcattctcctgtagaatttaggaagaagtctcactttaatgtaatgaccacctctggtattgacatttaactttgttagtcaggttattatcatttggccctgacacactctgcctgggacaattcttccccatatgaaggcctgccagtgccaggccagcagttacattactagagaccaagggtgtaaaggcactatttgtgacctgattgaccactgccttatgaaatttttaatcaataagaatcaatgaaaggcctatagtatatgattggcaggtttctggtgttaaattcatgagcaactacagaatgtcttatattggaagagccatccaggtaataaatatgctcccattaatcaatgatttacaccatctatctattttatgtgggcagctgctgtaccattataatgagagctccaactcctctgagaaaaatgacacctgaattgttttagtggtgttttggcataactggcgtatattgcagaaatgaccttcccaatcaagagtggttagaaactatagctgattttcaaaacaatgaacactgttttgctttctgggaattctgtaaagcacaaggaaaatatttttaaaaagcagaaggaaacagtgatagtgattggcatctggccatttgacagtaaaggtttgaatgatttgactaaagattagcttacttctttcccttgtctacagaaggtatcgtttaatactttcattgtagagactggtttatatgtgatctaagagtacactttgtagatgatacagactaaattagattaacaacaaattggtgcatgtataaaattccacgtatattcagcattctaattctttagatttttaaatatgcattctgataagagatgacattatccaccctcactctgcccacagaaaactctataaacataaacaattctgaatattcttataagcttttacacatgtgcaagactttcaactttttcaaagcattttgataaatatctcacttcagagtcacaatcctgatgcaataactagagtagatattgttttgtgacaagtgaggaaatgggaacctggaatttaatgtgctctagcccagtgctcagtacccagagggtacccactaaaaggcagtaagtagtgaatgatgctttgtagttggaatttactacagacccaactctatcagtgatcaaaatatattttccttcagcaaagccttttaaataccagggatctacatttgagaaagtcattgcaataatgtaagtgattgcaaaaaaagtaattgttttgttctttaagaagatgaaaatgctattttctttacttttaatccagagaatgtatttatagagggaagacagtcctaagaacagtattgataaggtatatgtcataatatgtgactaaaagttatctgtgacagagctcctttaattacttttgcatttctataattatttacttcaaaactattgttttcattctttaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 3646 - DNA, 219051 bp, human
actgccccctccctccccaactgggttcccgcccccctccctcagcagcccccccacaccctggtgaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaaggtgaggcagggtcctgaagtcacaggggctccagcagccgcttccctgccttcggacccggcgctgcgcggtgcgcggcgaggagttgcgatctgtaccaggggcagaggagcagaggagcagggaaacagcttcattttgcccgccgccccctctttttctcccgcgtgctggtgcgcgccctcatccttacaccttcgcatccctttctgccggtccctctggctccgtcggacgcctgggttcttctaggaccccagaacccggctttcctgtgcttctttgtcatctctccaagatcttctcctctgggcctcgctgttgctgccctgacggtctggggtcccgctgcccgccccggccctactgtctcttgccctctaacagtttctgctttgtgcctcctaatccatctctccttcagaatcttctaacttaggaggctcctctgctggctcccaagtcaggagcacactcctcttcttcctcgaagcttttaacttagctctgaatgtcttcagctctgaatattttgacttttttgtttgtttgtttgtttaattacagttgactaatgattttcttggaggcttatagtctaggctacagtttactgaaagtgatgagatcattccttcactaaatagccttagtaaatatcaactagggaactttaaagtttctttctaggtttcattaacttagtccaagaacaatagccacttaaaatgtatgtatatatgttggtacgcaatcttcgtacatggtcctaaatctgattcttccctggctgctgagcaggcctgagagagaggattggtgggaattgtgatgcctggctccatttctctaattgtaaactaggatgttaatcgttttaatgtagtcagaggactttagtggtttgggataaagtcgctcaagttagcataggctggtaactaagcacattgaatggagactaagagacgctgggatttaaaactgtctctggagggcacctgctttcttttttttgaagccacagtttcttaacagtagatttcatgtttgtataaaccctctaaaagcagcatattttaaaaccacgtagttacaaaaaagactactcactcttagcgatatcgctttctccccatgtagttgtggtgttagctcccatactgaggttcatttgctcactttcatactgcaattagtgtgtgaagaaagctgaatggagaagcacaaagtggaggcaaataccagtgaacaagcacatgctgacatacgcagctgtgtttttggaaatagactgtatctagtgttcaaatttaaaaactgagaaaaatgaaataattcagcatttatgacatcattttacatctaaaaatattagctcccttaactgcaagttcttattaatatcctcatacttaacggtaaaagagttgtttgcctgatgtatgaccaagtgttgccattgacacagtgtgcactaattggcagcaatctcagaagaaaccaggttgtgaatgaagataatggctaaatttcactgtcctggtagcacgtcttatggcagtgagatgagagtagtttctgctgcaacatcaaatgatgtatttaaaaaacagataaataagagcttcaattattaaaaagcccaaggttttcaatctgccatttttataagcacacttcaaaaagtgtagtgtgattatataaggctcagttgatgttctgaagaaagtagttttcacaagaaaagtaaggcctattgcttatcaatttagttagataacttgcagatgatttgtagtttcccaattgatttggtaaattcctgagtttacttgaggtttattaaaaaatggaatgtagtagggaaagggtacttattctaataggcccactttctaagtctgtaattttcttagcaaactattctcaaaatacataaaaacttacaactttttcaaggaaaagagtttatactattttcttacttttttcttttcatgcttattattgatacaaaatctaagctaagattgctgctaatgtgattgcatagtaagactatttatatttgccaggaaaagaataaaggtggatgagttagccataagcattttgctctgaatcttcaatatgactcaatatgtgtttgatagtccatctggtacacctagaggttagcagactggatatttctgatattactaaatgtaactgcacttacttattggattatcttctttctcattttatgtacatttcaaattatgcttcttcatgtaatttgacttgcagtagtgaaatgagactgaccaattttcaaattgtttgatttttattgatgtttgataaaccactaaaacctcttgaaaatatttttttcttaaatccactgattgaaaccgatgtatttttattgctatgaaataatacaacaaatttccaggaattatttcagaaaatgtggaaagactgtagagaaatgaatagccctagagaaaatatctcaaaattataaaaatggctttctcaagttactgatattcataacaatcaggtttttatgtatcattcattcatttactaattcattttacaaaatctactgggtacttgtgtgccaaggccctgtgttaggcacaatgataaaccttataaggcatgatctttgctcttgtggagtatcacagtgcttatattctaccagagaatacagacaataaacgagcaaacaaatgaagaagatccttatagactgtagtaagagcaatgaaaataagtaggggaatatgatacagatagctaggaagggcctactttagtgtgggaagtcagaaaaggcctttcagagaagatgattgagcagagacctgaaagagaagagagaataggcctaccttgtcaggatctgggagaacattcccgagataacattcttgcagagagaagagtaagagccaaggccttgaggggggaaaaagagacttggcgtttttgaagagcagaaagcaagccagcatggcggattaaagaagatgttacagagcctagaagcagctcaataaccgataaataggacttggaggtcctgagaaagaatttgggtttgattctcagaacaataggaagccactgaagagtctttcctggggaaggtcattggcttaaaaaaattatccagggaaatttaaaaaaaaatgttttgcagaggataaatagaatgtctactcattcagtcatttatattaatacctgagaataaaaaaaactctatgatcagtatgctaaataatcatgtaattcggttcctctactctgtttaggtaaggggatgggggaatgggaaccctgaggtgagtatgttaaaaggcagtttactttccactgtcacattgtgacttgtgctacaaggtaagttgtcaccaactttattaaaaatcagatcattgttcaacttaagaatttatttttcaaagaatgatatcttattttctcatggaaatatgtttcctttggaaggttggaaattttattttgtataaaggaataacctaggttttagaaagggcctttggaattttaagaagggcttatcattttcttttacctgttgcctctccaacattttcaaatggccatacctttattccttgagagattagggttactgtgtttcctgaggcttaaatgaatttattgccctaagcccttccttgaaagcaatccagctttgaggtctagttggtcccaaataggaatgcagatgattattgacattccataggagtaaatcctaatattgtgggggaataacctgcaaaataaccttcatcagtgcctgcagggtcaacttgatttgatcccagcctactttcccatatgtccttattattccctttcacaaatctctattggtttaaactgattttccccagtttggaacttttgtgcttagcattattcctggcatagagtacgtgcacagtgggtgcttgtcaaatggatgccatgcctttcttttttgtcatttcaaattccaggtcctattacactattccccattgaactagatctccccctctgaaggtgaacagcagtcacacacttgccctgttgtgtcataattatgcttatttgatgcctggccatctccccacttgcctctggcttcatgaaggcgacctagacctcatccggtttgctcattgttgtattctgagcacccagcacatggtatgcactttataaatagttattgaataatgaataaatactgtcttgtgatgtttctcctattaattttttgatgttagatcatttaatactgttttacttttcacgtgtttggtgttccgaagtggtttctgagagaggttgtagagcatacttgttaagagctcaagctctggagctaggccacctaggtttcaattccagctaggagacttaatagttgtgagacactgggtgagtcagtaaacctccctgtacctcagttatctcatatgtaaaaaaggggtaatagaacttgcctcttatggtacttgcaaagattacatgaattagctaggcccactttttcttttctctttttctttttcttttttttagacggagtctcgctctctcactctatcgttcaggctggagtgcagtggcatgatcccggctcactgcaacctccgcctcctgggttcaagcggttctcctacctcagcctcccgagtagctgggactacaggtgcgtgccaccacgccaggctagttttttgtatttttagtagagacagggtttcaccatgttagccaggatggtctcgatcttctgacctcgtgatccacctgcctcggcctcccaaagtgttgggattacaggcgtgagccactgctcccggcctaactttttatttttagtggagacagggtttcaccatgttggcgaggctggtttcaaactcttgacctcaggtgatccacccacctcgggctcccaaagtgctgggattgcaggcatgaaccacctcccccggcctaggcccacaatttgtttgcaatttttaaatttctaaagctctgaaaactgaaaaagattttatttggtaacttagatgccaaaactcatgtggtggcaaaacctgacttaaactgacatagggtatttatagtctttattctacttaatgttgatctttattttgttttgctatagaattactaatatgtttatggggttgcaccatagaccctaatggtgtattacataacatatggtatataaagtatatttcctgtctaaaggtctggacatttctaaattcagaaacacatctggcaccaagatttttcgatgagattgtacaccttgcagtaaactgcttaaatcagggccttgcacatagtatgttgttgctgtgggtggtggagattagggaggtaaataaactactttatctttcccaatagcttgctcataatagttaccatgtaaatatatactgatttactcatgcaataactgtaaatagaggactggctgtgtggttctcatgtcataggaaaatagatatggcagggtcatgtaattgaaatgagccaagactcgtctgttagtactctcatctggtaccattcagagcagtttagtttttgtttttctgttgttatttaaaccaacctatgcttctttagcacaagagagtcttttgtgggggtgggggtaagaaattcagttaagaacttatttaatgtgattagacacttatttttttgcagttgttgaacatttattgaactgctaatgtgtatagaaatctgtattaagagcaagagaaggccgggcatggtggctcacgcctgtaataccagcacttaaggaggccgaggcgggcggatgataaggttaggagatcgagaccatcctgaccaacatggtgaaaccctgtctctactaaaaatacaaaaatgagctgggcgtggtgacatgtgcctgtaatcccagctacttgggaggctgaggcaggagaatcgcttgagacagggagttggaggtttcagtgagccaagatcgtgccactgcactccagcctggtgacagagcgagactcagtttcaaaaaaaaaaaaaaaaaaaagaaaaagaaatagaaaagtagaaaagagaaaggtagaaaacaaatgagacatgattcctgaccttccttagccccagcgccctgcatggttacatggggacatgagtgtgcgttacaattctttattttcctctgtaaacttgacatcattaagattaaaaacatgcaaaggaaaacccaagagttaattgaaaactcttcttagcgtccatgatatgaattgggttttaattatcctaacacaacccccctcagtattatctttatataacatcttgacagccttttcctttctaactaaactaaaacaacatggattttcttgttctttaccaatacacaattggtgtattttcttttgtttttggtagagatgaggtctcactatgttgcccaggctggtgttgaacccctggcctcaagtgatcctcatgctgtggcctcccaaagtattgggattacaggcatgagccactgtacctggcctgtttttttttccttcggttttgtggggttgccagtaattacatgtctcaaaggattttttctgcagttttcttgcagttgaaaactagtccttgaaactattctgccaattcattcaacaaatacttattaagtgcctattatattccaagcattgtgctagtctaaacaaatagaatctctgtctagtgctctttccattactttgggtccttcaaagtggagcacatgtactgattgagcagggtggtgacaaggtggtgctcccaggagccacaaaataaagcagcttgtattttcttgaagcatctgttttacacagagatttaggagaacattaactggtagctatttaaaaatctttaaacaaattcagatacattctgccttagaacgcaatattcatagaaaatctgaggcaaaccccaatatttcagagaaagtctctgcttgcaagggcagctgtggtaaccctgagatgaccctttggaaagcactgaggtggtgctgtactgcccgaatctgttcttttagtcaaacacccaaacattttcatagccgtaaattcccatgatgacctgtgggaaagttaatggacataaatgtttttctctgttgcgcaatttcaagggtacatgttggttacccttggtctaatggtctaaatctaaacatgtgttgagttcttacagagtttttaatgttggtgggtaatggctaagagtgactatgaaggacctgcctagggaatgatattttcagaatagaggttattaggcctgacgcagtggctcactcctgttatcccaacactttgggacgcctaggcgggagcattgcttgagcccaggagttcaagaccatcctgggcaacaaagcgagaccctgtctctataagaacaaaaaaaaatttaaaaattagctgggcatggaggcacacgcctatagtctcagctactcgagaggtttaggcaggaggatcccttgagcccaggagttcaaggttgccgtgggctacaatcacaccactgctcttcagtctgggtgacggagtgagaccctgtctcaaaaaaaaaatctaaaaaaatttttaaaaaaggctagaggttattagaacacaaggaccacaaacttaaagcagcacagttcatggtgtcaaagctttgccttgttctgtgcacacttgcctgtctcactgatttgaagttcacttttgctaactttaaagctgctttcatttacagcatagtatacaaattggtttgttaattgctggccactgaaatagttaatactagaagaaagttgtcaaggattaagtgctttgaggttgataaaaggtttctacagtttgagatggttttgaaaataggccagcagagcattggaggaatgcctgttacaacgtgatggtttaatttgctccagatgagaaagatgaagaagaaaaaggcaagtgaagaaagggggtgaaagtaaatggagtaagtcaaacactaaatctttcaactgattttcattattgcagtcccactttcattgttgttgttccatgccagacatagttcacagggcctgacattgttatattgttgtgttactgctcaaatcttgtaaggacatgggtatagaggattgtgattagtggatggtctttatcgtctacaggtgaagtgcttttacagtctattcagtaaaaggagataagagttttgcttgtagtttgtagagttttctttcttggtcccacttttaaaaaaatggtgatacatttctaaagatcacttcatttcaacaaagttttctgttccactcttggatgtttcttttttcttttaagacagggtctcattctgtcactcaggctggagtgcagtggtgcaaagtcaaggctcactacagcttcaacctcccaagttcaagtgatcttcccacctcagcctcccaagtagttgggactgcaggtgcatgccaccacgcctggctaattttatgtattttttgtagagacagggtttcaccatgttgctcaggctggtcctgagctcaagcaatcctcctgcctcagcctcccagtttgctgggattacagacatgagccactgcacctggcctcactctcagatatttcttagtggaaaggcagtagagcttaatggctatgatcttgaaccctggaatcataggcttgggttcaaatcctgactgccttttgttgggcaacttgcttcacctctctgagccttgtttatctcccttgtaaactatctcatctagtttaaggattaaattaataatgcgtatagagtgctaagcacacttaagccacatatgaaatataactatacttattattattttcatagatttgtggctaaattagttgataacttggagcatactataggaccttggccaatcatatatgaagcagaaatgtgaggggaaattgtgtgtcttctttgtttatattgtcttaatcctagctggaatgctatttttcgaatgtgcatctcgtaaatggtgagtagactgtttagaagtaacactagttttctggcagacaagaaagtttatggtgaatgttggcttattacttactcaaatatggcatcacattgattccaagaaaaatgtcagtttttaatacaattagcccaatatatatttaaatgtgatactgtttgggttaataggattttaaattttaatatccattttgaaggaaaagggttatgcaggataatgtatactatgaacaatgttatcttttaaacatgaaaacatttggttttctgataatcacaggggtcacacatttttctgatttatctctaattgttccagattttaagtccccaaagaagaaaatactgaagcatttgtaatagttaagccattgggaagaggtataattctgttgtgaataatgtcttcctatggattttgagttgttatggttatttcaagtttttatcatggttactgtaataacaaatcaaataataccctaagagaagataaaagtttgatagtacctttgataaatgaatggataagtctaaatggagtattgagaacagctttaggtgttagagggatagactaatcttttaagttgagagtacatgaatctacctttcctactttcttacatgatgccctttagttccaatgtcagacaaatgatgagagagataatccttggtgatgaaatgccacaggtgcacagaagggaaaagaccaggtaacatattggtcatatactgtatattcacaggtttttatgaccgttattaagataatgtatattcaagtgcttgaaaagcttagctcactatattgatgaaatatattatttattagcagtgatgtctacatttataaatagtgatcattctcagtatcatttgatgataaaaaggcagtattcaaatttatatattttttagaaaaattagacttactctaccattaggtcattagctcaaaccttaaataaagataataccctttatttttagagcatctttcttttgaagcatgattaactgttcttattctgtttattcctgtggaatatgcacaatgagtttaagtaaattgcagaagggttacatcctgtgaggtggagctaagagtaggcctttagtttctaatccaatgcttttgtactaatgatataaaaagctcttggccgggcgcggtggctcatgcctgtaatcccagcactttgggaggccaaagcgggcggatcacgaggtcaggagatcgagaccatggtgaaaccctgttctactaaaaatacaaaaaaaaaaaaaaaatagctgggcgtggtggcaggtgcctgtagtcccagctactcgggaggctgaggcaggagaatggcgtgaacctgggaggtggagcttgcagtaagctgagatcgcgctactgcactccagcctgggcgacagagcgagactccatctcaaaaaaaaaaaaaaaaaaaaaaaaaaagctgtttagaccaaaggatcctttaatatctgtagcctttcaattgatggggttaaagcaaaatgtcagtaattgtgatagcaatttggtatttatcaaaatgagttttggattcagtaagaattttataagtacttttggtatcatataggtacagtatccacgtgaacatttatgaacaagcaattatacgtaaagcactctactaggagggagaaaatgtattcactgccctgaaataggttacagtcttgccaggggcaacagagaacatgagtcaatttgatatcggccaatactaatattattaccaagcagccagtgactaataaatcattattgcactcattatgagcctgggacccttccaagtgcatctgatgcattgatacatttaaaccacataacaatactatgaggtagaaactattattagccccactttacagatgaggaaactgaggcatatagatgctggataacttgcctgtggttacacacctaatatgtataagaactaggagtaaaatccatgtagtctgattcttgagtctatgcttttaaccacaacacttcctttcatgctatctctgacagaggccattatataacagagcatgatatctaaaaaaggcatgttagaaaacagattctagagaaataaagagaaatgatcagatgagggtgttaaagttggaaagatagtttgaagaaggcacttttaaaggaggtcttattgaaaagcaaggaacgtatttctgaatatttcaatgctcaaagctatgtgtacatatgtgcatgtgtgtgcacaggtgtgtgttggtatatgtgtgtgggcgtgtttattttaaactggaaaaaaactttagaggttaaaacaaattgacaatctttttactgacagctaatcagagctctgtttttgtgtacaatattttgacttcacaatcctgtgtcgaaaaaaatatttaacggctttattaagatataattcactcatcatacaatttacctgtttaaagtaatataattcagtaatgtttagtatactcacagagctgagcaactgtcaccacaattttagaacatttttatcacctcagaaagagaaatttgttttgaaacaaatgtggccacaaagaggatggaactagtgtgtctgttggtactactgcttgtctatcaaaatgttcatgatttatgctcagtctaacacagacctcatgctgtttttctgcagtctagctccaaattgctgtagagctcctcctcctttgaatttaattttgatcggtgacagtctttcaaggcagtatgtattgatctaattttgaattctcaattcaagttgattgtatatttgtatttgtcataaaggtattgatcttagttctaaatagcaaagccagactcgtatttaaaacaaaactgctaaacccactagtatgagtggctacctccttgtctgtgtatgctctatagtgggccagagccaaagatttctgagaaattttatgtgtatacactgatatttttaattacttctaaaagttatacctgatataggttactagtggacagatgattgaggtaaaagcaactcctccacgccattttttttggctggggcatagtattggggtggtgtgttatggaaaatgtcttttttttgagacagggtttcattctgttttctaggctagaatgcagtggcatgatcacagcttactgtagccttgacctctggggctcaaatgtttcttccacctcaacctcctgagtagctgggaacacaggcgcacatcaccatgcctggcattttttttttttttttttttttttttagtggaaatgaggcctcggtatgttgcccaggctgttcttgaacttctgggctcaagtggtcctcccaccttggcctcccaaagtgctgggattacaggtgtgagcgactgcatgtggctgaaaaatgtcttataaaatgtattccatgatactatgtacagatagtatgaaataactggaattaaaaaaaattcggccactgacttttcagctatttagggttcaaaaaagatacagttagtgtttatagtcaaggactgtgtttctgtccagtgggagttaccaaaccaaatatctctgtgtgtgttgggggaggcaggctgttcccaggtcttcattaaagtaataagctacagtcagtgttatctttcagactaaataattactatttcctttctattattaaaaaatgaccttcagacataattaaatgtcttaaagaacataggtgtcttttaaaatgtgttaatcttaggttgctctctttttcttcttacaatttttcttacttttaattttaccgaatttttctttcagaatgatcttgaaatgtcattttacactttttcagtatttttaaatgcctattatctacttgggttgtttctactcaggggccaaagtagttttagttgaagttaaagtgagttgataaaatgatttcctgtgaatcttaagtaaagtttttatttgcatagatggaatttctgctttgccatgtatggcaaaaggtgtggtgatctcacagctagtaggtaggataaaatcaattaaggtggcactgctgtcactagaataaaaaatctatgcatacctttatattaattagatgaaagctcctctttatcactaagctcaacagttgacatcacctggagtcagggagtcaggtgccgtggagttaaaaacagaaagcatgctcgatttagaaattctggcatatatgtatgatgctaccttttctcacaactagattttggttattaagccattgtgatattgggctatgttaaaagacattagaaacctgttcatttaagacaagccaaattggtctgatataagagggtcatgctgaatgagaaagtatcacataatttaggagagaggattttgagtaatgtgaatattgagttttctgtgacttggtatatcatttattgattttaaaaaatgaacccattacattatactcataaactattacttcacaatagtttgattttctgcttaaatcagtgcctaaaatggtaaagtcttaaatggtttagaatgactctgcatgtaggttaggtccatctacctgttttatatggggatctgctttatctgcacataaagaagattcgctagctttaattagccttactatgtagggcagcactttctctaatgagagaaaatgaggtattttacacaaattaattcaacagaaattagtgactaccttctttaaaccaggtgatggggatgcagtggtgaacaaagttctatcttcattctatgaggtactcacagcattatatgcactctctttgttcttttctaagaacattccattcaaaggaataggaaaagtggcaggagaaaacacactcctttcctttaaggatgtagtttagcatttgcacacatcacattcacacatatcccactggccagaacttaatcctatggtgatacctaagctggaaaatgtggcccttcactgcatggacaagcaaaaataattattactatatgagccgggaagaacagatattggggaataactaatagtctctgctatacattgtccctaatgtaaacctttaatcattcatcaatttttgacttatctggagatattatctctatgacatcagctacacatttgcttcatggtaaaaattaagacttctcagcagagtatacaagtccatcatgacttgactcctgcctgtccctttagcacctctctcaccccatccaaagttgcagccttatggggactacttggacttccccaaactagccatgctctcttaccacacatttgtacttgctacttgtattagtttgttttcacactactataaagaaatacccaagactggataatttataaaggaaagagttttaattgactcatagttttgaggggaggccctcagaaaacttacaatcatggtggaaggtgaaggggaagcaagcaccttcttcacaaggtggcaggagagagaagagtgaaggaggaacttctaaacacttataaaaccatcagatctcattagaactatcacgagaacagcatggggaaaactgcacctgtgatccaatcacctccctcccttgacacatggggattacaggtccctccctccacacttggggattataaattgagatgagatttgggtggggacacagagccaaacgatatcactactcatcctaaactgctgcctactttttgtccttgaggtttcagtttagatagcacctcttctaggaaggttttcttgagcctcctgtacctcacacccctgttatgtgtttctttcatgtatttccatagtattgttcatgactctctttagcaacctgtattacaagtagtgtttttccttctctgtctctctccctggattatgaattccttgaggacaggggctaactcagttatctgtattgtctgtcatgatacctgctccagagttgagtttacttaatgtttgttggtaagaaaatgaatgaatgaatatttagtttactaattatgactccttgattaagatgtcaactcttcctatttaccatctggaaactgcagtacttagagtattttccagtagctaggactgggtaattttgtaagaggtattgataaaataaaataatttgaaataaacatcagatgattaatatatgaattatagaaggcacaaacaattgatgtgtaagagttaggaagagccctagggatcatttaatccaacccttctagaagattttaaaaggacacacgactaatatatagagagaagttaaattacttgctcaagggcctccactttcaaggatcttgcaatatcgttaaacagatgatatgtatagacatgaaagaggtgattgagaaaaaattgccgaaggaatagaaatgattggaatagtcagggtaggtttgatcaaggatcttggctttgcagtgagccttggtcactgggtaggattttgatatgagaagacattcaagatataggcaatgtataaataaaagtggaaagacaaggatatacgggagaattttgagatctctttagttgagtgatatttagtagtaagagagaatacagaaaaattgggccagaaaatggagggatttaaataccaggctgctgagggaaaccattggcagttttaagtaggcgagtaatacagtttttgtatgttgtatctgactgataggtgggctgggttgaaggctgaatgggtcatgaaactggcatattgtctaatgtgccaatttaaaaatatgaacttaatgggttctcgtttttgctcaaaagcaaaaacatgatatactatcaattcccatgataattaacataacaatatcagtgtttttcttaatggagaaagtgagtgtaagtagcaagcttatagtattagtattgcatatgtattagtcatgacataccatagataattgtataaattttcacgttacgccaataaactgtaaaaattccagaagtaactgagaacgtggtagcagctgcagcatcggcccatgctattttgccagccattcggagactgcataaattaactagtggcatgaactctcctggtgcattttggagccattttattcaaaaattgttttgtagaaagtgaaaatgttatactgtattttggcaaaaataagaagaacaataagcagagctctctttagtgtattaagcatcatctaaaaatgaaaagcgtgaggggagaacctttacttcatgtgcctgtgaggaaattttgactttgtatagacaaaaagtatgtacacagagaaagatttgttatataaatagtatagctcatttgtatagtcaagggtgtcttcctttccttccttccttccttccttccttcctttcttccttccttctttccttccttctttccttccttcctttcttctttccttccttccttcctttcttctttccttccttcctttcttctttccttctttcctttctttctttgtgacagagtctggctctgtcacccaggctggagtgcagtggcaccatctcagctcactgcaacctctgcctccagggcttaaggaatcccccaccaagttgctgggactacaagtgtgtgccaccatgcccagctaattttttttaaaatttttattagagacgaggtgttgctgtgttgcccaggctggttggtctcgaactcctggcctcaattgatccagctgccttggcctcccaaagtgctgagattataggtgtgagccactgtgcccagccgagtgcatttatttaatagctgtgtacacttggacttaactcatggctttaacccatggctggctttaacttagccttttgaaagtctataagtttatagcttcagacacatattaatacttactttttaggacctaatgaaaacagtttatattatcatttgtctttctactaggagttggaaggaaattttcagtttaatgaagttttaagttatattaatttgagtctagaaaatttgtacaactttttttgggaaaccttcaaaagtatttgtttcagatggtgtaaaatgaaatgcataaatacctatttccataatatctttgtacttgaaaataatataaagttaaccttatgtacccttctgaaaattaaaagcatttaataaagtataatttttttaaattttattattattatactttaagttttagagtacatgtgcacaacgtgcaggtttgttacatatgtatacatgtgcaatgttggtgtgctgcacccattaactcatcatttagcattaggtatctctcctaatgctatccctccccctcccctctcccccctccccccttcccccaccccccttcccccaccccacaacagtccctggtgtgtgatgttccccttcctgtgtccatgtgttctcattgttcaattcccacctatgagtgagaacatgcggtgtttggttttttgtctttgcggtagtttgctgagaatgatggtttccagcttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgctataaacatacgtgtgcatgtgtctttatagcagcatgatttataatcctttgggtatatacccagtaatgggatggctgggtcaaatggtatttctagttctagatccctgaagaatccccacactgtcttccaccatggttgaactagtttacagtcccaccaacagtgtaaaagtgttcctatttctccacatcctctccagcacctgttgtttcctgactttttaatgattgccattctaactggtgtgagttggtatctcattgtggttttgatttgcatttctctgatggccagtgatgatgagcattttttcatgtgtcctttggctgcataaatgtcttcttttgagaagtgtctgttcatagcctttgcccactttttgatggggttatttttttcctgtaaattttttgagttcattgtagattctggatattagccctttgtccaatgagtaggttgcaaaaattttctcccattctgtaggttgcctgttcactctgatggtagtttcttttgctgtgcagaagctcttgagtttcattagatcccatttgtcaattttggtttttgttgccattgcttttggtgttttagacatgaagtccttgcccatgcctatgttctgaatggtattgcctaggtttccttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgttttcctccagtttgtcaaagatcagatagttgtagatatgcggcgttatttctgagggctctgttctgttccattggtctatatctctgttttggtaccagtaccatgctgttttggttactgtagccttgtagtatagtttgaagcaggtagtgtgatgcctccagctttgttcttttggcttggaatcgacttggcaatgcgggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttctttcatttgtttgtatcctcttttatttgcttgagcagtggtttgtagttctccttgaagaggtccttcacatcccttgtaagttggattcctaggtattttattctctttgaagcaattgtgaatgggagttccctcatgatctggttctctgtttgtctgttataggtgtataagaatgcttgtgatttttgcacattgattttgtatcctgagactttgctgaagttgcttatcagcttaaggagattttgggctgagacaatggggttttctagatatataatcatgtcatctgcaaacagggacaatttgacttcctcttttcctaattgaatgccctttatttccttctcctgcctgattgccctggccagaacttccaaaactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagcgttgctgaattttgtcaaaggccttttctgcatctattgagataatcatgtggtttttgtcgttggttctgtttatatgctggattacgtttattgatttgcgtatattgaaccagccttgcatcccagggatgaagcccacttgatcatggtggataagctttttgatgtgttgctggattcggtttgccagtattttattgaggatttttgcatcgatgttcatcaggcatattggtctaaaattctcttttttggttgtgtctctgccaggctttggtatcaggatgatgctggcctcatcaaagagttagggaggattccctctttttctattgattggaatagtttcggaaggaatggtaccagctcctccttgtacctctggtagaatttgtctgtgaatccatctgatcctggactttttttggttggtaagctattaattattgcctcaatttcagagcctgttattggtctattcagagattcaacttcttcctggtttagtcgtgggagggtgtatgtgtcgaggaatttatccttttcttctagattttctagtttatttgtgtagaggtgtttatagtattctctgatggtagtttgtatttctgtgggatcggtggtgataccccctttgtcattttgtattgtgtctatttgattcttctctcttttcttctttattagtcttgctagcagtctatcaattttgatgatcttttcaaaaaaccagctcctggattcattaattttttgaagggttttttgtgtctgtatttccttcagttctgctctgatctttgttatttcttgccttctgctagcttttgaatgtgtttgctcttgcttttctagttcttttaattgtgatgttagggtttcaattttagatctttcctgctttctcttttgggcatttagtgctataaatttccctctacacactgctttgaatgtgtcccagagattctggtatgttgtctgctttgaatgtgtcccagagattctggtatgttgtgtctttgttctcattggtttcaaagaacatctttatttctgccttcatttcattatgtacccagtagtaattcaggagcaggttgttcagtttccatgtagttgagcggttttgaatgagtttcttaatcctgagttctactttgattgcactgtgatctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctgttaggtccgcttggtgcagggctgagttcaattcttggatatccttgttaactttctgtctcgttaatctgtctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgtatgtgagatgcatttcctgaatgcagcacactggtgggtcttgactctttatccaatttgccagtctgtgtcttttaattggagcatttagcccatttacctttaaggttaatattgttatgtgtgaatttgatcctgtcattatgatgttagctggttattttgctcgttagtagatgcagtttcttcctagccttgatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgtcgaatattggcccccactctcttctggcttgtagagtttctgctgagagatcagctgttagtctgatgggcttccctttgtgggtaacccgacctttctctctggctgtccttaacattttttccttcatttcaactttggtgaatctgacaattatgtgtcttggagttgctcttctcggggagtatctttgtgacgttctctgtatttcctgaatctgaatgttggcctgccttgctagattggggaagttctcctggataatatcctgcagagtgttttccaacttggttccattctccctgtcactttcaggtacaccaatcagacgtagatttggtcttttcacataatcccatatttcttgaaggctttgttcatttctttgtactcttttttctctaaacttctcttcttgcttcatttcattcatttcgtcttccatcgctgataccctttcttccatttgatcgcatcggctactgaggcttgtgcattcgtcacatatttctcatgccgtggttttcagctccatcaggtcctttaaggacttctctgcattggttattctagttagccattcatctaattttttttcaaggtttttaacttctttgccttgaactaaaggaggaggttcgaacttcctcctttagctcagagtagtttgatcgtctgaagccttcttctctcaactcgtcaaagtcattctctgtccagctttgttccgttgctggtgaggagctgcgttcctcagttggaaatgcagaaattacccgtcttctgtgtcgctcacgttgggagctgtagactggagctgttcctattcggccatcttgtctccacccccgagagaaaaagtataatttttctgtgattccttttcctactctgttggaacatctgctaaactttagcccatcatacttcttatgcttgtataacaacatgaaaacctgtaataaccagtttttggcatcatacattattataagactttgtcataatatttcaggaaggtaatgctgttgaatgtactaataagttacaaaattaatttagatgatttcctagctataacctattgaaaatcatttgttttggtttccaatctgattgaaatcctaaaaatacttaaaataatttacagagtagcatgtaataggaatcgttcaatatacatcagcacacatcctgtgtattcattacatgaaatggtactcgaacattgtgaatataaagttatggtatagttttaattaagactgtggactctaaacctgacctaaaatctgattctgtcatttgctacttgtgttacttcattttattgcgtcatggtttcctcatctctaatggaggaacaagagattttatagaaattagataaagtagtgtatgtgagtgttaagcatagtacctagaatatgataagatttaataaatgttagttattattttatataactagtattatctggttatgaaaggaactttggcttttagtttcaaatttatctttctagccattttatttaagacgtttatacaagaagaaatacataaagaatgaggtaaatgacaaattagcaatgtaattgttatcaactagtggaggcacttttagcaggcaaattactcattattatggtcaattattttggcaaataattaaagaaaatgaaaaagaagaccaccagactatgaatgactttgcctttaactgatgctgatagaatttgttttaaaattttttcactattaggaagtagcctggttttgactaaactttttaaaaagaaaaaaaagtttgtttgaaataattacagattcacatgaacttgcaaagatagtacagagaggtcctgggtacctgtcacccagtttccccaaatgactacatcttatgtaactgtagtatattttcatagcccagaaattgatattggtacaatgtgtgtatatagttctgtgacattttatcacattatggattcatgtaaccacctccacaatgatgatacagaaatatttcaccataagagacataaattacagaactcaagaggagggggaaggaaagaaaatttgttgtattgacacatattttgcttaccatgttctttcttccttcctgatgttccaagataccctcttttatcattttcttttggtttagataacttcttttaactaatagggtaggtatgctggtgacaaaatcttagttttcctttatctgagaatgctttaatctcccctttattcctgaagattttgtttttgcttgatataggattctgagttgacagttcttatctttcagcacttgaaaaatcctttgtgtctcttctttatggcctccatggtttctgatgaaaaatctgctgtcatgtgaattgtttcccctgataggtaaggtgtttctttcactgctttaaaaattttttatttgttaacaactttcaaaagtttgattatgatgtggtttagagtcaattttcttattttatttatgtattttttaatttcaatatgtttttgaggaacaggtggtgtttgattacacgaataagttcttcagtgatgatttctgaggttctgttgcacccatcactcaagcagtgtacactgtacccagtgtgaagtcttttatcccttgccacccccatccctttctcctgagtgtccaaagtctaatgtatcattcttatgcctttgcatcctcatagcttagctcccgcatatgagtgagaatacatgatgtttggtggttttccattcctgagttacttcacttagaatattctgatatgtatataatgatgctacctttatccaggttgctgtgaatgccattatttcattccattttatgtctgagtagtattccatggtgtgtgtgtgttgtgtatctccacattttctttatcctagagtggattttcttgggtatattcaatttgggatttgcatggcttctcgattctgtaggtttcttatctctttgagtactttttcagccccaccctctttctctctccttcttatctctcatattgcaaatgttagatcgtttgttatagtccctaaagtccctaattctgtattcatatttttttcagtttattttatctttgtttttaaggttggataattagtgttcttctgttttacagttcactgatttttcctctgtcttttccattctgctgttgagcctatctgttgggtattttattacaattattgtattttttgcttttaaaagatccatttggttcttctttatatcttctatttctttactgagactttatttttttgctgaggctcttggtttcaaatgttttcataattgctcaatgaagcatttttatgatggctactttaaaatctttgtcagataattctaacatcgctgtcatcttgctgtcaacatctattgatactttttttattatactttaagttttagggtacatgtgcaccatgtgcaggtttgtcacatatgtatacatgtgccatgctggtgtgctgcacccattaactcgtcatttaacattaggtatatctcctaatgctatccctcccccctccccccaccccacaacaggccccatagtgtgatgttccccttcctgtgtccatgtgttctcattgttcaatttccacctatgagtgagaacatgcggtgtttggttttttgtccttgcgatagtttgctgagaatgatggtttccagcttcatccatgtccctacaaaggacatgaactcatcattttttatgactgcatagtattccatggtgtatatgtgccacattttcttaatccagtctatcattgttggacatttgggttggttccaagtctttgctattgtgaatagtgccgctataaacatacgtgtgcatgtgtctttatagcagcatgacttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaataatcaccattctaactggtgtgagatggtatctcattgtggttttgatttgcatttctctgatggccagtgatgatgagcattttttcatgtgtcttttggctgcataaatgtcttcttttgagaagtgtctgttgatatccttcacccactttttgatggggttgtttgtttgttttttcttggaaattagtttgagttcattgtagattctgaatattagccctttgttagataagtagattgcaaaatttttctcccattctgtaggttgcctgttcactcttttggtagtttcttttgttgtgcagaagctctttagtttaattagatcccatttgtcaattttggcttttggtgttttagacatgaagtcctcgcccatgcctatgtcctgaatggtattgcctaggttttcttctagggttttttatggttttaggtctaacatttaagtctttaatccatcttgaattaattttagtataaggtgtaaggaagggatccagttttttttttttttttttttgagacagagtcttgctctgttgcccaggctggagtgaagtggcatgatctcggctcactgcaacctctgcctccccggttcaagcgattcttctgcctcagcctcttgagtagctgggactataggcacacgccaccattcctggctaatatttgtatatttttagtagagacggggtttcaccatgttggcaaggctggtctcgaactcctgacctcaagtgatccacctgccttgacctcccaaaatgctgggataacaggtgtgagccaccacacccagccctattgatacttttttaatgcagctgaatcttcctggttcttggtatggcaaatgatttttttgatggcaacctggacattttaggcattatatcgtaagattctggatctcattgaaactttcttttttctttctttctttctttctttctttctttctttctttctttctttctctttctttctctctctctctctctctctctcttttcttttcttttctttcttctatttaaaatcttgccctatgaatgaaactttctgtcttagctggcttcatctgatactgctgtgtcaggggagggagggcactgcctcattactgccaggtgggtctagacagccaggtttcctaattgacctctcttgatacctaagagggtggtttttccttactggtgggtgagggtggaagtcctggctcctcactagacctccagtgatatctccctgcctgagagggctaagagtgccttgttactgctttacacatagccttcactgacatcattagggggatggtctcacagccactggatagtggtgaaagtcctggctctccactgggcctcttctgaccccatcccagcgcagaaaggagtgtgtttcattacagcattgtgaaggtggaagtctaggattcccactaagcctttggtgacgtggatgagggtgcagccatatttttttctgtagtgtttagctggagtagagtaattattgtctaaaaattttctgtcctaatattctgccctttttctgatcctctggctagagagagcagacttttcttcttctgtgtttttggtttgtgctcactgtcatttctaggttgccaacttcttcagctttataccttgaatatattaggcaaaaagaacacccaggaaaatctccactgtgctattccttgggtcctgaggtccctagcccatctgcttcttcctgccacctttcagaaccattttatgtttttatatacaatatccatgattgttagccatattttgtaggagaaataaggaaaaaaatgcatctacctcatctttccagaggaagtttgacttattttggccttgctgactttttcgtaagttattatagtttgattatatcttgaaaccagaaactattccttgtcctaactcaggagacattttggagtggctttatattctattttgctgctttgtcaatagagttatttaaagttatcattatgtaggcaacagttccttagtttgtaaggcaaaatgctgaatctaagaaacatgtaccacatatgtgtctgttatatctgtaagaatttacttatttaaaatcctgtttgcgttaagggtaataaaagtgaagtgatatatagatgacagatttcatgagagaaaaattttgaagtcagaatggggatgagtatcatactgaattcagtaatgtattatatataatgcttaagtaatgattaacgtatacattattgcagtaccggttaactagtgatcacataattctcatcgaaattgtttagagacataaaatattggcacagggtattgttttacattctttgaaacagtaaatgtagattggattgaggaaaaggctatctgctttaacaataaatttcctaggtacttcagtagcttactgtgaatttactttgccctgtctgttgtattactcttaaaggagttagagaatatggcttcaaaataatatcagtggcattgctttcccctgctcttgcaggtgaaatccactgataaaggggaagaagatccattgatggtcataaataaaatttatcctaaaagtgtaaaatattcagagctgaatacagctctctatatatcagccctctgagtttatagatgaggaaactgaagcccagtaatgttaagagacctgggaaaagtaacaagctacttagaaggaactgggacttgaattcagattctctgatcctggggccactatattttccattagctggtacagtgagggaagaatcagacctagaagctgccctcaaagagtctactggagcagatgggaagggcaaaagtaattgtaatacttggtagaaagtgacctttcccataaaagagatttggataaagttttttgaaatgtaattctttaagcatttaaactgtactttaattttgtactatgcatacataaaaggaaagaagtcagaaatcttatttccagactcttttagataaagaggtccccaaatttattaatttttattttgaaaaagtatactcgggataaaaatgtggatgattatgtctggtttagagtgtttcataatttaattaacctaagataaatttatataagtaaatagataaatgaataaatgtactcacagaagatatatatatgtgtatatatatatatattttaaagagtagattcagtggatagaagtttcaaagagttagatgtcacctcggtataaggagatttttctgataaagctattgaagtacggaatgggccatctcaaattatagggagttcacattactagaggtggttaagggaaggctagttaacttcttaacagggatgagagtttagagggaaattaagcattgtgtaagtggcaggacccatttgatctgtaaagttccctttgaactttgagattttatgatttgaattatttcaaattttgcctaaactttggaggcttgggcatagtttaaatattgtatttttctcattttcaataagagaaatcctttattttccaatttttagagtatttaaatgtcatgtctagcagtaaaaaataatagtttttttttgtagcgtaacatccttatttgttaaggttatgttttatgatttcaccaaatttgtatttcatcataggtacatataggactaacacattttaatacatgcctcatagactggaagaatttcaatctacatatttcatatgctttctatttttttaaattataaaggcatctaacacacatggcaaaacatttacagaaacccaaagtatccatgaaaaataagtcttctctctctggaggcagccattgttatcattttgtttatttactttgcttacagatgttttctatgcaaatacaagcatgtgtgtatatcctcttttaaacacaaatggaagtacgtgatacacattgatctatggctacttaacaaaactttatattataaatatttctatatcaggacataaatacctaccttattcttttatttctcatataattaaaaaaattgagatataattcacataccatacaattcacctttttaaagtattcaaatcagtgtttttttttagtatgttcacaaagttgtgctgccattacagtgatctgattctagaacattttcatcagtgaatgcctatatactgttggtgggaatgtaaattagtacaacctctaagaaaaacagtctagagatttctcaaagaactaaaagtaggtctaccattcagtctatcagtcccactattgggtatctacccaaaggggaaaaaaaaagccattatataaaaaagacatccgggcatggtggctcacgcctgtaatcccagcactttgggaggccaaggcaggcagataattgatggcaggagttcaaggccagcctgaccaacgtggtgaaatcccatctctactaaaaatacaaatttaaccggctgtggtggcgcactcctgtagtcccagctacttgggaggctgaggcaggagaattgcttgaacccgggaagcagaggttgcagtgagccgagattgtgccattgtactccagcctgggcagcaaagcaaaactccgtctcaaaaaaaaaatccatcttcatgcatatgtttattgcagcacaattcacaactgcaaagatagggaatcaaactaagtgaccatcagctgatgagtggatgaagaatatatgatacacacacacacacacacacacacacacacacacacacacacacaccatggaatattactctgccataaaaaagactgaaataatgtcttttgcagcaattggatggaactggaggccattatcctgagtgaagtaactcaggaatggaaaagcaaatataatatgttctcactgttaagtgggagctaagctaggggtattcaaaagcatacagagtgatatcatggacactggaatctcagaaggagggagattgggaggagaatgagggatgaaaaactgtctgtggggtaccatgtacactatttgggtgacaggtacactaaaagcctagacgtcaccactatacacttcatccatgtaaccaaaagccacttgtaccccccaaactattgaaatatatatatatatctatctccttttactcatcccatttgttctataataaagtctatctcccctctccccagttcctggcaattatgattctgctttctgtttctatggatttgcttattctagacatgttatataaatggaataatacaataaatggcctattgtgtctggcttctttcccttagcataacgttttcaatgttcgtcttagttatagcatgtattagtactttcttctttctatggatgaataattctacaaggtatgaatatactactacttatgtttattcatttatcggttgatggacatttgggttattttcactttttacttattaataaagctgctgttagcatttgtgtataattttgtgtgtgttatgttacctcattattattattattattattattttttagacagagtcttgctctgttgcccagtctggagtgcagtgtcatgatctcagctcactgcaacctctgcttcccaggtacaagtgattctttgcctcagcctcccgagtagctgggaccgcaccacatgccaccacgcctggctaatttttctatttttgtagaatggggtttctccatattggccaggctggtctcaaactcctggtctcaagtgatccatccgcctcggccttccaaagtgctgggattacaggtgtgagccaccatgcctggcctattaccttatttttaataactccatagtactgtgtcatttggatgttttataatttatctaaatagtctcctacatagagacattatggttaggtatggactttgtgattgatattgaaaacagccttgcacatttctgtgtacaattgtgagataaaagttgagagttggaatttctgcagcaaaaggcatgtgcatttataaatgtatcctcattgcccctcagagaagtttcatcaatttattcctctaagtacctgtttcctcacaacctttcttaaaatcttttgaatctttgtagcattgtgatgttcatttttatttctaatatattcatgctatctctctttttctggatcagtcttttaagaagtttgtcactattattcagctaataaaatcctcagcaacccaactttcttttttgagacagggtctcactctgtcatccaggctggagtgcaaaggtgcaatcatagcactcctgggctcaagggatcctcctgcctcagcttcccaagagcaggtaggactacaggtgcatgtgaccacttccagctaagtttttaaacattttttttttttttgtagagacagagtttcattatgttgctcaggctgatctcaaactcctggcctcaaacaatccgcctaccttggcctcccaaagtgttgggattataggcatgagccactacaacaacccacattttgattttcttgatcatttattgttttagttttctatttcatttatttttgttttttattatttctccatttgtactttctttgatttttataacattgtttttctagcttattaaactagatgcatagtgcatctatttttagccttttaaaacagttttattttgttttaaattgatacatgataattgttcgtatttatggggtacaatgtgatgttttgatacatatatacattatgtaatgatcaaatcagggtaattaggatatcagtcatctcaaatacatgtcatttcttcacggtgagaacatttgaaatcctctcttctattttaaaatacattattgttaactgtagtcaccccgccatgcaatagaacaccagaacttattcctcctatctaactgtaactttttgttgagcaacctctcttcattacctgccccccactctcgcccagcctctgataaccactattctactctctacttctatgagataaacttaaaaaattcctcattatgagtggaatcatatggtatttgtcctttcgttcttgtcttatttcacttagcataatgtcctctaagttcatcaattttgtcacaaatgacaggttgcattccttgttatggctgaatagtgttccattgtgtatgtatacaacattaaaaattaatttatccattgatggacacttaggttgattccatattttggttattgttaatagtgctgcagtaaacacgagggcataggtatatgatgatagatacatatatatacttggaattgtgattgctagatcatatggtagttttatttttagttttttgaggaacctccatacagttgtctatattggctacccaaggtgatccacagagtcaatgcaatcctaccaaaataccaatgatagtttttataaaaacaagagaaaaacaatcttacaatttgtatggaacaacaaatgacctagaatagccaaagctatccttagcaaaaagaacaaaactggaggaatcacattgcctgagtaaggaaaacagcacggtactggcataaaaacagacacatagaccactagaacagaatatagaacctagaaacaaatacacatatatacagccaactgattttaacagaggtgttaggaacattcagtgagggaaaggaaagtctcttcaataagtggtgctgggggaaataggatatccatatgcagaaaaatgaaaagtagacccttatctctcaccatatacaaaaaaatcaaatcaaaatggattacagaattaaatctaagacctgaaactactacaagaaaacataggggaagtgctttatgaaattctttggggaaagaaatttttggctaagcttcaaaagcatagacaacataagcaaaaatagacagatgggattacatcaaactagaaagcttctacacagctaggaaacaatcaagagtgaagtggcaacctacagaatgtgagagaatattttcaaactgtgcatctgacaaggagataatatccagaatatgtaaggaactcaactcaatagcaaaaaagaaaataatatgattaaaaaattggcaaaagagcggaagagctgtttctcaaaataagatataaaaatggctgacagatatattaaaaaaatgctcaacatcactagtcatcagagaaatgcaaatcagaaccacagtgcaatatcatctcacccctgttagaattgctattatcaaaaagacatgaaataaatgctggggatgatgtggagaaaagggaacttacatattgttggtggagttgtgaattagtacagccactgtggaaaatagtgtgaaggttcctaaaaaaatctaaatagatctcccatgtgatacagcaatctcactgctgactgtatattcaaaaggagggaaatcagtatattgaagaaatatctgcactcccatgtttattacaacactattcacaatagccaggatatgaaatcaacctaactgtatgtcaaaggatgactggataaagaaaagctgatatatgtatacacacacacacacacacacacacacacacacacacaatggaatactattcagccttaaaaagaattaaatcctgtcatttgtagtatcatggataaaactgggggtcattatgttaagtgaaataagccaggcatggaaagacaaatattgcatattctcactcatatacaaaagttgacttcatggaggtagagagaagaatgatggttactagaggttgggaagggtagcaggaggaatgaagagaggttggttaatgtgtaccaacatacagttaaataggaggaataagttctagtgtttaatagcacaatagagtgactgtagttaacaataatttattgaatatttcaaaatagctagaagacttgaaatgttcccagcacaaagaaatgataaatgtttgaggtgatagataactcagttacccagatttgaacactgcacattatatgcttgtatcaaaaatattatgtgcaccccaaaaatatgtccaattattatgtatcagttaaaaaaaaccaaaaatcaacatcactgtaacaaatggtatttgtattcttatttttttatagatattgacaagttgttccaaaacccatgctcccatgatgagtgagtttaactatctgcccacccccttgacatatctgatgtacttttttttggcacaggtgtgcacacaatttgatagaaaaataatttattcttgttagggagtatttaaaaatattttcaacttttattttagatacagggtgtacacatatgcaggtttgttacatgggtatatcgcactcaggtagcatgcacaatacccaataggtagctttttaacccatgccccactctgcccctcacccctctagtagtccacagtgtctattgtttcgatatttatgtccatatgtgctcaatgtttagctcccacttctaagtaacaatatgcagcatttggttttctgttcctgtgttaattcgcttgtgattatggcgtctagctgcatctatgttgctgcaaaggacatgattttttctttttttatggctgcatagtattccttgctgtctgtgtaccacattttctttatccagtccaccattgatgggcacctaggttgattccatgtctttgctattatgaatagtatgatgatgaacatacaagtgcacgtgtatttttggcataatgatctaatttcctttgggtatgtacccagtaatgggattgctgaatcaaatggtaactctgttttaagttctttgagaaatctccaaactgctttccacagtggctgagctaatttacattcccaccaacagtgtataagtgttcccttttctctgcagcctcactgacatctgttgttcttttactttttaataacagccattctcactggtgtaagagggtatctcattgtggtcttgatttgaatttctctgatgattagtgatgagcattttttcatatgcttgttggctgcttgtatatcttttgagaaatgtctgttcatgtcctttgcccgtttttttaatggggttgtttcttgctggttgatttgtttaagttacttatagattctggataatagacgtttgttgaatgcatagtttgcaagtattttctcccattctgtaggttgtctgtttgttgacagtttcttttgctgtgcagaagctctttagtttaattaggtctcgtttgtcaaattttgtttttgttgcaattgcttttggggacttatccaaaaattctttgtccaggctgatgttgaaaagagtattcataggttttcttctacactttttatagtttgagttcttaaatttttaatccattttgagttatttttgtatatggtgaaaggcaagtatccagtttcattcttttgcatatggctagccaagtatcccagcaccatttattgaatagggagtccttatcccgttgcttgtatttgttggccttgtcaaagatctgatggttgtaggtgtgtggctttatttctgagttttctgttctgttccattggtctatgtgtctgtttttgtaccagtactatgctattttggttatgtaaccttatagtataatttgaaatcaggtagtgtgatgcctctggcttttttctttttgccttggctatttgtgctcttttttggttccatatgaattttagaatagttttttctaattctgtgaagaataatgttggtagtttcataagaataacgttgaatctgtaaattgctttgggtagtatggccattttaatgacattgattcttcaaatccatgagaatggaatgtttttccatttatttgtgttgtctttcatttctttcagcagtgttttatagtgctccttgtagagatcttttacctccttggttcttggtgttcctaggtatttcattttctttgtgactattgtaaatacgattgtgttcttgatttgactctcagcctgggtgttattggtgtatacaaaggttaccgattttcatacattggttttgtatcccaaaatcttgctaaaatggtttatcagttctagtagcgttttggtggattttttagggtattttaataatagaattatatcatcagcaaagagggatagtttaacttctttttttcctatttggttacctttttttcattctgtttcatgattgctctggctagacttcctatacatcttttaagccttattgtatgtcctgatatttagctagagatggctgaatcttttcttacgcttctcggatattcacatttctttttctgcgaatttacaatttcaaatcatttgccctatttgtgcttttcttttgaattttatgaattctttttctcctttgaatttttattcttagtcacttttgtatgttactattattttatccttctttgttgattgtcttttatttttagatgatcaattttactgtggtataatttacctgcaatagaatatgagatacccctaggaacctactagaatgtctaaaattaaaaaaagaatacctaactgacaatgcgaaggtgctggcaaggattgtgagcaagtaaaactctcatacattgctgatggaagtacaaaatggtacagctaccctggaaaacaatttggcagtttcttacaaagttaaatatacacttaacatatgatccagcaatctcattcaaaggtatttaccatagacaagtaaaagcttatgttcacagaaaaatatgtatacaaatgtttatggtagctttatttataattgccttaaactgaaaacagcctgagtggttttcagctggtgatagaataaacaaacgtggtgtatgtacaccaaaatatactacttaacaataaaaaggaacaaagtactgatacatacaaaaatttggatgaatctcaaaggcgttaatgctaatcaactaaaagaggtcagactcattaaggctaaatatattatgattccatttatatgacattctgggaaaggcaaaattatagggacagaaaacaagttagtgcttgctggagaatgggggtgaaaagtggatgattccacatcaaggaaatttggacagtgatggaattgttctatgctgtatcttgattatggttgtaattatgactattatatgtttgtcaaaactcagctgtacacctaaaaagtgtgaatttttctatatgtaaattacacctcaataaacctaattaaaaattttaaaattaaacccatgtgatttgcattataaattggaccaccatttgtgattatgaaatatgaacttgccaataaactgctacaggtgacgctaaactataaggagccccttctgctgcgtctactaattaaatactttgaatgaggttcaaaaatggccaatttgaaaataaaagtaacttttaaaacaaaagttgttacacagatattcaattgcagaaagagtaagagctttgctcaaaaacttgaatatgacattcacataatatccactgtttctaggaaaaaaacttataataatgtctgcatctgtacattactttagagtttgtaaggtacttttatatatgccatctcattttgaattattgcaaaacaatgcctcactagcaaagaataaatgttcccatgaagctgcaagcccctatgactatgaatacaattgtgaagtagggattgtcagaccccaaggttcattttctccctgagtgacacttaatccagaggtaaaaatcagtctcagatagtagaacaggccaagttatgtggtaaggctgtggtgtccccaaacagaagcaactttgatggaagaaaacagagaatacatgtaaacatgtatttgtgcacatttgtattacatggctgctgagagaaaacagcaggctgtttcctttctagggcctgtttatttctgagcatatctccttggtgagtgctccccacaaaatactggtgcataatacgtaacatctttccttaatcataatgcaccccctacgtccctggtcccaggccttttctcaccatgttccctcgtttttgaatatacttttatactcccacaccctccacaaggcagtaatttaaacctcatccatccttaaggaccagccccaaacgtcctcattcacccaagcagaagtaattactttttgtagattcccactgcatactgcttaactttctcttatagaattgatcacatttggcattgcctcatatagatgtttgattgcttccagttgtaaactcattaagtacctagcctagttcattggagacccaccacaccagctagcagtgtgccttgctatactgtaaggtcttagcactttcactgaagttcaggcataatcaagtgtgccacatgattccagaaagcaccaagccaagaggaaacacagaggtggatgtggaaagcaaaatacaataataaagcaaaagtatgtttctccctgtgttagtcggggttgttcagagagaaacggaaccattaggagattatctatcaaggggtgggggttgagagaaggggagagagggagagagagagagagaagaagaagagaagaggagaagagaagaaaggagagaggtgagagaaagaaagaaaagaaaagaaagagaaaaaagattttaaggaactgtggaagcctacaggctggagacccagggaagagttaatattgaagccccagccaaaggcagtcttcttgtttgggggtgggggacagaaaaggagcagtcatttttctattaaggccttcaaatgattggatgagactcatcaacattaggaaggataacctactttatgcaaagtaacctgctttactcagaaacgtctagaataatggttcaccaaataaccatgttgacacataaattaaccatgagacctttttttctctacaagatgctccacaagtctcttcttcccagtccttctcccaatgcaacgactgcagtgggagccacctccttaaaaaggaagcagttttatctaaggcatgctaaacaaattcctggaaaggtctaactaaatgataatgcttcagaaactatagtgatcacataaccaaaaaaattccaagttattttaaagttgcagataaatcccaattgtgtataataatttatcttgtgattggtgagttttgttacattgcagtcacatttaaaaaaaatctctcagaagaattaatttcaaaataaacctcaatcctggaacacattacaacattctcttcttatgctcctctttctaaataaggtaccagtgacctcaactgaaactgcagtttaactttattaaggaagaagaaatagaagggacaaaaactgttgtaaaataaattataaatattaataatcactaatgctgaaatttctagtgctcaaataaacataaaattagaaactggtctgttctgcctatggagtagcgattctttattcctttactttcttaataaacttgcttttacttaaaaaaaaactgtcttaactattttaatgaagtatttgaaaacagtttttttcccacaaatatcttatgacacagaaatagaacctagcagactattacactagtgagcaaataatgaacttttggtaaagcatacccaaccttcagttagaatatctcctgataataagaaagatctcattgaaatttattaattcttttgtgtctagtagataacttggatggcacacagtgctttgatttttacctgcccagaatttaactcctcatcctatcctacatgattttctttttcctctcccccttcctcttttattccatgtcactgggaatggcaggtcttgcaccaagtaatggcaggtcttgcaccaagcaagccagaaacctgagctttagtctttattcctccccacttttcactcctgcatccattctagtagtgaaaccattcaatagctttcaattaatccttcctctctcttttttcttagttcagattctttagtttgaattactctatcagttttctaacttatccactgacttcaggacttgccttccttcagtttgttcaactgcattttgagaaatactgctaatgctattctgaagtcactcttgcttgaaagtatttcagtggctccccagtatcatcagtataaaaaaatctttttttgagttacacataaacccttcagtatggacctgatcacttgctaattctcatcgtcttccacacacagcaaacaaactgacttttctgctgtggtttatgttttatctcccttatgtggctccctctgcctggaatgcccactccgttccccactttgcctagttaacccatatatgttgtctaacaaagactaaaatcaacctttgtcacctctcagaagctttacagacacaagaatattaactgtagtgtattgaacttgggaaaagagcaatgatctgagatactgagtcaaaaagcctcacagataatctaaacaatttccaatccaaaggggctgaaccagtagtttacaatgtattatttcccccatactattcatatgtgtagtgcattctatcagtaactctcaatataagtagtgaatctccagaagggaagggaacacttcgggagggataattcaatgtgcacatgttgggacagaggaaaagaaagaaaagaaagagaagcagcctcacaaacctaagaaaatcttatcaaatttttatagtgaaacagtttgggggtgggtggcattgaatcaaaaatgactttactggaggtccagttttcaaatgtagataataattatgggcacagagattttatatagagtttacaacttgacaataagctcttacaaaatcgccagtggaaaatgtttgccatggtcataaattcagtgacctgcttgaaagatgtgtggtatttaccctatcttgctccagccagctcatacagaaagcagcagcataatccaaaggagtggggacatccatggaaaatttcctggcctggcagtttgcatgataagtgaagaaaacacgatttactaagaaaaatgcaggtggaacccccacagcaggatgaggccaacaaatttattacactaggtgaaatacacatgaatgtctgctgccaggtcagactcataaatatgcattaaaagagattctgaacccttatgagaaccagttttttctcaacctacaagggctgacagatttatggttgagggttttacttcacaaacaaacccttaggtagaacctacatttctgctaaggtcatagtgttctttcacaccaaggagactcctaagaagaaacaaacagttttttaacagtttatacaggtagaacattccagtaatcagcagatagcaaaatctgtgactataatgagcaactaaaatggaaaaaagcagaaaaaataggacaagggagtcagaaaggacagacattttttctaatctctactttgctacaaattagttagctatgaggaccccagtttcctcatttataaagtatgttaagggtaggaagataataaaatcttttaaggtctgtcccagcattgaaacagtaggatttgatctagagtgacctccctgacagatacgagggtgaaatagaggcaggctcacatgacagttactggcaaggaagagaaatgggtagtcatgactggtggaagtgagtaaaagttacaaaagtaagctggacatacagtctgggtagccaactttatattgttagaaagtttaaccattcttttccaaacatcccttcccacaactttcaaaattattccttaactcttctatgactttctattgttatattctacatttgtatcacaataatgttaacatcaacccctagtacaggtagggctgaaatttcagtcaatctactcttatatccacagccaagtatatgtagagaggatgatattgggggatgatatggtttggctgtgtccccacccaaatctcatcttaaattccacgtgttgtgggagggacccagtgggaggtaattgaatcatgggggcaggtctttcctatgctgttcttgtgatagtgaataagtctcacaagatctgatgttatataaaggggagtttccctgcacaagctctctttttgcctgctgccatccatgtatgatgtgacttcctcctccttgccctccaccatgattgtgaggcttccccagtcatgtggaactgtaagtccattaaacctccttattttgtaaattgcccagtctctggtatgtctttatcagcagcatgaaaacagactaatataggggagaagggagaaatagagggaatgaggacttctttcttcatttgtggggtttttttttttttgagagagtgtctcactctgtaacccaggtgatagtgcagtggcacagtcttggttcgctgaagccttgacctccagggctcaagcaattctcccacctcagcctcctgagtagctggcaatagaggcactcaccaccacacctggctaatttttaaatgtttggagacatgggggtctcactgtgtttcccaggctggtctcaaactcctgggctcaagtgtcttcccacctcggcctcccaaagtgctgggattacaggtatgtgtcactatgcccagcctctttctccatttgacatcatgatataggcttcaattcatcaggaagagaaaacaattctaaacttttgtggatctattgcatagcttcagaatacataaagcaaaactgaacaataagaaaatgacaaatctgttcatgtccttcgcccactttttgatggggttgtttgtttttttcttgtaaatttgtttgagttcattgtagattctggatattagccctttgtcagatgagtaggttgtgaaaatttcctcccattttgtaggttgcctgttcactctgatggtagtttcttttgctgtgcagaagctctttagttgaattagatcccatttgtcaattttggcttttgttgccattgcttttggtgttgtagacatgaagtccttgcccatgcctatgtcctgaatggtaatgcctaggttttcttctagggtttttatggttttaggtctaacatttaagtttttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcacatagttgtagatatgcggcgttatttctgagggctctgttgtgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttgattccatatgaactttaaagtagttttttccaattctgtgaagaaagtcattggtagcttgatggggatggcattaaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctttgtttgtctgttgttggtgtataagaatgcttgtgatttttgtacattgattttgtatcctgagactttgctgaagttgcttatcagcttaaggagatcttgggctgagacaatggggttttctagacacttctcaaaagaagacatttatgcagccaaaaaacacatgaaaaaaatgctcaccatcactggccatcagagaaatgcaaatcaaaaccacagtgagataccatctcacaccagttagaatggcaatcattaaaaagtcaggaaacaacagatgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgccgctataaagacacatgcacacgtatgtttattgcggcattattcacaatagcaaagacttggaaccaacccaaatgtctaacaatgatagactgggttaagagaatgtggcacatatacaccatggaatactatgcagccataaaaaatgatgagttcatgtcctttgtagggacatggatgaagttggaaatcatcattctcagtaaactatcgcaagaagaaaaaaccaaacaccacatattctcactcataggtgggaactgaacagtgagaacacatggacacaggaaggggaacatcacactctggggactgttgtggggtgggggaaggggggagggatagcattgggggatatacctaatgctagatgacgagctagtgggtgcagtgcaccagcatgtcacatgtacacatatgtaactaacctgcacattgtgcacatgtaccctaaaacttaaagtataataataaataaataaataaataaaaatatttaaaaattaaaaaaaagaaaatgacaaatctaccaattggagtggaaaattgtaaaccacctctctcagtaactgatagaacaagcagacaaaaaaaaatctattatggttatacataatttgaatacaattatcaagcttaatttattgagtatacatagaatatttcagcaagtggagaaaatgtcttatcacaagtatggacagaacatttattaaaattgaccatatactaggccatcaaacaagtctcaacaactagtgaaaggactgaaaattagagtatattctctggttactgtgcaattatgctaaaaatatgaaacaactaaaaatagccatgtatggatattgaaaaacatttttaaacaacacatggggtgaaagaaatcctaatagaaatgtaaactacttaaaactgagcaataacaaacactgcatagcaaaacgtgtgaggtgcagcgtaagcaaaacttacaggaaaatttgtagccttaaatgcttacacagccttcatcacttaacgacaggtatacattctgagaaatgcatccttaggcaattttgtcattgtgtgaatatcatggagtgtacttacacaaacgtatgtggtatagcctactacacacctaggctatatggtatagcctgttgctcacaggctacaaacctgtaatgcatgtgactgtactgaatactataggtagttgaaacataatgatctgtatttgtgtatctaaatatatctaagcatataaaaggtatggtaaaatatggtataaaagataaaaaatggtacacctgcatagggcatttatcatgaatggagcttgcaggactgaaagttgttatgggtgtcagtcagtgagaagagaatgtgaatgcctaggatattattgtacactactatagactttataaacactatacatttaggctttactaaatttataaaaaatattttttctttggtaataaattagccttaacttactgtaactttttactttgtacactttttaattttttaaaactttttgcctcttttgtaataacacttagcttgaaacaaaaacatattgcacagctatacaaaaattctttttttatatccgtacatatatacatataatttctttatataagcatttttcttttttcatgaactggaagaattaatattgttttttatttgtataaatgtaaggggtacaagttcaattttggtacatgggtatattgtataatggtgaagtcttggcttttaccatatatatgcctttttctatttttaaaattgttttttttttttttttttttacattttaaacttttttttgttaaaaacgaagacacaagcatatacatcagcctgggcctacacagggttaggataatcaatttcactgccttccacttacacatcttatctcactggaaggtcttcagggcaataacgtgcatggagctgtcatttcctatggtaacaatgctttttttctggaatacctcctgaagggatgtgcagctgctcagctcagcaaaggcaccaactcccaagggggcaattttcagtttcagttcaggtgagggtgtgtgtgtgtgtgtgtgtgtgtgtgtgtgtgtgtgtgactcttctggatggccctgttttcaccaggatgcagggctccaccaaagcgctgtttgctcagcagcagagtgcagattcagctcaggtccctaggggcagggtgcaggcatggctgggagaagatggagctgttctgccaaagtatgggttccccaggagggactgcgcagcctcaactctgcctgaggggatgggggaaggagtgggtggagcagttccaccatttcttggccccacagggaagggacagttgttcacagctggacttgaggatatagggccactaagcaggggtggtttgagggcagtttagtctcagggaagaagatgtgctgtgactactcgtactcatcctggggcaagacatactctagcattagctctcagtgcagtagccctgtgggccacttggggtggggcacagtgttggcttcttatctgtggggggagcacagctttgtggtctctaggcagctccctcagctgagcttaatgctagtgaggactgcaggggaccccagtagtgaggattgtaggtatccaaagggttgatgggggctgctgggatcctcttgcctacctttgcaccatagagagaagttccttctggttcccaggttatctcacatgggggatggggtgatggagtcctagtatttccttccgttctttatgtgactctcctgagtttctgtgctcaccaaggtttgtgttactcctttgacgcaccctggtgttctccattagttattttcattaaaatatagctgtttatttgttgttttgcttgtctttatggaagggaggagggctaggggcttctagtcggccatcttcctctctacccattgtgcttttctagtgatactgttctgaaggctggatccaacagaaattgtgtgtgtgcagagatgtgtaaataagaatgcgatattatagtcatgtgtcacataacctttcggccagtgattaactgcctacgaaattgtggtcccatatgattataacggagctgaaaaattcctattgcctagtgaagtcagatccctcctaatgttgtagtgcaaagcattcttcacgtgtttgtggtgatgctggtgtaaacgaccccactgtgctgcttctagtggtataaaggtatagcaatactgttatatatatagtacataatacttgataataaatgactgtgttactggtttatatatttactatactttctattgttattttagagtatattccttctatgtatacaaaaacctaactgtaaacagcttcaggcaggtccttcggaaggtattccagaagaaggcattatcatcataggagatgacagctccatgcacgttattgcccctgaagaccttccagtgggatgcgatgtggaggtggaagacagtggtatttatgatcctgaccctgtgtaggcctatgtgcttgtgtcttagttaaaaaaaagtttaaaaagtaaaataaaagtaaaaattgaataaggattatagaataaggatataaagaaatacaatattttttacagctgtataatgtgttttaagctaagttattacaaaagaggcaaaaagttaaaaaaaatttaaaagcatataaaaaaagttacagtaagctaaggttattattgaagaaagagaaatttttttataaatttagtttacctaagtgtacagtgttgataaagtctacaacagtatacagtaatgtcctaggccttcacattcacttaccactcacttactgactcactcagagcaaccaacttccagtcctgcaggttccattcatgctaagtgccctatacaggtgtaccattttttatcttttatactgtatttttactgcaccttttctaagtttagatatgcttagatacacaaatactgactattatgttacagttgcctacagtattcagtacagtcacatgcattagaggtttgtagcctgtgaacaataggctataccgtataacctgggtatataataggctatatcatctaggtttgtgtaagtgtattctatgatgtttgcataatgatgaaatcacctaatgacacatttctgagtacctatccccattgttaagtgatgcatgactgtacttacaatgagaaactattggaaactctctatgtatataccaatgggaagaataaagaattgtctcattgtgttcatgggcacgtaccttaatgactaatgattttgagcatctttccatatatttatttgttattccatatatctttgagtatgtgttcagatttttgcccattaaggaaaaaaactagattttctttcattgtagagttgtaatttttttattgattctggatgtaaatctttcatcagatgtgtgggttgcaatttttcttcctggtttgtggtttgtcctttcattttcttggtagtctttctcagaacaaaatattgtaatttgataaagatcattttgtcaggtttctctttcgtagatcatgtttttcatagctacaagatctttgcctaacctaaaatcctgaagattttcttctatcttttcttccagaagttgtatatttttgggttttatatttagatctgtgatccactttgagttaacttaaagcaaataagatttatttgctaggaatacttttatttgtttaactcataaaataaatatgttatgaaaatgtgttactaggagttattgcctccagttggtattttggaagcatgggattgttagtgacatttaagctcttttgaccctggccagaagttagaactatagttgatttcataatttagtgacttaaaagtgtgtagtatctggagcaaatcgtttcatgaaagaatacttaccaatatttatttttactattttacccctgtagttctgtttcattaaaaataaacacttgtcctgacccactaaacagatttcatgtctcatgactggttccagataatttaaaaagcatactggcttaactatcttcctgaattggaactcacaatcttcaccacctccactactaaataaatattacctgtcattacccttttctgtctgctttgtaacaattctacttggtttttctctaagcacagtttaatttttgttatgactttacaaatttttagataatatactatcagctatgttgtcagaaaaaaaacagtaaatggagtaatagaaggaacttattgtgatactgtagaattttagtatctattaaaatagcgatgtccagccctggaggagctataactcttccgtatttgtgtttcattacctattcctgtcttagttgagtttcttttacttctatgtagcagaaacacactggagcttgctctagcctaatggagcctagggaggccaagggcaggaagctagaagggctcagtaactttggaagctattcttgcttcttgtatcatttgtgttccaggctacgttggctctgtttctttttatgtgagtcctttacacctctgtctttctgaagactggctttctctgatttctctgtgcatatgactgccctgagaccctgggattacttctggccagactagaattgctctgctccaattcccaggagagatagtatatataattagtttaggacaagttccacttctggtctaatcagcatggcccaaaggtagttagattggaaagaacaacccatgtttgccttgtgggtagatggtatgcagttctcagagactgagaagggtgctgggtctactgcaagttcacaaaatgctggttggtatacatttaccttttaaaatgaattttaattaatttggttttcagaatgtagaagtttataaaaagttcattgtatattaaaaaagactgagttaaggattacaaaactagaaaagtcacactgacatcaaaggatgactattcttttattactttcatgttaaaaataattaagcttatataacaaatttagtcaaatatattgaccacagagtactctttattttcaaaggtggtagtcatccacatagtgaacgtcttgtcgatccagcagttgaaggtgttataggctaaagaaaattaatatttaaaatattagacatgcattacaaatttacctctgaagagttttcatttagatatattaaaattccaagttgtagggaagggaagatatgagacccaacatttattgtgtttctgcctagtcagtcagttaacatattttatttcattcagaccttatagccaccctttgagaagtaggcgttgttatcctagaagcagtgaagaaattaaaacacacagaaaacagctagcaaatatgtagtgaggctagcatttaagctcaagtctgtgtgactctacagtttcttctctcttcactctactgtttgggggtatgaaagtatatttattaaacttttctaaaagaggctataagtaggactatacagaagctattcagttcattttcttgtctgtgtgcttaagacagtctcagtgtcaaacatatgataatcatttctccatatctggagcaaaaagagagtcatgtcagttacctaatgttagtcacttaagcacatggattttttagaggtcattacagtgataaatcaatattttaaaatagcagtggcttcttcagtttggagagaaatgttttttaaccttatattctaaaccttaatgcatgctaaattgggaattggagggaaaaagggaaagctgacctttcttttttagtctgaacaaacaagaagaggaaagcaaagactggctaaatagtataaggcagtattttaagctttccatgtttattcacttgaaacctgttatttttcaaaaacacatttttaagtgaaaaatcagaaaatatatatgctttagaaattattgttaaagacaaattttgtaacataaatgctttatgtaatagttacataaaacaagtttaagttgtctggtattgatgatatagaggaaaaactatccttcaaatatttgtgaattttacctgtgagttaatgatggtttaccttctaatttatcaacctaaatggccttgtccaatacaattaaaatgaacaattatttggtttattgtaacttcagacttagtcggaaaaaaatatataacagctgctagggtgtaattgctaaaataactataataatttttgtctctgcatggtgaagaatatgcattaagactttagcaaaagataagactgtgctctctttgtaagtagtctgatcaaatgtggctcatgacttaaaattaatttgatataaagtaaatctagcttaattctttattaagaattcacaatgacctttttgaaatagaggaatttgagatgaggatgagctagatgctccagagttcacattgctgctaccctttagggcataaaaggagcaaccaaaatcatgctattttagttctttaatagtttggctattcctttacaagctatcttttctagggacaaactaatatagcatgacatactttaagcatcaaacataaaagagttttgaccaaactgctctcagcatttctgttctgaaagtacctaattaaaagtaaccctgagttactggcccagatattggcccagtgtaggggaaatgaagcccacttagagttaatgggttgaaccaattgtcctctgtagttcatttcagtacctctaatgtttttctcattggtaagctttgagacaggatgggagcttattagtgacacagttttcttcttctgaagctaaactcttggtattgtgatcttttgaccttttattcgctctaacttcttgattccctttttccactcctctaaagtacagcacatatacaggttcattgatgtacaaccaaattttactgtagtggtgagcatggtttatggatttaattaattgacctattagtgaaatccagcttattggcagtctttcacgattgaaattctaactagtctctctgcatatctatttagatcatcccttaaccccaatgctaggctgctgctaggttagatctgaaagcactaccggcagtcagttttgcatattcagttaattatttggtttcttataaaccacttctctatttttttcttttacttattctttgcttccaatttcttggctacagtttcttagttctgtttgctgtttagtcagaggaccagtagaaaagagcattttccttttccttttcaccagattcagggacagtttctgtgttctcctggttcaggtctctgtaagtcaccatatgtggctttcaaccctgtcagacgttgaccttacccttttaaacattttgtagcagtttgtttaattagtgggaaatagaattcatagatagtgtgacctacttatatacatataacaaaatcaataccatgattataatataaagaataaataaatataatttatagtgaaactgtacgtatttcaggatatgactgtgagggcccaactgtactagaagatgtagtgaagtagtgaatgcttgtacctacttcttttttttttaaaacaaaaagttttttaatgtctgtagcctaatcttggaaatgaagcttgtacctacttctaaagaattaagttcaggtttatgagaagtaacaaggtaattctgtatagaaaactacagaaaatgaaaaattagtggtacatgtggaccataacataaaaatgttagaataaataaccacagatgagacttgtttgtatataataagagaaagaaggaaatacttgaagccgagaaaacatgtcatgacaaattacagactctcaaaatgaagaaaatgaggaagtacgatattctcacaaaggacttgggccatatttataagggtactgagaaagtaatttcctatattgtgatagagaacaagaccctgatgaggcatcacagaaagcatatttcctattttgaaatactaccactttaagacatggtttagattcctggtgcctcaaaagaccttgatgaccaaattcttctctaggtgatgagaaatagagaggatggattagaaagagaaacaataaaacagtaaggtatggagaagatggggcagtagatgtctctataccaaaaagatagaaaaataacaggcaatcaccaaatgaatactttcaatatgggtttttacaggatatgtttcttagtgttacagaacattttttttaacacatagaatttcgtaatttgaaacattaatttaagtaatttttattcttttaaaaaatttgctcttcaaaattcaacttcagtaatttttattgagatccctatggttcatatgtctctacgaatttaataatgctttgtttgtaatctttaagaatggactcaaatatcctctgccattttttgcagaggttccattgcttttgcagtaactgcactattatactaaactcttttcaacaaatatataattagaaatgctctagtatgtagtgcatagagtggatatataatttagttttgagacaacatctttatttgattcaagcttctgcctccgtaaagactttgtcctaaattattgggcttttttcttaacttcttgtcaaatctacctgtattagtatacacagttcgtatactacctgtgtattagtatacacagttcctggtgtttattgtgttaagtttcacctggcagagtatttccctcttctgggaaatgaggccattctttactgtttgggactgctccatgtattccataacacttacctctgcccaccaaatgctcgtggtttctctcaataattttgagtggtaaaagtaccccaacacatttccaaaatgctcctcaggggcattggactcattggctattcctagctaaatgtatatgcttgcatttcttaaaaaacaacctccacaaattttatttatgatttaaaaacacttaaggttaatccccattttctcttggaagaggagtcttttttcagtgtgactgttgtggattgaattgtgccctcctgaaacctagatgttgaagtcccaaccccaccagtatctcagaatgtggtgaagtgtggagatagggtatttcatggtagactctaattcaatgtaactggtgtccttttaagaagaggttaggacataggcaggttcagagggaagaccatgtgaagatggccatctggaagccaaggagagagacctcagaagaacccaactgtgctgacatgttgaatctgttgtttaagctgcccagtttgtggtactttattatggcaaccccagcaaactaatacaatgactgattgatacttcttaatatgtgttatttccatgttagtataccaagatagcagtataatttagtggttgcagttcagattttcaaggttagaattctgactcagccacttagcaatggtgaccttgagcatattaataaactctgagaagcctctgttttttttaatctgtaaaatgagggtaataatacgttcttctctgggttgttgtgaggatttggtaaagtaactaatgtaaagtgtctggtacgtggaagaattctataaataatacttcttttttcatctgcttccatttttaggtatactttgcattttcaaaaatgatgtaatggcatacttgttagatggacatttattgtggggatttcaggctgcctgattcgtggatgagggagaggtttgcgggtcatagggctttttcaatacctttatactcaataatatgcatttaacactttacaaagtcatagtacctcacatccaggtctacatgatgcacaaggattaccctcattgtgcctcaggagatattattgtaacctttgttttgcttacataacttcctttaagacacagtatacctgtcccctgggaatatgctgagataagtattcttcctctgtattgcatagtgccttagcacacataccttcattcatagcatttatatgctctgttatgtctgttttctccatgagactgaactctttgaatgtaggtactgttcctcgttcatatttatattcctaatgttctgcacagtgcctgattctttgtagatgtgctataaattacatattaccaacatttatgagtaatgctaagtgctagatgctgtctctgtctctgttttacagacggtagttaagtgctcacggtaacacagttcagtggtagagctagaattgaacaccatgatagcttatttgcagggcccatgctcttaaccattataatataatgtctcttccctgagaatggaagggtcatcatctggtatattgtaggtcagtgtagcccagagagggagtttggaacatttaattggtaggaccaagaacctgaagcacgccttacctgaaagcaagttgggggtgtgtgtgcatgtcctgatgcttggaaaagaagttatattttaatgcacatagtctgctatattatttgtactactggtattgaaggtttagataaaatttgtatctctgaaatgcactttcttcattaaaaatgaatttctatagtgatatagagtgaaatttcctagtaagcccccaaatcgcttaaaatggatgtcatcattgactgtgctcccttatacgttgatagcagggttaagatgattgatatagctttagggaatttgctatatttgtagtggaaacagcgtgagaagaaaagtgaagatgctgcttgtaacagttaaaacttcagatttcttaaatgcttaggagatgaactgttccagaattttgttttattgtatttttatttacaactgattttatctccttaatatcaatgtatttttcattttcaatactttggttaaattttttcctgctgactcatggctgtcattacagctgttacagtaaagtgttttagagatgctgtaggatctgttgagacttgtagaactatttgcttctacaatatatgatcccggattgttgtactcttcttatgttccttgaacagcttttgcattttcttctatgtcatgccttagtgtgccttccttcagctccttatctccttcttctgattttttgcatgctcaaaaccagttggccaaacagatttagaattgtacatgaaggactaaggtgtgcgtcagttactaacatgaatgtgcatttgtgcttgagctttgtgatatctattctgtctctgaggcctcttttttacttgtttctttactgtgttttgaatagatgaagttactgcaaaattggttcattctagacatactataaaatgatgtcaattttcagtctgtctattaaaagggatagtttggcttaatagtcagaagttcaggtacttttccagtagattgttttagtgacattttgcaattgattattattggaaagtaaaattctttctgccttaatgaaagaaattgtgctttaatttatcctgtttaaaaggaaaagtcaacaaatattttgggtgataaattcatgaccagcattcatttgggcacgttgcataactgagctatagttattgacccagaagaagtaatacctcatcaggatagcaaaggattataattgttttgaaagatcaagacgctagccatggatttaagagtggagaactatgaaagcacttggtgtttaggaactctgagaggaactgtagaatgaaataaagtagagcataataggaaggtggaagctgataaagacagagcactaaattagtgtggcatactttaattaattagtgtgtgtaagagaaataaaaatgagggggggagtaggggaagggatttctggagatactactctgtagtttcatatttagaagacaaatcaaagctgttaatagactgttgactttgagctgcaattattgatatcagtatgagaaacagtgggctgacatcagaatttaaagggctaaggtggtaacactatgtaatggagaggctttaaaatcagacagtcctgggttagattcctggcatcatcacttctggctattttgacattggataacttcatgttttctaaaaagcctagaaaacgtgtaccagtgcctgtctttctctttgtattcatcattttggtagattactggaagatgactgtttgggcctaaaggaagctgtccagttttaaattgttgttgttgctgtatatccttacatataatttattgtcaggtatatgatttgcaaatattttctcctattctgtaggatttttcacttttttttttttgaaatggactctcgctctgttgcccagactggagtgcagtggcacaatcttggctcactgcaagctctgcctcccaggttcacaccattctcctgcctcagcctcccgagtggctgggactacaggtgtccgccaccacacccgactaattttttttcttgtatttttagtagaaatgggggtttcactgtgttagccaggatggtctcgatcttctgacctcgtgatccacccaccttggcctcccaaagtgctgggagtacaagcatgagccacggccccggccgatttttcacatttttgataatgtccagtgatgcacaagttttacattttgattaagtccaaattatctattgttgctcatgcttttggtgtcatgtctaaaaatcctttgccaaatgtgaggtcataaaaatttgtttttatctaagagttttagctcttaacaggtttttgatccattttagttaatatttgtatatggtatacacaaatgtatatgtatatggtgtatacctcattcttttgcatgtgactatccagttgtgccagcaccatatgttgaagagactttcctctcctcaatgaacagtcttggaacacttatggaaaatagttaaccatagacacgtggctttatttctggactctcaattctattccattgatctatccttgtgccaacaccacactgtttgattaccactgctttatagtaagttttgaaattgggaagtgtgagtcttccagctttgttctgctgtgattacctttaaagattaatctttgctgaaaaaaagtcccaaggaacagggacaaagtacagtgtggttttgacaggggaataaatactctgggaggctgtagctgagatagatagatttaagtgctcggaggctgataataaagaaatgaataaaaaagtaaaatatattgaacacctattatatgtcagctgttcatatatcctcacaacaaacttgaggaagtgggtattggctccccatttttacctagtaacattctgagaattaatgagatgaagtaatttgcttgtgcagctagaaagtgacagctgaacctatgtcattaagcttctaaaggcctattaccatgctgccttgataatgaaactacctgaataaatgtatcaaccagggtctaatcaagagaaagaaatcacatgagttatttgaacaaagagaatttaatataaataattattatgtaagtatattatctactgtaaattaattgaaagggtaaaaaggtatttttttacccaggacagataaggctttcctgtccgatacaatagccactagctacatgtggcttttgagtacttaattatgacttttacaattagctagtcagtttctacaaataagtcagttgagagtctgatgaggattgtgttaaatctgcaggtcactttggggagtattaccatcttaacaatattaaggcttccaatccatgaacatggtatgttttcccatttatttagatcttattctgtttttcagcaatgttttatagttgccagaatataaattttgtactttttctgttaaatttatttccaagtattttatgtttacattgatggaattgttttaaatttcgttttcagattgtttattgcacatgtatagaaataaaatctatttttgtatattgatcttgtatcctgcaactttgctggactcatttttttacttctaatagtcttccatcaattctgtaggattttctacgtacaagctcatgtcatctgctctgaaaaaataaagtaaaaatagttttacttcctcctttccaatatgggtgcctttttttcttttaaaaattatttccctgagttttccaagatgaatttcatttccttttcttggttaatttccctggatagagcttctagcacaatgttgaatagaggtagtgagagcagacatccttgttttgttcctaattttagggggcaagcatctaatgttttatcatcaagtatagtgttgtagacttttaaaaatattacattaaattattattcatctttctttcttagagctgagggtcttgctgtgttggccaggctggtctcaaactcctgggctcaagtaatcctcctgcctcagcctcctgagttgctgggatttcagatatgagccactatgcctagcatattcatctttattactgaattttttttgcaaccccttaaatttctgtggttgaggtgagaccctcacttactttacatcagttttggccctgtggttatagaagatttgggggaaattgtaaaaagtcctaaagattctgaattcagattgttttgcaagtgtctttatattctatatctgttttaaagaaaccaaatctgtaactgacagttcatgcattcatcatggtagtgaggttaattttaagatgccatgccaagatttaattaacaggcatttgtgcaaatcaacagccttagttctatatcaaatgataaagtaaaccatatcctactttaacttttttgatctattgttgaactgtgggtctgaatgtgttccataagatggtttctactgtggctatgaagattgtagaaaagatagagctacctacacttctctttatgtcttctgtcattttcttaaatttgctaaaaatatttgttatagatccagaaaaactgttacctttattcagacctgcatgctgtactcccttgaatcccttgcacagtaaaagtagagtgacctaatttagtaacatggtgatttctgctggaaagatttgtatctgaaatactgctttctaaggagttctgactggtgatttgccagttttttttttttttaccatatttgaaaatcacttactaaaaagagttaaaactctagtacattgactatatgaattttatcagaacaggttttaattgttttacatttaattgacttgtggcttttgatcgaataggatgttaaacagtatttcatctatttagagggaaatactttgtctttttaatgtaatattgaggaatatgataaactcctaaggaggcagtttataatttaatacagtactcacaatatttctaagactgattgtgatgtataaatcagagtggaccttaaagagggttcttaattcatattagcctatgtcattttagcaaaagattaatacttattttttaagaaatgtgataataaacttgtcattgataaagaaatacttttatgtcttcttgttgttatttagatgttgcttagtgtttgagcacggactttagatttcagctatagattcacttaaaaaccagaattcttcagcttaaagacctcttgcacaaagaaagcaaaatgatgtttttttttcttttactatactagaagaatatcatgttataaaaatgctgcttgcatctagatttcaagagttacttggaacttaataatattttattatattagagatataggcatttttgttttaagatagtttgtgaatctcattttgcttggataaacagctttctgataaggtgatcactgtaatataaaagcacttaagaattttaccctttggaacatggagggcaaattgaattatagcttgttagcatggagatgaggaaaaaaagaaacaacctgcacctgcttgcttaaacgcatcccaaattgaaagctttaatacatgaagccacttagttttccctataaaatgctcagcagttttttatcttcactcaatttatctatagatttccacttaaaatcttttgtaagcgtttttcttctttctccttcattgtctttttcttgtttgtaatttattgtgggagaaataggattttccatggtaactaggaccctgagaggtgttttatattctgtggtttcagattttctcttggtttctctctctctctctctctctctctctctctctctctctctctctcctctctctctctctctctctctctcctctcctctctctctctctctctctcacacacacacacacacacacacacacacacacaaattgagattggacatcttttcttatgcttattctttttattgccattcttctgtgaaaggcctgttgaaatatttgctcacaggattgctcacctttgtttcattatgttttcttttttttattattatactttaagttttagggtacacgtgcacaacgtgcaggtttattacatatgtatgcatgtgccatgttggtgtgctgcacccattaactcttcatttaacattaggtatatctcctaatgctatccctcccacctcgccccaccccacaacaggccccagtgtgtgatgttccccttcctgtgtccatgtgttctcattgttcaattcccacctatgagtgagaacattcggtgtttggttttttgtccttgcaatagtttgctgagaatgatggtttccagtttcatccatgttcctacaaaggacatgaactcatcattttttatggctgcatagtattccgtggtgtatatgtgccacattttcttaatccagtctatcattgttggacatttgggttggttccaagtctttgctattgtgaatagtgctgcaataaatatacgtgtgcatgcgtctttatagcagcatgttttataatcctttgggtatatacccagtaatgggatggctgggtcaaatggtatttctgttatgtttttagaatattttatgtataatgaatattaaacatttgcctatgttgcacatctcctggcttccaatctcacacccccatgcctcttcttaattatgtttatggtgttttgtaccatatacaattgcaactttttgtaaccagcaaacttaaacattattttctttatgggctctaagttttgtgtcaacccttagaaagattttgtgactcattaaaaattgttttaaaaaattctcctttatctgtcttctagttttttttttttcttgagatggcgtcttgctctgtcggcctgactggcgtgcagtggtacgatcttggctcactgcaacctccacctcttgggttcaagcaattcttctgcctcagcctcctgagtagctgcgattacaggtgcgcccagctaattttttgtattttgttttttttttagtagagacggggtttcaccatgttggccaggctggtctcaaactcctgacctcatgatctgcccacctcggcctcccaaagtgctgggattacaggcgtgagccactgtgcccggcctctactacttttttttttttttttgagacggagtcttgctctgtcgcccaggctggagtgcagtggcgcatctccgctcactgcaagctctgcctcccagattcatgccattctcctgcctcagcctcccgcctagctgggactataggcgcctgccaccacgcctggctaattttttgtatttttttttttttttagtagagacggggtttcactgtgttagccaggatggtctcgatctcctgaccttcgtgatccgcccgcctcagcctcccaaagtgctgggattacaggcgtgagccaccgcacccggccctctacttcttttacgattttttcatattgcaatatttaatctatctgaaacatatggtatagataggattttaatctcctctccccagcatagccagtttcccctaaagtgttttttgagaagttttatcttcctactgatttcaattgccacattcatgatatagttaataaccatatgtattttgatctatttttagattcgactctgttcattcctctgtctgttcccacactagtaccacactgtaatagttactatatatattttttactacattttaatatccactggaaaaagtttccttgcctctgcctccacaaccaccctccccaaacaccagccatgatgtttattgcttatttttcttttttaagcttattggacaatttttatgtgttcagttctcccaatgaactacagattcaacgtacaaaatgtccaccttctccacaaaaaatctgactcttttagggaatttgattgtaattgtattgaatttgtgtattcaatttgagggaagtttgcatctttatgattttgagtttgtctgttcctggatatggtgtgtgtgtgtgtgtatgtgcgcgtgagtgtgtgtgtttccatttattcagggtcatttattcttttatgtgcttccataaaattttatttttctttttatttatttatttattactttttttgagatgaagtctcactctgtcgcccaggctggagtgcagtggtgcaatctcggctcactgcaagctctgcctcccgggttcatgccattctcctgcctcggcctcctgagtagctgggactacaggtgcccgccaccacgcccggccaatttttttgtattttcagtagatacggggtttcaccaggttagccaggatggtcttgatctcctgacctcgtgatctgcccacctcagcctcccaaagtgctgggattacaggtgtgagccaccgtacccggccataaattttatttttcatatgtctttcatacatcttttaaagcacatttgtaagttttttttttttttacaaactttgctgctctcaggtaggtggtattttttccagtacttatagaatatgatattggtggaatataagaaatccttgttttcatggacctgacattcttgtaatgggcctctcattgtgctaatttttcagttgatacttttgcattttccataaaccttatgttacctataaatcattaatttttagacaatcatttatgatcctgcagcagcaacattcctcaggaacttgttagcaatgcagattctctagaccgatcccacaccaactgaaggagaaactctttccagcaatttgtgcttcacatgtctccaaactctgatgtatgctcaagtttggagaccactgatgtaaataataattttatgctgtcttgctcatattttcatttctcacattttttaaattgcaagatgtgtgtgtatcagggctcagtggattacatagaatgagcactgactgaataggctgagacaaatcgttaacatccatgggtaagatgggaggggaatgatgagacatgaattattccttaatttcttaattccttaattaggtgaataaggaaaaagtaaatcagagagagagagagagaaggaaagaaagaaggaaattaagtatacaatttagggtgaggattttagtggttgacagagggaagtctgattcaaagatcactcctatagataagtaagaattgtaacattatgaaattgaaagaaataaagacagctaagcctaagcctggcatttgatacttaatgaatgtttgtaagatgaagttcagtctttgccatatgagggtcaccaccattagaaaatcatatagaattgcattaatacaaggataatactttcaatattggcaaaaaagccaattgcaatgatgagtcagatgataccatgagccaacaatatacctcaaaggcattcctaaagcctattatgaatgacaacatgagaagggactaccaagggatcttgtcaggaaagaaggaggccaggtgtggtggcttatgcccataatcccaacactttgggaggccgagacaggaggactgcttgaggccaagagtttgagacaagcctgagcaatatagtgagactctcctgtctaaaaagaaaaaaagaaagaaagaaaagacgggaggaatgatattaagcagtggaactgcatggtgtatggtgtatacctatagccaacatgaagtacaatgatagtgaccacatggtggtgacatgggcagattgcttcagtgactatagaagggaagctgaaattgttgagaagagtgtgtcagccactctggcacttggccaggaaaagggagaaacctaagaaacatgggaatccagtctttttggtaggagtttagacctaaaagtagctgtgaacatacctctctggaccccctagttgtagcataagatgctggtcaaggggaaaccaggcaggctgatcatgtacttaaaatgagcgttctgaaataggctttagctgcaacctttagtatagtgcaactgttattttgttagggtgcgtgtgtgggagcataccagatagacctatcaatttttagatttactgtagtgaagaatcaccactcaatgcaacagttagtgctcaggtattttaggataagacctctttagtgccacaggtgggagaggagaataagctaaatgattctatgatctaacactctgggacatttaaaaaaatcaacttttgtctaacaaactattttttaaagaacacaattctgttaaacttcagattttgcattttcaagatgattttgaatttttgtaatgctgctatatataatttaatttagaggagtgcaattatgtgcagtttttctagattttgcggttttttgattttgtcgtgtttagcatttttcactaatcctttctgtcagttttcttttcttaccacagtacttatcaaaattttatttgaagacagagtactagagaaactcctaaaatttcttttatatagcatcagtttaattcataagtgagacttaccttatgtagtgtgaaattggctaaggatatctcaaatctgattattttaaagctattagtttttggacagagtaggaaagagtgatacagtgggttttaattaaacgctaggtcataaactggaatctttatttgaaatattatctaagataggtgcttgagaaatattagatttgtgaattacttaaatacttatgaataaaattgcttgaacttatgcaagatatctcaactatcataagcagttttgtcagttttgtttctggtgagctatattgaatattttaagggcaaaactacaattaggtcgttggcaggtatgtgctctgagtaatgattagtttcccttttattcatgagggtgtcatggccaggggaaagtgtgcatttttaattacaatacttgtctcgttatatttttgttctgtctggttttatttctttgaaagctctttaaaaaaaatgttggcctttctatgtcatatcccgtctgcacatctacatagtcccgacttcagggcagaaataatattttctactttttttgtttcttctttattagaaaattccaaacatgcagaaaagtacaatataacagttgcccatgtagccaccatgtagctgtgtaaaacctcaaaattttgccatttttgttttagatcctcaacaaaaaaagatacaggtgaagctcctagagtatccttccacaattgcattttcctactatcctctcctgggggaactactgtccaaaatttggtatttatcatttcccttattatttttgtcctttttctatatctgtgtgtatgtgtgtgtgagtgtgtatgtatatgtgtgtacatatgtgtacttgtttacttcttcagtttacatttttgtctaatgtaatgctattcagatttacctgctctagtatctcctattatgaaaacaaaataaaacaaaacattaactacttgtacattatgtctcatccaactgccacccatttctctactctctattaaaggaacactccttgtaagagttgtgtacttatttcctctctcccttctaattcttaaactcatactaatcagctcatctccattactccacacaacccagtcttacttaacaaggtctccagttgcctctctgtcactacactaagttgtcatttctcacttccttacttaatctctcagcaacatctgacacacttgcttactcttttcttcatataacaccttattttgtcttctgggttaccacaccttcctggtttcccttcgagcccacggcctctccttactcttttttaccagatcctttttgtctttttatttcaaaatcaattgagcaaaaaaaatacaggattaaaagtaaacatctctcccatctcatattccttctcacaaataaaggctataaacaggctttatgtgttgtgcatgtgcatgcacatgtgtgtgaattcataggtgaaaacagtgcctcaattaaaatagcatttatttgtttcctgtttctattatggttggtgcgaaagtaattgcggtttttgtcattaaaagtaattgcagttttaatggcaaaaactgcaatagctttcacaccaacctaatattggttttatatgtgcttcttgcttatattatttccttattttaccattatatgttattgttttcactaatttgtgtaagttaaaattattagccctttgttgcctgtcatgtgtgttatgaattatttttcctagtttatcagttgcctgagggccttggcatatttgaagtacagagttttaatttttttctatgatcagattgaatagtctgttatgatttctgatatttgggtgctgcttgccttcttcactgcatgattataaataatttcacttaggttttcttttggtactctttcagcttcattttgttacctttaaattttgatccttctggaatgtatttcagggcaacaagtgaaatagtggataacctctgctttttaaaaaaaataaacacaaccaaatggctacccagttgtcctgaaatcacttattcaatcatccccccttctcttacttgtttgaaaggccatctttaccccagagtaactccctgctgtatttgcattcctcacaagatcttgaaataatttatttatttttgttttgtttttcaagccactgcagtaaagttctccccactgatattgaaactgctcttggtaaaggtcaccactcatattataattgttaaatcaagtagatgtatcttacttggtcttgaatttgttgaatgctgttgaactactcttcctttttagcttttatctcacaattctcatagtttccctcctaccgttctctctgttttccttactaatttgtcttcttccatttctttgggattccaccttctcatggggaatatattctttttctgctttttatttatttataatttttgtgggcacatagtaggtgtatatatttatgggatacatgagctgtttagatacagacatgtaattggaaataagcacatcatggagaatggggtgtccatcccctcaagcatttatcctttgagttacaagcaatctaattatactctttaagttattttaaaatgtacaactaagttgttattaactatagttgctcctgttgtgctatcaaataatagatcttatttattctatctaactgtagttttgtactcattaaccatccccacttctccctacccagctacccttcccagcctctggtagccatcattctaccatctgtctccatgagttcaatcattttaatttttagctcccacaaataagtgagaacatgtgaagtttatctttctgtgcctggcttatttcacttaacacaatgtcctccagttccatccatgttgttgcaattgacaagatcacattctttttgtagttaaatagtactccattgtgtatatgtactacatcttctttatccattcatctgttgatggacacttaggttgcttccaaatcttggctattgaatagtgctgcaataaacatgggattgcagatacctctttgatacatagattttctttctttggggtttgtaattagcagtgggattgctggatcatatggtagctctatttttagtttgttgaggaattgccaaactgttctccatagtagtggtactaatttacgttccaccaacagtggacaagggtttccttttatctacatccttgccaacattagttattgcctgtcttttggataaaagccattttaactgagatgagatgatatctcagtgtagttttatttttatttttattttttggagacagagtctcactctgctgcccaagctggagtgcagtggctcaatctcagctcactgcaatctctgcctcccgggttcaagcaattctcttgtcagcttcctgagtagctgagattacaggcatgcaccaccacgcccatctactttttttgtgtgtacttttagtagacatggattttcatcatgttggccagctggcctcaaactcctcacctcaagtggtccactagcctcagcctcccaaagtgctgggattacaggcgtgaaccatcatgtctggccctcagtgtagttttgatttgcatttctctaatgatcaatgatatcagccacctttttattggcctgtttgccatatgtatgtcttcttttgagaaatgtctattcagatagtttgcccatttctttttctttctttttttttttttttttgatggagtcttgctctgtcgcctaggctggagtgcagtggcgcgatcttggttcactgcaagctccacctcccaggttcacgccattctcctgcctcagcctccctagtaactgagactacaggcgcctgccaccatgcccggctaatttttttgtatttttagtagagacagggtttcactgtgttagccaggatggtctcgatctcctgaccttgtgatctgcctgccttggcctctcaaagtgctgggattacaggcatgagccaccacacccagcctgttttgcccatttcttaattggattattagaattttttctatagagttgctgagctccttacatattttggttattaatcacttgtcagatggatggtttacatgtgggaaaaaatagatgcaaattatccatctatcgttgtctcttcattttgttgattgttttctttgctgtgtagaaactttttaacttgatgtgatcccatttgtccatttttgctttggttgtctgtgcttatcaggtattgctcaagaaatctttgcctagaccaatattctggagtctttccccaatgttttcttttagaagtttcatagtttgaggtcttagatttatgtctttaatccattttgatttgatgtttctatatggtgagagataggggtctactttcattcttctgcatatggatacccagttttctcagcatgatttattgaagagactgtcctttccctaatgcatattcttggcacctttgtaaaaaatgagttcattgaagatgtatggatttatttctgggttctctattctgttccattggtctatgtgtcttttcttattccagcaccatgctgttttggttactgtagctctagagtataatttgaggtgaggtaatgtgattcttctgattttcctttttttttttttttcctcagagtaactttggcaattctggtcttttgtggttcttattaatttttggattattatttctatttctgtgaagaatgtcattggtattttgataggggttacattgaatctgtaaatagcattgggtagtatggacattttagcaatattgattcctccaatccatgaagatgaaatatctttccattttgttgtgtccacttcaatttttcatcagtgttttatagttttcattgtagaggtctttaacatctttggttaattcttaggtattttcctttatgtgtggctattataaatgggattactttcttggtttctttttcagattgttcacttttgacatatagaaatgctactgattttttatgttgattttgtatcctgcagctttactgaatttatcagttctaatagtttttgggtggagcctttaggtttctccaaatataagatcatgttatctgcagtcaaggatagtttgatttcttcctttccattttgtaagcctttatttctttctcttgtctggttgctctatctaggacttcctgtactatgttgaataacaatggtgaaagtgggcatccatattttgttccagatcttagaagaaaggctttcagttttttcccattcaatatgatactagctgtgggtctgacataaacagcctttattgtggtgaggtgtattccttttatacccaggtttttgagggttttctttttatcatgaagcgatgttgaattttatcaaatactttttcattatcaattgaaatgatcataaggtttttgtccttccttctattgatattatataccacattgattgatttatgtatgttgaaccatccttgcatccctggggcaaaacccatttgatcttgatgaatggtctttttaatgtgttgttgaattcagtttgctaatattttgtggaggatttttgcatcaatgttcatcagatatattggcctatagttttctttctgtgatgtgtctttgtttggttttggtatcagggcaatactggcctggtagaatgagttttgaagtattcattcctcctccattatttggaatagtttgagtaggattggcattatttcttctggaaaggtttggtaaaattcatcagtgaagccatctgatcctgtactttcctgtgctggagacactttattacagttgcaatctcattacttgttattggtctgttcaggttttggattttttcatgggtcagtgtcactaggttgtatatgtctataaatttattaatttattctcgattttccaatttattgtcatgtatttgctcatagtagccagtaatgatcctttgaatttctgcagtatcagttgtaatgtctcctttttcttctttgattttatttatttgggtcttttcttcatttttctgtctggctcagggtttgtcaattttgtttctcttttcaaaaaaccaacttttcattttgttgatcttttgtatttttttttttcatttcaatgtcatttatttctgctctgatctttatgatttcttttcttctactaagtttgggtttggtttgctttttttctatttctctaagatgcactgttaggttgtttattagaattttatatctttttgatgtaggcatttataactataaactctcctttaagtactgctttcactgtatcttataggttttgtatgttttgtttacattatcatttgtttcaagaattttttgaatttccttcttaatttctttttataaaatctgctgtgagagaacagcttctaaatttcttcattgacccactgatcattcaggagtgtatattttaattttcatgtgtttgtacagtttccaaaatttctcttgttattgatttctagttatattctattgtggtcagagaagatgcttgatgtaacttcaatttttttgaatgttttaatacttgttttgtggcccaacatatgacctgtccttgaaagtgatccatatgctgaggagaagaatgtgtattctgtgctggtggatgaaatgttctgtaaatttctattagttccatttgttctatagtgcagattaagtccaatgtttcttagttgatttttcagtctgggtgatgtgtccaatgctgaaaatgggttattaaagtctccagctatgattgtattggcatctattgctctctttaggtctaataatatttactctatatgcctaggtgctccagtgtcgggtgcatatatgtttacaattttatatcctctggctgacttgacccctttatcagtataaaatgccattttgtctctttatagtttttgtcttgaaatatgttttgtgatataaatatagctatcctggctctttttttggtttccatttgcatggaatatctttttccattcccttatttttgaactaagtatttctctacaggttatgtgtactttttgtaggcaacagatctttgggtcttgtttttgaaaaccattcagccaatctgtgtctttcgattgtaggatttagtcacgtagattcaatgttgtaaggacttcagccattttgttatttgttttctggttgttttatggtcttctcttcctcctttccttccctcctgtcttcctttagtgaaaataattttctctggttgtatatgttaattttttatatatctgatatatgttttttgatatgaggttaccatgagactttcaaataatatcttataactcattatttaaactgttgacggcttaatactgaatgtgtaaataatcaaacaaataagcaagagaaaaccagagaaaaccaataaaactctacactttaacttcttcccctagctttttaactttttgttgtctctttcttttctttttgagatagggtctcactctgtcatccaggctgtagtgcagtggtgtgatctcagctcactgtagcctcgagacctcctggccttaagtgatccacccacctcaacctccctagtagctgggactataggcatgcaccaccatgcctggctagtttttgtgttttttgtagagacagggttttgccatgttgcccagactggtcttgaactcctgggtgcaagtgatccacccaccttggtcccccaaagtactggggctacaggcatgagccattgtgcctggcctgatgtttctatttatatcttgttatactgtttatgctgtgaaaagttgtaattatatttcactgtgttataatattctgtggttttcagtgtgcttatcattaccagtaggttttgtaccttctgaagattttgtcttgctcaataatatccttttctttcagattgaggaactccctttagcatttcttctaggacagatctggtgttgatgaaattcctcagcttttgtttgtcaaggaaggtctttatttctccttcatgtttgaaagatatttttgccagatatactactctagtgtaaaagttttttgttttccttcaacactttaaatatgtcatgtcactctctcctggcctataaggtttccactgaaaagcctgctgacagatgtattggagctccattgtatgttatttgtttcttttctcttgctgctttaggatcctttctttgtccttgacctttgggagtttgataattaaatgccttgaggtggtcttctttgagctaaatctacttgatgttctgtaaccttcttatacttgaatattgatatctttctctaggtttgggaagttccctgttattatccctttgaataaactttctatcctcatttctctatctaccacttctttaatgccaataactcctagatttgcccttttgagactattttctagatattgtaagtatactttattcttttttattttttcttttgtctctctattttcaaataacctatattcaagctcattaattctttctcatgttttatcagttctactgttgagagactctgactcattcttcagtatgtcatttgtatttttcagctctcgtctgataggattctgaattctttctccgtgttatctttaatttcattgaggttcatcaaaacagctattttgaattctccatctgaaatgtgacatatccctgtctctctaagactggtctctggtacctcatttagtttgtttggtgaggtcatatttcctgggtggtctcaacgtttgtagattttcgttggtgtctgggcattgaagagttatgtatttattttaatctttgcagtgtggacttgtttttactcatccttcctgggaaggctttccaggtatttaaagggacatgggtgttgtgatctaagtctttggtcactgtggctatattttcattaatgggcatctcaaacctcgtaacgctgtggctcttgcaaactcttggagatactgccttggttgtttttgctaagatccagaagaattctatggattaccaggcagagacccttgttctcttcccctaatttcccccaaacaaatggagtctctctctctctcttttctgagttgtttagagctgagggagaggtgacaccagcacctctgtggcaaccaccactgggactgcactgggtcccacctgatgctagcacagccctgggttttgcccaaggctcatggtaaccacttcctggctactgcttatgttcattcaaggcccaagtgctctacaatcagcatgtggtgaatccagccaggcttgtgtccttcccttcagcatggtgagttctccctggccctgggtgtgtccagagatcctgtctgggagttaaagcctagagtcggaaaccttaggaatctacctggtgctctagtctgctgttactgagctggcactcaagttgcaagacaaagtcctccccacttttccccctcctttcctgaagcagaggagccactccttttggccatccttaccccagggctgtaatgagtactatctagctaccagtgatgttcactcaaggctcaagtgctcctcagtcagcttgtggtgaatgctgcctgtcctgagtctttctcttcagggcagtgggctcccctctggccagggcaggtccagaaataccgtccaggagtcaaggcctagaattggggactgtaggagcctgcttggtcctttaccccactgtggtctctccacatagctaacacatctaggaatgttctgggtcacatgtgaagccagcatggctctgagtctctcccaaaacccacagtgagtattgcctcactaccactgctgatttttcagggcccaagggccctttaatcagcagatgattaatcctgcttaggactgggtccttcccttcaaggcagcaggtttcctttttgctcagggtgtctgtagaaatgtcatctgggaactagggcctggaatgggggcttcagaactgtgcctgctgtcctagcctactgtaggtaagctagtatgcaagttgcaagacaaaatcatctttttcccttctgtcctcaagtggaaggaaggagtctctcctgtagctgtgaacggtgctgcctggggttatgggagggctgatgcaagcactcccttgggtgcaccagcttgtgtctcactgggtcatgtgcaccccacatccactggctttgagcccagcataacaccaggacttgcctaggaattgcagtcctagtggcctggactgccttctcactttatttagaatgccagagcgctttagcccatggtagcagggcttgatggaactcaggttctaatcattgggataagcaatttatctcttcctaggcctggtctaaatgctccctccatggtcgttggctgagtttttccccttgttgctctctactctgacagggtagcactgagttccaatggaaagtccccattactgcaatctctctcctctagtgcacagattctccctctgcacaatgtggccactgccaggggatggaggggtggtgatgtaggcgattaagggctgtatatcctacaatcttcagggcctttttccttaatttgatgttaaaacaaggtattgtgatcattcacctgatttttggttgttatgaaagttcttttttgtgtaaatagttgttcaatttcgtcttcctacaggagagatgatcacttgaggcttctattcagccatcttgctctgattgccttcacttgagtaacatttcccaatctcatcacttcacttgttacttaattggctaaatattcctacattgacacttctagttccaatctaaatctagatgtaatcttttcaattttctgttagacactgtttggtgtgtcctatggtacataaatgtgtgtacatcaaacaattgttctccttttttcaatatttttccttattctctacatgctacctcacttgatatcttcatcctcatcccagttatttaaacagattttgtgattttgtttgtgatctccttatccctgtaatacctattcatgatcttttagtcaatcagtcctagttcactctggctatcctcatagacattgtctgggctcttatctcagttcttgactgtagaagaactttcttaactgatctctagatatctagtctatctctcttccatccccatattggagctgtgctaattttcttttcttttttttaattactattatactttaagtttcagggtacatgtgcacaatgtgcaggttagttacatatgtatacatgtgccatgctggtgcactgcacccactaactcgtcatctagcattaggtgtatctcccaatgctatccctccccccttcccccaccccacaacagtccccagagtgtgatgttccccttcctgtgtccatgtgttctcattgttcaattcccacctatgagtgagaataagcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcgaatggtatttctagttctagatccctgaggaatcgccacactgacttccacaatggttgaactagtttacagtcccaccaacagtgtaaaagtgttcctatttctccacatcctctccagcacctgtggtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttttaggtttcctgttcactctgatggtagtttcttttgctgtgcagaagttctttagttgaattagatcccatttgtcaattttggcttttgttgccattgcttttggtgttttagacatgaagtccttgcccatgcctatgtcctgaatggtaatgcctatgttttcttctagggtttttatggttttgggtctaacatttaagtctttaatccattttgaattgatttttgtataaggtataaggaagggatccagtttcagctttctacatatggctagccagttttcccagcatcatttattaaatagggaatcctttccccatttcttgtttttctccggttagtcaaagatcagatagttgtagatatgcggcgttgtttctgagggctctgttctgttcattgatctatatctctgttttggtaccagcaccatgctgttttggtgactgtagccttgtagtatagtttgaagtcaggtagcatgatgcctccagctttgttcttttggcttgggattgccttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggactcctaggtattttattctctttgaagcagttgtgaatgggagttcactcatgatttggctctctgtttgtctgttgttggtgtataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaattgccctggccagaacttccaatactatgttgaataggagtggtgagagagggcatccctgtcttgtgcctgttttcaaaaggaatgcttccagtttttgcccattcagtatgatattggctgtgggtttgtcatagatagctcttattattttgagatatgtctcatcaatacctaatttattgagagtttttagcatgaagggttgttgaattttgtcaaaggccttttctgcatcttttgagataatcatgtggtttttgtctttggttctgtttatatgctggattacatttattgatttgcgtatattgaaccagccttgcatcccagggatgaagcccctttgatcatggtggataagctttttgatgtgctgctgggtttggtttgccagtattttattgaggatttttgcatcaatgttcatcaaggatattggtctaaaattctctttattggttgtgtctctgcccggctttggtatcataatgatgctggcctcataaaatgagttagggaggattccctctttttctattgattggaatagtttcagaaggaatggtaccagttcctccttgtacctctggtagaatccgactgtgaatccatctggtcctggactctttttggttggtaaaccattgattattgccacaattttagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttaacattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcattatgtacccagtagtcattcagtagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgagttcaattcctggatatccttgttaactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacagtgatgggtcttgactctttatccaatttgccagtctgtgtcttttaattggagcatttagcccatttacctttaaggttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagtgcttccttcaggatctgttttagggcaggcctggtggtgacaaaatctctcagcatttgcttgtctgtaaagtattttatttctccttcacttatgaagcttagtttggccggatatgaaattctgggttgaaaattcttttctttaagaatgtcgaatattggcccccactctcctggcttgtagagtttctgccgagagatctgctgttagtctgatgggcttccctttgagggtaacccgacctttctctctggctgcccttaacattttttccttcatttcaactttggtgaatgtgacaattatgtgtcttagagttgctcttcttgaggagtatctttgtggcgttctctgtatttcctgaatctgaatgttggcctgccttgctagattggggaagttctcctggataatatcctgcagagtgttttccaacttggttccattcccccccctcactttcaggtacaccagtcagacgcagatttggtcttttcacatagtcctacatttcttggaggctttgctcatttctttttattcttttttctctaaacttcccttctcacttcatttcattcatttcatcttccgtcgctgataccctttcttccatttgatcgcatcggctcctgaggcttctgcattcttcacgtagttctcaagccttggttttcagctccatcagctcctttaagcacttctctatattggttattctagttatacattcttctaaattgttttcaaagttttcaacttccttgcctttggtttgaatttcctcccttagctcggagtaatttgaccgtctgaagccttcttctctcagctcgtcaaagtcattctccgtccagctttgttccgttgctggtgaggaactgcgttcctttggaggaggagaggtgctctgctttttagagtttccagtttttctgctctgttttttccccatctttgtggttttatctacttttggtctttgatgatggtgatgtacagatgggcctgtggtgtggatgtcctttctgtttgttagttttccttctaacagacaggaccctcagctgcaggtctgttggagtacctggccctgtgaggtgtcaggctgcccctgctggggggtgcctcccagttaggctgcttgggggtcaggggtcagggacccacttgaagaggcagtctgcccgttctcagatctccagctgcgtgctgggagaaccactgttgtcttcaaagctgtcagacagggacatttaagtctgtagaggttactgctgtctttttgtttgtctgtgccctgcccccagaggtggagcctgcagaggcaggcaggtctccttgagctgtggtgggctccaaccagttcaagcttcctggctgctttgtttacctaagcaagcctgggcaatggtgggcgcccctcccccagcctcgctgccgccttgttgtttgatctcagactgctgtgcaagcaatcaggagactccgtgggcctaggaccctctgagccaggtgctggatataatctcctggtgcgctgttttttaagcccgtcggaaaagcgcagtattcgggtgggagtgatgcgattttctaggtgcggtctgtcacccctttctctgactaggaaagggaacaccctgaccccttgtgcttcctgagtgaggcaatgtcttgccctgcttcggctcgcgcacggtgcacgcagccactggcctgcacccactgactggcactccctagtgagatgaacccggtacctcagatggaaatgcagaaatcacctgtcttctgcgtcactcacgctgggagctgtagaccggagctgttcctattcggccatcttggctccctccgctaattttcaaatatatatttgtctatatatatgatctggctaaaaattttagttatatatattatatataactaaatatatatatataactaaatatatatacaactaaatatatatataactaaatatatatataactaaatatatatataactaatatatatataactaaatatatatataactaatatatatataactaaatatatatgtgtgtgtatatatatatatctaaatatatatatctatatatatatctaaatatatatatctatatatatatctaaatatatatatctatatatattccctggctaaaagttttagttaaagttaaatcccacataaacttgatcacatgtgtttacttctcccttcctaacttcatgaaaaagagagtaaggtaatggaaaaactcaataagacaaagagaacaggagtaggagcattgatagttgtaaggttcaaactaacttttacttattgcaatggaagtttcaacttgaatatctccttctacatgaacttctgagagaaaccaactaattcttcccataaaactcctaatattttaagacttggaggtacctggtctgtggaaggcaggaatgtgtcatgagattggatacatgagttatttgttgaaaatctttatgataagtggctgcagttccatatcctatcacctactccctgctcctcaggagaccaaatagtttattttctggagaatctgaataagaatatcccagactcagaaatccaggcacagtaggagggttggttgaaataagaagactgtgttattctgttttgtgctgctataacagagtacattataatttatatataacagattgatttacaatgagcagaaatttatttctcacagttctggaggctaggacgttcaagataaaagaggctggcatctgacaagggccttcttgctgtgtcatcccatggcagaagttggaagggcaaaaagaggcagagggagagagagaacacacaagaggaagatgaacttgaacttgtccttttataaggaacgcattcccatgataatggcattaatccttcatgagggtggtgcccccatggctaaacacctcctgttagaccccacctcccaacagtgttgcattgaggtcaagtttccaacacattcttttttgggggcacattcaaaccatagcagagattaagagaaaatttgcatacctaatttcaggacctgtatgtttcatcctagatgcaattagtgaaacagggcatgagttatttagttttacattatcagatttctagtagtaatctagatatagatttttcccttttcaacatcttctaaataattgtatagtctaaacataattaaaaaattttaacatctcaaattctctcatcactttaacatgttttagaaaaggtaaatcgaaggtcagttcatgtgagagtgtgtaaaatattaatttcatttaacctactcagtttctttacttgtaataacagaattataagcagaaaaatgattgtacaaataaacataaatgatgtcatttgatttatttgctttttagaattatgaaaacccaataaatagagttttttttcctcttctatttcttttccttaaattcaggggctggaagagggctgacgacaatgaagaatccctcctcctgcttgcttaattattttagatcttcacataacttcttttttctttttcttttcttttattattattattttttgagacagggtctcactctaccacccaggctggagtgcagttctgtgatcttggctcactgcaacctctgcctcttgggctcaagagatctttccacctcagccctctgagtagctgggtctacaggcacataccaccatgcccagctaatttttgtatttttatagagacggggtgttgtcatattgtccaggctggtctcaaactcctggactgaagcaatctgctcgccttggcatcccaaagtgctgggattataggcatcagccactgcacccagccaacataactttatgaataaactaaattgcgtattatgcatttttattttcccaatgtaataaattgattttattaacaagagatatttaagtaaaatttacattttgcttcccaatatatctgaaacgaatagaataaatacataaaatatattctaccttcccagtgttatacatcggcattactaaaatgtagatattttagatatagttgagtttaccaaaactcacctactcttttcctacaaaaataatcaccaaaacaaaaattcagtgcaggccaagaaaatatttctatccgctattttatgtctttcgaatttcaaagtactatacctttctagcttatatttttttgcaaccaattctaaaattgtgttccctgtttatagacttctcagaccccaagttcctgaggtaacatgggaatcagtgctgtctctatgtgtgtgtatctatgtggcatgtatttgcctcaactccccccttctaacttctcttgtctaacccaacttcatacagggtccttaggtcttctgattctcagtttattccaatttcctgtataaatagtccctcttgtctgcaggtggtatgttccaagacccccagtggatgcctgaaaacgtggagagtaccgaaccctatatatactatgtttttttgataactgagaccgctactaagtggctaggagacaagtggcatatatagcatggatacactgcacaaaaggatgatttacatcccaggtgaggtgcagcaggatagtgtgaaattttatcctgccactcagaatggtgtgcaatttaaaaacatgtgaattgtttattttgagaattctccgtttaatattttttgaactgcagaaggccaaaccatggataagggaggactactccacttggttgcttttccatggataatcattagttactgatttcacatgaaatttagtcaatagtatttagtgattcactattaaatttcatagatatttttactttcagttttttaaataagattcaatttcttaattttcttaagatgtaatatgaacattaagtacaggggcatacatttttcctttaattcaaccatgaaaagtataaaaatattataaaaacagaagttgaaaattccagtgttaatcttcatagtaaatattggcttcttttcctcctgaacaggtcattatccaacttttagaggtgatggatcatctgcatagaggggaattggttgctgcaatacttcgtaaccggtatatttatggaaatagtttaacttatataacgtctttcctatttatatacctaacatagcaggcattcaataaatatttgttgaatacttggtataaagtaagtatttactgtatgaatgagttagagaatgactaagtgacaaagaaattgaataaagaggatgttagtgacaatgtttcctgagataatgaaaaaatagagaatatatttagaaaatgtaattggtataaattatgagcacctggaatacaatcagtggagatatttatttgaatttttagttttaaaggcatatctgaataaatacaggtatccatagcttaagaatagaagtgccaacaacacatttttaaaaataggattgtcctgtgattgtatatatttatattatttaaaaatccagttaaaaccttttcagggagttactatgagatatttaaagcttcttctgacaaattaggattttaaatttattatttaaagaaaaatagccttgtttgcaggtgtgacagagtctgtcttattcccagtagcttgattgtacagtttggatgaaacatttggaatagtatgtttgagttgtctgtatcctggctctgatgcttactagtggtatagccttgggcaagtttcgtagtcattctatacctcaatttcctcacctatgaaatggtgttaataatagtacctacattgcagggttgttgtgaagattaaataagtgtgaaaggtggggcatgtatgaaagtgtgtgtgtgtgtgtgtgtgtgtatgtgtggagagagagaaaaaatagagagcgggtgtgagtgagtgagctgggcagatagtaagcagtatatatgagctagtatgagggaacttttaaaagttcatggaaaaaatggaaataaaagataaaaataaaaaacaactgtttcttaatataagctccacccaaatcaagttgcttttttaagtgttgataccagccatttaaagaactgagcgtcctgggaatttaaccatatcaatgatgtttcttttacattattaagtgaagaaaaatgggtgctctttaaagggtttttaagactaggaaacaaaaagaagtcagaaggagccaaattagtactgtaagatgggtgcttaatgatttcccatcaaaactctcacaaaattgcccttgtttgagaaatgagcagaagcattgttatggtgaagaaggactttctgctgaagctgtcctaggcatttttctggtaatattttggtaactttctcaaaacactctcataataaacagatgatatagtcctttggcccttctgaaaatcctcaagcaaaacgtcttgatcatcccaaaataactgttgttgtgacttttgcttgtgaccagtctgcttttgttttgactgggttacttctaccttttcctagccattgctttgattgtgcttgtcttcagaatcatactggtaaggccatgtttcatttcatgttacaattctttgaagaaatacttcaggatcttgatcctacttgtttaaaattttccattgaaagctcttttcttgtctgcagctgatctatgtgtaattgttttggtagccatcaagtggaaagtttgctcaacttgaatttttcagttggagttgtgtaagctgaaccaactgtggtatctatggtgttgggtatcatgtctgctgttattcgctggtcctctttaattagggcatgagcaagattaattttttccttgcaaattcatttggatcatctgctgctgagggcttcatctttaacatcatctcatccctttctaaaatgagttatccatttgtaaactgctgatttctttgggggcattgtccccataaacttttcataaagcatcaacgatttcatcattcttccacccaaactttgtgataaatttgatgtttgttcttgcttcagttttagcagaattcatgttgctttgatagaggctcttttcaaactgatgtcttatactcagtgcttcaaactgggtcctgttcaggcatttataacacattactatgagtttattttcatgcaaaaaaattgaaatccatgcatagtttttttcaaaatacacattttgcatgaactttttgaagatccctcatattattcaaatataaaagtgagattttaattattttgaaaatgtagtatttgtgtttttcaattccgaggtattttaaaatacaggcatgttgtaaaatgaacagaaaacgtaggaaaggttgaggtaggaagggaacatatataaagttactgttacttgacagataccatagaaggaattttccataataatccaattagagaaataacatgatgggtgcctgtttgttggaatgtatacagtagtccccctttatccatgcaggatacatttcaaggctccaaggttgcctgaaactgaggatagtaccgaatccaactgtcatcaatcagaacatatttctgctcatctcttctactcacaaatataaacattttccatcttaactaagcacttttcatacactgtggtcataacttttgcagtttgagtgtgacagcagaactagcacaagctgcttcttccttctccacaatttcaccaacagatttctttcttactgttgatctgagcaacctcagcatgtgttttttaaaaattaattttgttttaagttctgggatacatgtgcaggatgtgcaggtttcttatgtagttaaaacgtgtgttctggtggagggagaacatacttttgtaagtcaagaactttgaccctttcacttaaaggaaaccctttatggcttctctttgatatatccaagtcaccagtatcactattcttgcactatgggccattattaagttaaataagggttccgtgaacacaagcactaaatacctcagcagttgatctactaactgaactggctactaagtgactcatgggtgggtagcatttacggcaaggatgctggacaaagagataattcccgtcgtgggtggggtggagtgaagtaggatagtgtaagatttcatcatcttactcagaatgacacacaattgaaaacttataaattgtttattcctggagttttctatttgatattttctttagaatgtggttgaccatgggtaactgaaaccaggggaaagtgaaaccatgcataagcagggactactgtactatcatctgggctagggtggaatattcagcttaggggctgtaaaacagacttgctcacagatacagaaaataggggaatcatagcagggataatatgtggccatgttgggtgaaaacaggagtagatcaggggatgttgaatttatagctgcatgtatcagtagttccttctttattgttgctgtgtaatatttcattgtttaaatatgcaacaatttattctatctattttcctgttgatagtcatttaagttgcatccacatttggctataatgcataaaactgttattagaattcttgtataaaatttattttggccacatgcactcattttgtttggatttacagtatactagaagtggaactgctgggacatagagtaagctactgttgtttaacatttgtagaaactaccaaacgttttttgaaaatagttgtaccattttatactcccaccaataataagtgagaatctttactaacacttgatattgttagcttctttaattttagccattctgtgggtgtgtagtacttcctcattatggttttcactcttcattttcctcatgtgtaatgatatgaataggttttcttatgtttattagctatttggatatattttagaagcatatgttcaagtgttttggccatttaaaaatgggttattattttattttgattattaggaggttttagttcactctggatatataggtatttgtactgtgaatatttccttccagtccatggcttaccctcgaattctggtatttgtgtcttttgatgagcagtagttctttttaaaatgaagttcagtttatcatttttcttctgttatgcttggtgctttttgtatcttgcccaagaaatctttgctcttccaaatttgaggttttcttccaaaagttttacagttttagccctcacattataaatgcattcttgaccgcaaaccagagaagtgaatgtatggcctagattccacataagatctaagtgattaataagaccactttacagaagaaaagttctttgtacttttaattctaagctaatacctttgtaaatggcaaggtaactgaatgataacttgagctaaatctggcattgcagagagacctagtcttatggaccctagtttataacacaatgacttttgagtcttctcttgtaacctttcttataaataaagcccctttgaaagaaatataattctgattctaagtaatgtgatccagaacatagaaaataatgggaagttgcatagttcaaatgtcaaaacctgagcaaaacgttgcttgcatgcatatacaaattatgggtcagtttcaaattccaaatacagtaaaacataggaaaaggctcacatctggaatcacagcactttgggaggttgaggagggtggattatctgaggttaagcgtccaagaccagcctggccaacatggtgaaatcctgtctctactaaaaatacaaagaaaattagctaggcatggtggtgcacacctgtaattccagctatttgggaggctgaggcatgagaatcgcctgaacctgggaggcggaggttgcagtgagctgagatcgtgccactgccttccagcctgggtgacagagcaagactccgtcaaaaaagaaaaatggaatatatgaagggaataaactctttttgactaagaaagttttatcccagcatgagaatggtttaagatcgtgaaagttattcatagaatgcatagatgtaatgagaaccaaaagttaaaatccaaaggtgtttgaaaacaattacatgctccttttaagaatagaaaagagcccttaaaagacatgtaccctaaaacttaaagtataaaaaaaaaagattagtgacagaaacttgcacttataatatgaaaaaattatctctctgaaacaacaattcagcatcacacttaatggtaatatgtaagagttgttccttaagcagcaataaaataagaatgcccacaatcaacataatattgaatatatatctgtaaattctgtccaatgtcagtaaagaggcataattaatggaaggaagaagagaaaattaaccaattcctagaagataaatagtgctgggaaaactgtatatccacttgcaaaagaatgaaactggatccttatattacattgtacacagaaataaacgcaaaatggattacataccaaagtgtaaggcctgaaatcataaagcttctgaaagtaaacacaagggatcagagctatcaggaagagcttgacaaaaaagaaaagaaaacacaagggaaacactccttgatactggccttggcaatgatttttttggatatcaccccaaaagcttaggcaacagaaacaaaaataaacaagttgggactacataaaaatcttcttcatgggaaggaaaacaataaacaaaacgaaaaggcagcctacatattgggaggaaatatttgcaaaccatatatgtgatgagggttaatatcttaacataacttacataactcagtagaaaagaaacacaccaaataacacaacttaaaaatgagcaaaggacctgaatagatatattttaaaaaataatacataaaaatggccaacaggcatataaaaaggtgctcaacatcacatcatcagggagatgtaaatgaaaaccacgatgagatatcaccttgcacctattaggttggccattatcagaaagacaaatgatagcaagtgttggagaggatgtagagaagagaacccttacacactgttggtgggaatataaaatgatacagccattatggtaaacagtatagaagttcctcaaaaacctgaatacagaactaccatatgacccagtaatcccacttctgggtatatatgcaagagtaatggaattagcacttcctcgagatatctgtgctttcatgttcattgcaacattatacacaatagctaagatatggaaacaactttcaatggatgactggataaagaaattgtgacacacacacacaaatgggatattattcagtcttttaaaaaggagataatgcctagagaaaatttttacaatctacccatctgacaaagggctaatatccagaatctacaaagaacttaaacaaatttgcaagaaaaaatcaaccccatcaaaagtgggtgaaggatatgaacagacacttctcaaaagaagacatttatgcagccaacagacacatgaaaaaatgctcatcatcactggccaccagataaatacaaatcaaaaccacaatgagataccatctcacgccagttagaatggcgatcattaaagtcaggaaacaacaggtgctggagaggatgtggagaaataggaacacttttacactgttggtgggactgtaaactagttcaaccattgtggaagacagtgtggcgattcctcaaggatctagaaccagaaatgccatttgacccagccatcctattactgggtatatacccaaaggattataaatcatgctgctataaagacatgcacacgtatgtttattgcgacactattcacaatagcaaagacttggaaccaacccaaatgcccatcaatgatagactggattaagaaaatgtggcacatatacactatggaatactatgcagccataaaaaatgatgagttcatgtcctttgtagggacatggatgaagctggaaaccatcattctcagcaaactatcacaaggacagaaaaccaaacaccgcatgttctcactcataggtgggaattgaacaatgagaacacttggacacaggaaggggaacatcacacaccagggcctgtcgtggggtaagggtaggggggagggataacattaggagatatacctaatgtaaatgacgagttgatgggtgcagcaaaccaacatggcacatgtatacatatgtaactaacctgcacattgtgcacatgtaccctagaacttaaagtataataataaaaaaaaaggagataatgccatttacaacaacatggatgaacgtggaggacattatgctaaatgaaataaggcagatatcgaacaaaaaatactgtatttttttattattatactttaagttttagggtacatgtgcacaatgtgcaggttagttacatatgtatacatgtgccgtgctggtgcactgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttctgtccttgtgatagtttgctgagaatgatggtttctagcttcatccatgtccctacaaaggacataaactcatcatttttatggctgcatagtattccatggtgtatatgtgccacattttcttaatccagtctatcattgttagacatttgggttagttccaagtctttgctattgtgagtagtgccgcaataaacatacgtgtgcatgtgtctttatagcagcatgatctataatcctttgggtatatacccagtaatgggatggctgggtcaaatggtatttctagttctagatccctgaggaatcgccactctgacttccacaatggttgaactagtttacagtcccaccaacagtgtaaaagtgttcctatttctccacatcctctccagcacctgttgtttcctgactttttaatgatcgccattctaactggtgtgagatggtatcttactgtggttttgatttgcatttctctgatggccaaattgtctcagcccaaaatctccttaagctgatacgcaacttcagcaaagtctcaggatacaaaatcaatgtacaaaaatcacaagtattcttatacaccaacaacagacaaacaaagagccaaatcatgagtgaactccaattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatgaccatactgcccaaggtaatttacagtttcagtgccatccccatcaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgcctcatatctacaactatctgatctttgacaaacctgagaaaaacaagcaatggggaaaggattccctatttaataaatggtgctgggaaaactggctagccatatgtagaaagctgaaactggacctcttccttacaccttatacaaaaatcaattcaagatggattaaagacttaaacgttagacctaaaaccataaaaaccctagaaggaaacctaggcaataccattcagaacataggcatgggcaaggacttcatgtctaaaacaccaaaagcaatggcaacaaaagccaaaattgacaaatgggatctaattcaactaaagagcttctgcacagcaaaagaaactaccaccagagtgaacaggcaacctacaaaatgggagaaaattttttcaacctactcatctgacaaagggctaatatccagaatctacaatgagctcaaacaaatttacaagaaaaaaacaaacaaccccatcaaaaagtgggcgaaggatatgaacagacacttctcaaaagaagacatttatgcagccaaaaaacacatgaaaatactgtatttgtaaatgtcaaatagaaacacaggggcaggagtgggaagaaatgggaagaagaaggtcaaagcatgaaaatttgcagttaggtgaggtgaataagtctagagatgtaatctatggcatgaggacaatagttaataatgatatattctattctgaaaattttccaaggaagtagattttagatgttcttaccacacaaaaaggcaactctggaaggtgatggatatattaatttgtttaactatagtaatcatttcactctgtctatgtgtaccaaaacatcatattgtacactttaaatatatgcaataaaaatagaaagaaataaaaaggttaggcttgtatatctataaaagctaagtcttaaaaacaaccccttagtgctagaactaatgagttataaaaaatagttggatataaataaaaatttttaaaaacagtaccttttgtctgtatcagaaatcgccatttagaagatataatggcaaacaatcaatttataatagccgtaacaaaaatgtctaggatttatattatgaatatttaaaaattctgctcagagacaggaaagaagacattttaaaaatggacagttatacataccatggttcttgataaaagactgaatgctaagaagagatacattatttccaaattgtcctatacattctacataaatttaggaggatatttaaaaatttggcaaagcaaatcttcaataagttaatgaatatctgaaagaaatgtatctccattattagtacattgtctgctatgtagtaattgctcattaatttactaaataaaggactagtaaaaaatctatatttgttctgtttatgatgcaacaaatatttatggtgtaattggtaagaactaaacattgtcacgtgcaaaagcatgatgaaaagtgatgagttcttctactcattgaccttcttctgggggtgtggtgtggtcagataataaatatatatcacgaagaaaattgttatgaaaaattaataaggtaggtggaaatataaagagttaagagtgagcggaggtcagtgtagaagggcattaacttcttattagccttgcatgtgtttagtcttgtaatctaccatccatcatatattttaccctatatgaagttttattctagtgctttatgagctatagggagaagtcagccacatgtggtttgctttgatggaaacagtatacttatctgaacatcctcatgcatgcattatggtaatgtctaggaggacacgttgtggtgagagtcaccagtttgttgttgtggcggtattttctgattgcattcctggagctaatagcatttctgtaatgctctgacagagtttcagtcttccaaatgtagtctttcatagatgaaacacagtataaaatatcgtctggtatttccaacacaggagaaagagtgccaaacactgtacaatcatatttttaccattttaacaaatattattcaccacttactgggtagggtgctagggatatagcagtgaatgttaatacatggttttctgtgtagtgggaaatacacacaaataattgtgtttcttaagtgctgttgaaaggacatatggggtgctactgactgtgtataacacatatatacaccgggtcttgggagggtcaggacaggctttatgagtgaagtcatgtttcttctacttctctccatttccactctactaccaccatcttagttcaagctactctcatcttttgcctgacgtcctgcaataaccaattggttagttcatttttctctaggttctaattagagttctcttttcagaattcaaatctagccatgttgccttttcgctttcaaattattctatagctgtatcttaattttaggataacatccaatgttaatctcacattgcactactatgcatgaaggcatgaaaaagcatgatgcattcacagagctataatcaaaatcagatgattattaattataataataaggagcaaagtaagaaaaggctggagatgagttaggagagggaggtatggatcaagttaagaagcattttatgtttatgctaaagagtttacatacttcacagactgcagagatctactgaagcttacaaacagaagagtgatgtgatctgccttatactgctagaaagatcactttggtggctgtgtggattatttggggaaggaggacgggaaaattaggagaccagtgatcagtctattgtagcagtcaaagaaagaaatgaaaagagtctgaacaaaggtgatggcagtgggaatgaatgaaagggaatgcatttgtgaaatacttagggatgaattttacaatgtttgggaaccaactggtttcttcacactctaggcagaaggttcttttaaaattgttaatctgataatgtcacctagactgtcctttcctgtttatgactattaaaatcctacttgttcctcaagacccatactgaattccataccctacataaagcctcatctgatcaatccaatcacaagatcaggagagcttcttgcctctgaactactttaccactgcaatgaattttatcatgtttggttctgcattgaagtaatttgagcctttatttgcttatgcctaagggagccctttcagagagtgactggctgtatctaatgtatttttatatcctgtattgtacataatgcaagattttgcacatagtaagctttcagtaaatacctgtagaagttgtaccatttattaacaattactggatggtgattttattcagtaaaatggtttagagtagttttcttttgtttcccacagttaactcttacttatagttaagtaatttaatattaagtgacagtctttaagactgtaaagtaggctaactgaatttagtatagattctaggaataagcccagacttttgtactgacgtaatgtataatcatgtcttcatggtgtagaatgtcaagggaatacagggctgggaatcaggtcattccatgtttaaaaatatttagcctttactatttgtcaagtggtgtcctcatctgtcacatgtaagaattggaagatggaaatctttcttttcattttaaaagtctaaaattatatttttaagacgaagcacatagtacatgctaaagaaacacatatgtgattaacttcatataaaacaaatttaacaaggtgatcagccattggagataagtccttttattaatttatcataatttggttttctcactttcaatgaaggtatcttttctgtgttttttgaagattaaaaacttgtgagggtctggttttatcatgggtgaagtaagcgtggcaataattgtaagccaaatctttggctagaagatctagccaataaaaataataagagggtaacacatgaaattctgagaccagttactttttatacattggaattattttggtttaaaaattctgtaggttttggttatccactattattgtcataagatcttatggtagacgcacatgaaatttatcaccatatttgttcctataactgaagagttgcatgttttcatacaaaggatatgggcttgttagtaatgttgcatgttttatatatttgaaggaattttccaggtcatagaaagtatatctgttcttggggagaataattgctactccaatttcagtcatcctacctatcttgagtgttgctgttcatatttacattcttcctgtgcaatctcatctaccgcaattatttcagtccttgcctacatactaaagacctttcatttatagctcgagtctcaattttttctgagtcccagactaaaagttgtttattttctccctccacaattttttgtttgtttgtttggactctacaagtaatacatatttattacagaacacttagaaaaatagaaaattatatatatgcagggtaaataatcacataagatagcctctgttaacacctcgatgtattttcactctagtcttctgatacatttttaaatgtaactaaggttttacttattgaatatgatctagttatagtagtgtggttaagggtgaggctctgaagtctgccaaatataggtgtcattcaaactctgctacttactagctgtgtgaaatttggaaagtgtcttaactcctatgagtccatttcctcatctgtaaaataaagtgatatcactgtgtgggattgttctgtggattaaataaaatgtttgtaatatggttaagttcctgtcatatggtaaatgctcagtaaatggaagcgcttactgttttattatactatatatcatgtctgtacctccctgtttttcttattagattttgaatattttgacatcagtaaagacttgtagttataatagctgcatggcataagccattctgtggtacaaacaatgtcttaatattagatatttaggccaattccattttgggggtattgggggaatcagcccccaatatttcaatgtaggttcttttctattttccctaagtgtcagctggtctcagaaataaagagacagagtacaaagagaagaattttatagctgggccgctggaggcgaagtcacatatcgtcaggttctgtgatatccacttgagctgcaaaaccagcaagtttttgttagggattctaaaaggggagggggtgtatgaaaagggagtaagtcaaaaagatcacatgcttcaaagggcaataaaagatcacaaggcaaaggcaaaattagaatactgatgagggtctgtgtgccgctgtgcatgcattgtcttgataaacatcttaacaggaaacagtgttcaagagcagagaactggtctgactagaatttaccaggctggaatttcccaatcctagtaagcctgaaggcactgcaggagaccagggtgtatttcagtccttatctcaaacccataagacagacacttccagagcaaccatctatagacctaccctcaggaatgcatttcttccccagggtcccaattattaatattccttgctgggaaaagaattcagtgatatttctcctactcacacttccatctataggctctctgcaagaagaaaaatatggctctgttctgcccaaccctgtaggcagtcaggcctcatggttatcttcccttgttccctgaaaatcactgttattctgttctttcttagggtgcactgatttaatattgttcaaacacacatattttacaatcaatttgtacaatagtggtcctcaggtgacatacattctccgcttacgaagataacaggattaagagattaaagtaaagacaggcataagaaattataagagtattgattgaggaagtcacaaatgtccatgaaatcttcacaatttatgttcagagattgcagtaaagacaggtgtaagaaattataaaagtattaattttgggaattgataaatgtccatgaaatcttcacaatttatgttctgcctcggctccagccggtctctccgttcggggtctctgacttcctgcaacatgggggtattagttgtagtagtgccttccatatctgttataatttatcttttttccttctatttattgatttttgctctatactgtgtcaaatcctctctttactccctttaatgtacattttgtttgtcacattggtttagtttcctttagtttcctcgaccaacgtaatttatatctttcctcatcttatcttacttggctttctcttcctggctcattgaagtcatgtttccttattcaataaatagtgtttttcaatatatttccattgctgctttccatgctagttgtttttgtttttgtctgttcattctcaaaggaagaaagattccctgaaaggcctttgtactgttgtttaaaatgttttttgttcatggtctttatgtggctgactcttgttgtctagatctttacttaaatatcctctcctctgagaggtttcctttgaccatccaatctaaagtggccacctgtatactgtctattgtcacaccatcccaatttaattctctccataagactcatcattccaactattagatattttccttctttatttattttctatcccctttcactggaatagaagctccaagaggccaggcatcttgttcaacttgtttactgctttaatcgcagcacctacaaccatttcttacagacaagttactcaataaatatttgctgaatgaatgaataaaggaattaaccatttcccctctgtctgtgctcttgtgcactaatcccaccgttttctctgatttttatccatgagtcaatactaatagaaataaacgattgaataaataagtagggtagaagagacaagtcttccttacagaagaattccatattttatttgtgaatgtttgtttgtatatataccttctttagaggctggaactttattctccttccactggtgttaatttaatgattcacttacaaagaaaagaatgtggaatggaaaaaaaaatggtaactttatagtgaagaaatctgacaaatactaccagcagtagacagaatacccccgccccctgcccccgcccccgcccaggatggccacattttaatccccagaacctgtgactatgacactgttcatggcaaagtggacttgcagatgtgattaagttaaggtctatgagatgaggagattatcctggaccgttcaggcaggcccattgcaatcacaaggatccttataaaagggacacaggtgcgagtcaggaaaaggagatgtgatgatgggtccagaggttggagtgatgctctttgaagatataggaaggtgccacaagccaagaatgcaggtagcctctagaatctggggaaaaaaaataacaacaacaagaaaaccatctctcccctgaagctttgccaatagttaatttttgatttctgacctccagagctgtaagatcatcaactagggttgtttaaagccaccatttgtgatcatttgtcacagtggaaataagttagtatgccttattttcagagtctggcacaaaggcttcctaatatataccaggagctgtaatttctgacttgatataagcacaaagaggaattgatggtagtggtggtcagaaaggggcacacagtaaaaggtactagaactctggctgctttaaaaagcaacaacattgccaggtctcagtttcagtgctggcactggttttcctgactctgtctacaagatatttaacagtaagttgggcaaggtaggatcagaagtaactagctatttgttatttaaaattgaatattcaaatatttatctatatttttcttatccaattgtataatttatgctcattgagaagtatttggaaaaattataggaaagtataatcccactgcactgaaagcgctgttaatattttggatctcataaatacaaatgtttattcaacacaaagattccccagtattgtaaacatgacatatccaatgtccaatcccatgtaatcttagccctgagtacctgccttgtcatctatattcttggtattgtttgatgacaccaccattcactcaggtgtctgactcagaaactcgggcatcatcctggaccctttctcatccttcacactcagttagtctctaagtccacttctccttcccaattatttctccaattcactccccctgctgttttatccttattatcacttccttagatttggcccacataatttgtcagctagatcattaaaatatccttctaatctgttttttttttttgcttctagtcttagccctccccttctcccctgacagtttctctctctctttgcagccataatgatctttctgaaatgtaaatatggtcatattgttttcttgtttagatttcttcagtggctgccagtgtggcaaggtctcttatatggctcctgtctacctcaccaggcttttctcctgcacagagcatgcattgcagccttccccaacactggaagatgacccgttccctcatattgccacccttctttctggaatgctttctctcatatgttgggcctaacccattcctgtttatcattcaggacctctctgtgaaactttcactgaaatatatgccatgcctcttccaagcagaattaggtgtccttttcttatttatttatttatttatttatttattttgagacagtgtctcactctgtcacccaggctggagtacagtggtgcaatcatggctcactgcagccttgacttcccaggctcaggtgattctcccacctcagcctcctgagtagctgggacgacaggcgtgtgccaccatgcctggctaatttttgtattttttttagaaatggggttttgccgtgttgcccaggctggtcttcaactcctgggctcaagtgattcacccacctcagcctcccaaagtactgggattacaggcgtgagccaccacatgtggccaagtatccctttctaatggctcccctagcattgactctttttttttttaaattatattttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctaattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattaccattctaactggtgtgagatggtatctcatagtggttttgatttgcatttctctgatggccagtgatgatgagcattttttcattgttttttggctgcataaatgtcttcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagtttatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattcaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaatagcattgactcttatattttggtgttgttaggagagattgaagtcccagtactcatagtagttgtattggcaagagtcattataatagctaacacttaaatagcgttactttgtactaggtacaaaacctttatgcatattaatttatgttattctcataataactttatgaagtagatactcatcattattattcccattttacaaacaaggactttgaggcacagagagattaagtaaattgtctaaggccacacagtaaataagcatggatccagggttcaaatgcaggaagtctagctccagagtctttgcatttagccatatgccagtctttttccttccctggaatgcaaactccctgaggacaagggttttgcctgtcctgtatcacctctcctgtgtctcattacctaaaactaattcatggcagtaataaatacttctcatgatgatctttttagagagtgcaggaagtgaatgtagaggaatgtgtcctcctgtctcttcctagcagaattaggtgtccctttcttacagctcccatagtattagatcttatttctgtggtgtctgtagtagatattaaagttccaatactagtagtacattggttgtattggcaagagtcattgtaatagccacctatggcgtttaccctaaggccaagctagttctgcttattttgggtgtgcatacatttacgctgataggttaagtactattaatgagttggaagcctggaagttgataaaggtaattttttcttttaacagatgttcacttccctcctttttcagtcttttattttttccccttttcatcttcccagcaaacacagttacaaggtgagcgttagaaagattatgtaaaattttcaaaggctcctgaacaacagttgtgtaatgttctattttgggttacatgtgaccaggaatatggacccatgaaataattcagagccttaatgtggatgcttctaaaaatatatagccaaaggacaaagttttcctttgtctttctggttatcagtgctgtgtgatattttgaccccttccctccattcgacacttggttttctttgtaccattgctttgtttcagattaaaatgaaaagaaaaagattaataccttttttccctggaagatctaccttttcattggattatagtttccatgcctgtctttgggacttattaatagctatggcaatttaaaggctttgtgatccacagataggcatactatgattctcttctaagagtccttaatccaccattgagagaagggcaatgtgtcctcctcccttcctgaggccctctgtatccatggtgtgttatgaaatgcatgatcctgaaggtaaagatgttttcctatatcagcacagcacgacatagctgatatagatatgagctatagatagctagaataaaatcctctagtgacctttgcagtctgttttaggggaaacaaacaacagaagcagcagagtgaatccaaattaaatttaatgttgtttttgacaggaagagctgtgcctggatgtagacagtgtcatttctttttccctggcacattattgaaaatactaatatataactttgtccaaatttggctgagatcagccattgtccagggctggcaggtctctctctctttttttttttttttttttttttgacagggtctccttctgttgcccaggctggagtgcagtggctcaagtgattctcccacctcagcctcctgaatagctgggactacgggtgcacaccaccacgcctggctaattttttctattttgtagagatggggtctcgctatgttcaccaggctggcttagaactcctggcccacaagcgatcctcccacttgggcctcccaaagtgctgggcttataggcatgagccacctcacctggctgactcctacttttgacttctcaaacttgggaggctactcaaatcagtgggaggtcacttagaacacacttttctctctagattccctgaagcagtgctaagtctaataaggcctctagggagcgataattatttgatctctggcccccaatgcctgccccttaatgttacatttatcctttactcatgtgatatgaaggggaaagtatattaatactagctttcaagtatactactatactccttcccatttccctttaagggtagtttatttacctgattgacctttctgttgtaaaggcagaatgtgatactgagtgtggagtttgaaaaccactgttttctggtcttgactctgccaacttaacagtggtaccagtttctttcttcttcctttttttttgtttttagaacagaaatactttctcctgtcttgaaaattaatgagataatatgcttgaatcactgtgttctccctgaaaggtggaccctgaataaattcaagctgatttttttgaaaggagctgaaggcagagttaagtctatttgtttttctaagaatagctgtggctccacaaataacatactacactttttttagagaggaaaagattgtagagatagtgttaaccctctcaaatgtaaaatgacagggaatctgatattcaaaggtgagatcatttgtccaagttcatgtagcaaggtaaagggccaagacatgagtacccagaggtttggtttttctttttttttttggcacaattaagagttatttttgcctcagaaatctgcatttcacatatttaatgcaaaataaaacccttctttggtaaaatacattctgttagactttcactattgtacagtccatgtgatgaacttagtatttatagttaaattagtatagcctttaccaccatttttgtatgtaaaatactttccctcttatctaaatagttccagtagtttcttttctgtgggttggatagaaagtaagtattgatctaataatcactgggtggtagggagatggataaaaatagaatggaaactcaacccagtctgttctaaactttgctatgtgtgcaattctgatgtattatatggccttaaacatatatttaatgacacatctacatccaggcacagcccttgctgttaacaacattgttaattcagttacacttcactctcctgcctcagttgttgttttccctagaaaagactgctaaaatcattacacaatttctttccagctatttttaggcccatgtcttagttttctattgctgctgtaacaaattaccataactccagtgccttaaaagaacactgatttgttaccttacagttctgccggtcattggcctaaaattaaaggactgtgttcctttctggaggctgtaggggaaaatccgtttccttgcctttcccagcgtccagaggccacctatgtgcctttgcttgtgtctctcttcctccatcttcgaagccagcagtgctgggtcaaatctttctcacatctcctcacttgaacctctgctgctttcctcttccaatgttgaggagcacaactgaataatccaggataatctccccatctcacagtctttaacttaatcacacctgcatcatctcttgctatgttaggcaacatatgcataggtcccaggaattaagatgtggacatctttggggacccattattctgcctaccacaccctatatctatgtcaactataccatactgtgagttttcttttggagggtattaagataatggctgttttcaagttaaaaaattattttcaaaaatatttatcacaaatctttgtcccagtgccctccatgcaagatagtttccagccattatgaataattgtttaatattttatatatacagtcatctgttgttatctgtggggcattggttccaggaccccctgagactgcaaaaattcacagatgctcaagtccctgataacattaatacattgtaatcaaagcccattcaaattttttccagttatcccaaaagtgttattgacagcagaaagctcaacttcagaattatgcattgcaattaattgtaatgtctttttagtgtttttctatctggaacactttctcagtcttctcttgactttcatgaccttgacacttttgaagattacaggccagttaatttgcagaatgtccctcagttttcattagtcttaattgttcctcatgatattattgaggttttgcttcttcagcaggaattgcacagacatgatcttctcattgcatcctatcaggtggcacctgatattgatttgtcccatacaacttgataacttgattaaggtggtatctgtcaggcctctccactgcaaggttactttttcttttatttctaattaatagtatttctgatgaggttgagaatactttgagactatacaaatatcttatcccttatcagactttcaatatttcatttattgcatcaatatggaatcatagtttcctattttattgttataatccttgatttattttgatgccaaatggtctcatatttgtatgatccccttcaagctggtttatgtatctttttcacaagtctcaatcatccttccttatgtttggagtttatcttgtactttctgagtgcttcattacattccagttcatcttgtactttctctgcattagctctggaatcaggcatcatggttccttttagtggataatcatatctcgaaccaaaatctgtttgctaggagtgctcattgctattccagtattgctgttccaaggcccttttgatggagagagctaggaaatatttgtatacatgtatatacacacataaatacatatacacatttatacatatatgtttatatctttatccattgaaaccatgagttctcaccaataccttcaattttaatccaataccatagagttcattctagttttctcccttttcatgatttcacttctcaattggtaacattaagaaacatgtctcttattatttgaccagttccttcacatgtagccaatgccctgttgacacacccttgcctccccgactctgacttccagaaatcctggctgtagctgccacctccctgcatgaataccctcattttgtttgcatttcaccgtaccacatcagtccaccattgatgtagtcttcctgcaatgacaccttcctcatcttctcaagccccacaaagagtctctatggtgccctcttcatagggcatgcctactttgcttggtcccactaatggattgaactgttcaggaaggggaagggaaggaacattttctgtactttgacgagttgttgccacctttttccttacaaccatggtaaggattactacccttgtactggatatttactttctattgttgtagttcctataaattctgctttcctgtagtcaacatccacattttaaaattataatttatgagatttttgcttgtcaatttgagtccttttcttcagattaatattaatttgtttactggtttattattattactggtttgatttttgcctaataaggtgttaaaaatgaggcaactggaaataagatgattttcacgtaattatggtataatttatagaaacactactgctttctcataatactttttgttatttttatgttcttcatttaattttttttcttttcactaactaaacaaacagcagtgataaatataaactatcagcaaagctggcttagaagaaagagtttaaaaaaaatgagacaggatctctatgttgtccaggctggttttgaactcctgacttcaagtgctcctcccaccttggccctccaaagtgttgggattacaggcttgagccactacgcctggccagagtgaagcctttcatttttgaatagaggtattttaaaaacctattgcacagtaacctattcctggttatttagggttaggaacatgagttcaaaaagtctgacctccttagcatggcatagaaagctcttcacattaggttctcagatttcctttctagcctcagtttctgctgcttctcattttggtactctgtgctattactgtaccacattattttcccttcgccaagtgtgccacattcttttgtatttctgtggtagtgtgcgattacccagaaggtagatcaagcacatgcttggaacaccaaacagacataggtaccaaacaatgaggaagaaaaagagtatttgatgtttcatgtcatcatcaaggaaattagatctttgttggacttccttacacttaattcataatttagaattatttatattttgaaatacatgtgagggagcaccatagccttttctgtaattaaggcccctgtacgttattttaggcccttctctgtgcctttgcttttgctggatcttagcactgtgaaccctgcctctgagagaattgcatgatattccatcccacagcattttatttatttatttatttatttatttatttatttatttatttatttattttcgagacagagtttcactcttgttgcccaggctggagtgcaatggtgcgatctcagctcaccgtaacctccccctcccaggttcaagcaattctcctgcttcagcctcccaagtagctggaattacaggcatgcagcaccacgcccggctaattttgtatttttagtagagactgggtttctccatgttgaggctggtctcgaactcctgacctcaggtgatccgcccacctcggcctcccaaagtgctgggattacaggtgtgagccaccgcgcctggcctccatcccatagcattttattgcacatctatcataacacttagcactttgtataacaatttttaaatcatctctcctgaccaaaccatgaagtccgtgaggaaaatgacatcttcccatctagccatctatttcgtgcatctaacccggtgatttaggcaaagtagagactcattaagtgttgttaaactgaataattattgtcttgtttatagatgcaggtggtagcttttatagcagagattgaattatgtctctttaactgttaccgcacttgattcattagtatctgttcggatagaatttgacatgtccaggcagtccagtttgttaatataacaaactgttcagagaattggcagtgttcagaaataagaaatctgaaaaatctgtaagattcatatgcaacacgatgatttactggaggctttttttttttttttttttgacggggtcttgctctcacccaggttggagtgcagtggcacgatcttggcttgcacaatcactgcaacctctgcctcccaggctcaagtgatcctcccacttcagcctcctgagtagctgagaccacaggcatgtgccaccatgcccagctaatttttcgtatttttggtagagacacggtttcatcatgttgctgaggctggtctcgaactccagagctccagcaatccacctgcctcagcctcccaaaatgctgggattacaggtgtgagccaccatacctgaccctactggtggctttttcttccatcttgtccagtgttctgacaatcaggatttagccttgtatactcatgttcattcaattgcattagttctttaaaaatcgtagaatcttttcagttagatttggattagagttgtaggtactttctgatttgttcactttaagcagttcaaggagaaaacaatgaaaaattttgttgttggatggatatcacattggctcttttgctgcttaaatatcatctatccatggcctgcaggagccatagaatatcttaactcgttggggtcctattacgatagtcctgccccagactacgaaaagtttccaaaggtcatcttttgagtttgaagccatctgagtagaaagttttctaatggcagtggttcccagatgccagttagttcatggaagctggtttgttatggatattgtcacaggtctgcagtgatgtatgagaaacaacagtgtagtgattatctaccagaaagctaactttattgattacaaaggaccatcctttattctgagattgttctttacactttttgcttgttcaaatgctcttttgtccttaatttaatgaaattaaatttacgatgttaatcaaggactgtatctgtatctttatatgaaacccttgagacaagatatgtttcagaacttacattctttttggattttagaaaggtagcagtctgtatatcctatattacataacagccccagcagggtttgaggtgacaccccataatcagttacagtaatgttactgcagtgaaatataagaatatttatactaagtgagagaaaaagcctgtgaatagcctcatgtcagttcaggtcaagcttgactgccagatgagttcatatcagttcagattttgctgccaaatgagttacaggcaagaaaaaattgatttccaagtgtttgaattttgaaattgtggataaggggttgccttttaaaatgtccttactttgtaaaataaagttgagtatcctatgtaggaccccaaaatgtttttgaaatttcattggtccacaaaatccaaaacttgggaaacagctcttgaaagctattgaagtgagtataacattactgttacactcatccctagccaataataattttcctctctattttgtttgcaaggaaatacattgctgttggttataatctttggatgttgtaaaaatctccaaatatacttttaatcaaagtagattgaaattaagtttatcttgtagcaattttaggacgctggggcaggagagaaggttgcagcctgaatccatccacaattcccagtgatggattaggattctgtgatagggatgggttctagcttgacaagtcctcccggctgcatttgtttggccaaatagattagtgaggagattggtctgttttgggtaagggcaatagtaaatacctatgtgcacttaggttaactgattaatctttggcatttgtagcttaggtttctatccatcagatggggttaacagttcccatctcacaagtatgaaatgagttaggagctatggaagtactttgacaatgaagatcacattagcatataaaataataatcttaaagaagaagttatgtagtatgaactaatagaatcaaaacaacacagctgcacaattcttgtcctagtaaatttgtctagaaagtagacttggtaaaacaattatttgacctaactgggctataatttggctcttgcttaaaaacagtatttctccgttctatgtgccagttatttatttattggccctcagcttcagattcaccatgtgttgcctgctctgtgaaaatggacctgaaccttttgttttctatttatttatttatttatttatttttaatagattttttaaattatactttaagttttagggtacatgtgcacaatgtgcaggtttgttgcatatgtatacatgtgccatgttggtgtgctgcacccattaactcgtcatttacattaggtatatatcctaatgctatccctcccccatctccccaccccccagcaggccctggtgtgtgatgttccccttcctgtgtccatgtgttctcattgttcaattcccacctatgagtgagaacatgcggtatttggttttatgtccttgtgatagtttgctgagaatgatggtttctagcttcatccatgtccctacaaaggacatgaactcatccttttttatggctgcatagtattccatggtgtatatgtaccacattttcttaatccagtctctcattgttggacatttgggttggttccaagtctttgctattgtgagtagtgccgcaataagcatacgtgtgcatgcgtctttatagcagcatgatttataatcctttgggtatatacccaataatgggatggctgggtcaaatggtatttctagttctagatccctgaggaaccttttgtttttatcttttttttgttttgaaccttttgaatggttgcttccattaccacctgacactgaagttttgtcagtagagggtgctggaaaggcacatcaggaaggaagtactttgacaatggtgaccactttaacatatcaaatcataattttgaggaataattatatggtacaaacttgtatagtatttatatgttcatatagttgtttatataaaatttatatatttatatagttgttatatataatatgtataatttacatagcatttatatggttttgcttcatggttccctgtgtgcttgctcagcaggctgttttttgagcatcttcaccagtgctcagcttctttacccagtggtcagtagcttctcatggtgcccccagagacagttttatagcagagtatttctggtaggacactttccagaaggtgtattttgagcatgtcacaaagggtgggtttctgacagattccagctaatgagcaccacagcagcttctctacccttcattgtgctgtggctgtgccctctccaataatgtctggatctcagccttgagcagaagtcactttctttggtgctctttctcagccctaggggtagttgctcctgatatctgtgattctttgattcttgtgtttttttttagaatctctttacttattactagccaatttctcattactccaatttcctgttattccaaccctctgtcatagttaataatttcttatgtacaactctccctgttcaaattactatgcggtttctctctcctgagtagacccagacagttgcaaccaattaaagatctctctgagccaccatgtatcactggcaagccaattcttcagagatgatatcgttgtatctgtagttgaaaaaattcaaatatcttttagggaaatgtctcaaaatccaatgaagtttagctgttcttcccatggggtttctgtgtacctatgtatttgtctctctttctctatcttcatgtcccaccaccttaactgtgagttctcactcttctctccttctccatctatttgccttcatacacttagtttccaaccccagcattgcttttggcttccctgcgtctcaatttctgtcttggtgaggcagcgatataaaagatcataaattaatgaaatcaaggacatgaaagtgctttgtaattagtagagtaccatacaaagtggtgatattacttgtgtttattaaatagttttctcttctatgttttcaaatgttcaattatgttttattttaagagctttgtgggtgccttcaggggtacttacaaactagtaaaatagatacatcaatacatagaattattagacaagactgaatgtgctgggtgctaaaataggggaacaaatgaggaaacaggagccctgaaaattagaatttaattgtggtctgaggattcatggattatttccaaggagaatcatctgaccttgaaggaccttacctgcaatttattaaatgtttgtggcacaaatgagccttgcaatacgtactttacatatattctcatattgaatctttacattcatccttatattcttaaattattttatgtcttagactgatttcaaaatattttgcttgaagacagatttttgttcatttgttttatttttaattgaaacttacctccagttatgtgtgaaaactcagtggcagtaaaatctacaagatagaacattatgttgcttttcaggtattttctattttcatattcattcatggatacctacattttaaaagatggttgaacacttttcacctgagaactagagtaaatatatgataatctctatatttaaaaagggaaacgttttgtttaaaaattgatgactcagtctctttttttttttccataagagagtgtgtcagtaggcttctaggagatggcatactttatgaaaaaatgtagcatactatttaaattagaggtggttacgctttgaatgcaaagtatcctgtcaaatcacaggatgagtgcatctcccagtggaagatgttgcaaagtgcaagtgagtatgagtcttcccgaaagcatttgtctttatagcttggattctatgagatgcccaccaaagacacttaattttttatcttagaaagtcaagatggatgagtcttcagatttattaggaacccttctttagttttgaatattttgtgatgaatccatactttatctttttgcagatgagatggaaatgtcctgtttctttggcaaataatatgtgagcatagcacatgtagctttttttttttttttaaataggctatgatttgatcagtgttttctgaagtattatgtgcgtgctactggtggtatatgtacccgtagaaatagacagactaacacaatttgaatatatttgttacttattttaacgctgattaggaaaaaaagcctggtatatcacacttgtcatttcttagatactactgaagttaagactatgcaggtaaaaacacctcacccagaccaagtgaattactggtgcagtgttcaggcatgcccaagaatgtattgctgcattcttttcatagatacagcaacactctaccagaaaatagtagtatttaaatatacaaagtatttataacatacataattgcaaattggaatcggttctatgctctttttttgttttgttgttgaggtcagtatggatcaatggataaaaattgaatttttaaaatgtaaaggtgcagactgtgagggaaatcttattaggggatgattttgatgaagttagtcatgtagctttagacaaacttgaagaccaaatttagcaaactgtctgaatcatctgctactgttacagaaggaccaactgcaaagaaaacaactatcacacaaatttgatgaaagtatttgaaatttgtattttcataagtatgatgagaatgaacctctttccttgtatgtcagatgtgtagagacacacattctggtgtgaaacctttcaatcctgtgcttttttgaaacacaaagtgtgctatacaaagtccacctgagaggttccttaaaaagttgaacatagagttatcatatgttcacccagaaattcagaaactcctaggtgcatatccccccaaattaaaaactagtactcaaacaaatgtacacccatgtgcagggagggactattcacaatacccaaaggtggaaagagctcaaatgcccattaactgatggatgggtaaataaattgtggtatgtacatataatggaatactcagccatatagtatattagaagtatcagtacttctaatatactagtaaatggtggatgagcctccaaaatattatgttagtgaaaggagccaagcacaaatgattagatactatatgattcaatttatgtgaaatactaaaatagataaatccatagtgacagaatgcagatgcaaggggctaggggcagggaggagagaatggggagcaactgcttaatgggtatgggttttattttggagttgattaaaatgtttcacaacaagatagaagggggtggttgcgcaacattctgaatgcactgaatgccactgaattgtttacttgataggtgcagcaaaccaccatggcacatgtatacttatgtaacaaacctgcacattctgcacatgtatcctggaacttaaagtaaaataaaaaattaaaaaaaaatcactacttttatcttatgtggatttcacctcagtatggaaaaaataagacttacccagtagtgtggtatgtgtgacattttatggggaataggatgatgttaggttgtgcataagcatttcttattacaggagttaagtatgtatttttacaattgtcttctttttatgagaaattattagtttcctatttgcagtaataagttttcctttaaagataaatgtaagttttaaagaaaaaataagatggtactgatatgacacatgaaggcagttcacaaatgaatgaaaaatggcagcttcaaagagacattttgttttatgttcaagccaactaactttaatttttattatgttattattataattattattgttttagagacagagtctcgctctattgcccaggctggagtgcagtggcaccatcatagctcattgcagccttgaactctatgactcaagtgatcctcccacctcagcgtccctcacaggcatgtaccactactccttgctatttttattttttattttttatacagatgaagtctcactatgttgtccaggctagtcttgaactcttcccacttcagcttcccaaagtgttgggattacaggcgtgagccactgtgcctggccaatttttagtgagaacatattagacactagttgctgtttatgaaagttgaacgagatgtgacttttgccttaggaaaaacttccaacctaaaggtgataagccaaatctataaataattcaaggaagaagctgaatgtgcccagtgagactggaacagaggacaaacagactgaggccaagaccaggtacctgtttggtttgattaccagtaccatttcagaaaatgctagaataggcttctgggtgtagtggctcatgcctgtaatcccagcactttgggaaaccgaggatggaggattgcttgagacctggagttcaagaccagcctgggcaacatagcgagaccccatctctaaaaaaataaaaaaattagtgggcattgtggcaagcacctgtagtctcagctactcagaagactaaggtgggaggatcacttgagcccaggagttcgaggctgcagtcacctataatcacactactgcactccagcctgggtgacagaacaagaccctgtcactaaaaatgggaaggaaggaagggaagaaggaaagaaggaagagggggagggaggaagatgctaggatatataggaagaaattaaactaaactctatgtacaagtgcaaacaaaaccccaacttaatattggcattcgtggttgatggaaagatgggagttggtgggaaaccattttagagcaaaatttgcttttgaaattagaaacagggagaaaaattacttaataaatgcagcaggccgggcgtggtggctcacgcctgtaatcccagcactttgggaggccgaggtgggtggatcatctgaggtcgggagttcgagaccagcctgaccaacatggagaaaccccgtctctactacaaatacaaaattagccgggcgtggtggcacatgcctgtaatcccagctactcaggaggctgaggcaggagaattgcttgaacccaggaggcagaggttgcagtgagccgagatcatgccattgtactccagcctgggcaacaagagcgaaactccaactaaaaaaaaaaaaaaaaagcaacagataatgtaatcaagtttcatatactgtggtcctttttgcctctacctttttctctctcagtaacttggaagtcctctgggcttcctctctccctaaaaatctcacatttaaaggtagcatagtagagggcttgagaatatatgctctggagctagactgcttgggttcaaattccagttccaatatttacagatcgtgtaaccttagtcatgtcacttgatttttctatgtatttgttttatcttctgtaaaatggggatgttaatagtaactgcattataaggctttggtaaggattaaataagttaaatgattaaatgtggtaagcatttataacactgcttggcacatggtaagtgatcaaacaaatgttagccattatcatcatctccagtcagtaaatcctgtcaattttgtctcctaaaagtctttttgaatgtcacccactaccactgccttagtttaagatcttatgttgtcacaattgcaattgtgccttaactagtcttgcacccgcaccctctctcctaaccatcccctctgtctcacttgactgcctgacatactcttgcttattctgaaatactcagctcagatgtcacctctgtgaaactttccctgatcctctgtgctagtccacttagggctctccatgtgcacttatatcctttggaacatatctcatttatagcatagcttatatagtactgtgactgtaactgatgttccgtgggttgtgtccaccttgaaggtgagaaactgggtttacttagttttgaacttccaccctaaacacagcccctggtacaaagtagatgcttattaaatgcttgggtggattattgaatgggctctgcctgtagaaagctagtttacagtcttcatttgggaagctaagttgaacacacctaagaataaataactatgaacattgtatagtaactgctgaaagagtttagaaagaaaaggggagtgctgggggtaatcaaattatacttcaaaaaggtagagcttgatttagaacttaagaatgggcagaacttgtgtgaacagagaggcagccacaatctactatgcaaaagggatgttttatgagttgaatgggtggtgacagaaaaaaaggaaaaaaaaaaagcccagccttagcaaaacagagaagagaccagtctaattagggtgtgtgtatgtgtgttgatggggggaaggtatatgttgaaaactacaagtagatcataacctataaacagggtgtgttctaaagatttatttacaaaccatttgtttggacatgacacataatatacatggtttctagccagctcaaaatattgtatttaacctacttagtagtgaactatcccagggacagtgctccagagcctgggagcagagagtcaggaaaggtgcgatggattctgggctagaagacagagtgatagagaaattgagatttgttgttctcctatgaccctttctgcacctttttttttttttttacatctcagtttctctaagagaaagtttctctatccctcaaggcaccccatgctgctaacttccttgaaacagaaccccatccaaagttgctagggctctaaaaggctctctctcacctccagcctgcctcattccctcagggcaacagctctttgctatttgaagaaacttgactcaactcattcatgccaatgtgtgaataactgatagccacctcatcctggcagctgtacttactttaattttaacagccttcttgttagctcaaatgaacctgtaattgctggaatttctggcactggtacagagcaaacaatgtgggaggggggtgagggttacagagagagagagagagagagagagagagagagagagagagagagagagtttcactgtaggagaagatattttgagataaggaaagctttggccaagagctttgcctaattttcctttcttctccacctccctcccccaaattgttcttgtgtattcctcttcacaggtttactataggctgcaagttgtttattattattactttttaagaataacttctgtagcagttctgggtatggtggtactgtgttttttagttgtgtgcaaatctgggattacctgtaatgggaaatagggttgaatagataaggtggggctgggggttgaggggaccttgaaagtggagtctacaaatacatccatagaaataaggagtcatggaaagtttttgaataaaagcttaagatgatgaaaccaataaaggtggcaaaatgaattctaaattttgaattagaaatgatggagtattatgtttactcttggcttgggattggtttatacagaatcatatttctggttaccatttttcatggttctgggcattcacctttaattgttagtatctctctccttggctgtctgttctctgtggctcctgagccaatcttccttcaggattaatatgctcctagaagcttttatgacttttgtattaccaactagcacataagggcttatacattctgtttctgtgtcccaaaattcaagtctaatgttagcaaaacacaactctcatttataagacttttttttttttactttttaatgaaaatttccagcctttccaaacataccccaaaaacacactggagatagtggttaatgatctgcatcagttagccctcagagctgcaggaacctccacacccactccctaacctatgcatgttaaaccatgttgtagataagctcttccctttggggaaccccattgtcttttattctttatattgttcattatgtaaatattcttgatatttctcctccaccagtctgcacaaaggagaagccagaaaatggggtgagaaagggatttgagacatttccttaagcctaaattataattctctcattggaacaggattcatagatctttaatcaaatatgtttatttttctctgttttgaacgttaaaagggcttgttcgcattgggccctcttgtgtgtcatttgtatattttgctcttgactgctcagcataccatttacattaccaggtattggtgatgtgcagtgacttgcttggttgaatttgctatttcatttttttgctccatgtagtggagcagtgattgttaaaattggattttgtggtttactctttcgtcatgacttgtagcaacagtaatttaataggatttaacagtccaaagaatatactttttgtccttttcatttaccagtccacaaaatgactgcttttaggagatattgtttcatttttcaatattccctggcctaggtggtaacaaactaataaaatgcattcatttgctttaccaatcctatcttgacttagaaagttgattactgacatttcccttccttatggtagttaagtgttttccttactcagttcagttcagcagtcacctattgatccattcacacccccatcctcattcttctatcataaagttattatatacctactatgctgggccccctgccaggcacacatagggtctgtcatgcaaacatcaaaaggagccatttaggtatgctatgtgcaattgtaacattttattttttcttatgattcaaatcttagttttgggaggaaaaggccctttaatgatttcttatttaattatcatcagaaaagtgtagttaggcatggaggagggaagaacctacctctgctggcttgatttcaccaaaatcgcctcctataattgggttactatgtgacaggcactgagttaggtataatacaaacataaggaaggcccaacctcagttctcaggaatttatagtctagggagacatagaagcagttttaacccaaagagagaggagctataatattcaaagtatcacaggaggatagcaaacccattacctgtatcttctaagggatgtgagggaaagtttcactgagggaggtttgcttgaacacttaagcatgactagaagtttgcttggtagagtagaagggcagggaattccaagtggaatcagatgtgaagtcactgaggcatgaaggagtatgacatatttgaaatgtatgccaagaaattgctaattactagatgaaagagaactctgtggaattggcattgggaagatatttctggtacaggtataggttgatcatttatgtaacttttgtcatatagctattctgtagcttccattaactattccttacttctcctctcctccagccatttatgtgaagactttttttttttttggaggggaggtgtttaggagtcatatttgtagtttttccttaaaatgaatattaatataaatattaatacaatacagaggtgactaataaacaccaaattaggtatcaggagacctggcttattgttttccacttctctcagcggctatgtcacttgagccaaggcatttaacagctctgtttcttcatgagtaaaatgggaatattaatgcctgcattgcctacctcaggatcaggttgaaaatgaaaatgaaactgttaaaaataaagaggtataataaactcttttacttggaattctgctggctgaggttaaactgacatttaaagcaagtaaaatactttgtggagtatctggatagaaaaattaggttggaaaataattcttacttcctcattaaccctctatgtctgccctttagtctttgaaatgtcatttagcttatttctatgtttccaaactaacatgataaaaattttaaacttcctaatgttctggcatgtatatcttggccctttcaaattctcagtgtaactattaaatagcaattgatttaagagttaggtgagtaaaatataagttggtatatttcgtagtcaatcttgaataattcatacctattaagtagtttgaattactaatgagatactgtctatcatttcttgttccatatggtggtaggacacaagttttgttccattttagaaatgtataagagggtcctgattcattcaattaggattgggaggttatgagactttggccttctgccttctttgccatttttcctaattcagtgacaatgcaggcagcagttattagtagcagcaaatgacatttccattcattttatttcctttgacccccatcttccccattagattgagtggtaatctactgaaatctgataaatcacttgaaacatgaacttctagactataggagcatgagcaattgcttccaatataaatactcctggctaacccttctttagatcagtggttctcaaaatctatcactatggatatttcagcaggacagaaaattctgtaaaccacttaagtcatcctgctctgaaccatcttacatacatcagaagaaagggaaagagtactgctatggatgagataacacaatggtattttacatggaatgtaactgaattatttatactagactagtattgatcctgtcatcataatcactattatatgacacttgtggaattccaagaggtagttacccctcctccctttctgcctttgcaacttagagatgaactagttatgtgaatttggataaaacacctattctaatcaaaatataatataaaatggttgttgagatttttctaccaggccctaaggaaataatctgtcaatttgtctgtttttcacaaaactaaatgaggaaatggtctggcttattttctctttgttttaaaatctatggtgccattgatacccagtttaaaaacattcttctgaaggtgctgttgattaaatcattttaatgtcccccaagtactgcctgtttttgaagattatttggaaaatgtggcacattcaccaactcacattctcctcttattctgtacttgctttttttccttataagttagtggaaaggcaactggtcagttttttcactcaataaaaaagaaggaaggtgtagacagcttttatctgggaatgctttaagtcattgagagaatatttttaagtgttaactactttttgaaattattggcagaatcttttaatccattttaacataaaacagttgactaagatggaaagatttttattgtttacataaaagaaatcaccatggtttttgcatcattgcataaatctaagagattgtgcatacataaaaaggatgagacaaagctgaatgttaagtgccaaaatcaacgaaagcttgcgtacttactgggtatttgacactgagcataatggaatgtggttccacagagagagaatactaaatatttagacccaaggacatgtttctctgatagcttcttatcctaatctcctagctaacattattaaccctttttgaaacacctctttcttacacttagatttcctcctattaaagctcacccttggagattctaaaccttctatacccaagcacctacactcacccactcatctctttctgagatcttcatgaattccttttgtttattatatggatctttgggtgaattatcttggtttactatgagtagtaaagcacaatcacaatttctctccacttacagctctatttttccaaaggtcacagctccatcattcagctcttctgtcggtatccctttctcatcgattccctggaatttttgaaccagggctgtgaggtatacagccagcaatgttgcatagtactttagagttgctgcccaacacaggtccatctctcttcacaattcatgtttgttccttttcaggctcagagtggtgaaggaagttactaagattagcgtgcactatgaagtctgggaggtgggctttcagggacctgcttacttactctgaggctctgacctttgccttagtgtgattttctcaccatcctcttttattttgtgggcaaaggatcaaaaagatttcttcaacattgagtgctaaacattagcaagaatgcgtggtttctggtccctgtaatgaaagaatatttttaaaaccatagactcaaattaccatgtaagatatcacagaagcaaatggaatttgagctggatctggaagaatgggttgagttcaggaaagtggagtttggaagagatttcatgcaagagggacctctggagcaaaggcgagaaagaacaaagaaagcttttgacatagagaactggaagttggtgttatgatttactacagtaaactggaagagtaggttggccggtatgtactgagttcttagtgctaggcttagttacttgattaattatttgattgatctactcattcaacagattgtttctcatagcccacaggataaaatccaaacctgttttctggcgtgcatggtcttctgtgatgtggtttctgcataccttaaaatctactccactcaacactatgtacccacttttcagtaatattgaactcttttcagtcatatcgaagaatttgctgatccctgcaacatgttgtattccttcacatgtttctttctttgcacaggctatttcttctagagttcacttgatgtatgcttcattcttcagcctcagttgcaacggaatttttgttattcctctgctgctgtagaatgctaggcttatattactaaagcttctacaccatattttgtattgtcagaatacatgcctgcttccctcactcagcttatgagcttcctgagggccagggattgtgtctggttcacctttacatccacaccacccaacatagtacctaacatgtagccaattcaataaatacatacttactgtaaaattattcattgatcatttactttacatcatgtgtagttttatttttaaaaagcgatctagatggaatgggattgacaaattgaagacgggcaatgcagggagatgagttatatgtatttttgaagtagctcatttgtttaaaaaaaacagtaggggctagattcctgggagattgataaagaaaaaaagataggacttaatgactggcaactatgggcaagagagagggaagaattaaagataataaaaaataaagataatacaacaaatagcaggatagtgacccttaaaaaaataaggttactttcaggtaagcatgtttttttttctaagttggatttcctggtgttagtatttgtctcactccacctttgctccaaagatgaacactttgttcctgttcagtttaccagaactaagttcaagatatatgtgcttctcattttcatatctggccagcagtttagatatgaaatataaatagttcaactacactgactacaatttcctatcaagggaaggtatgcagtacataggtttttttttttttttttaaatatataaagcctgtttctgcttttgggagctacaactgaagtgttgtaccaggcagatgcactggggtgcgctactatgtagcagagcctagctgtgcatcacagctcttaactttaaaactccagagaatttgatgagagagggatccacaagaacatgacaaatgatgagagttcaaaccttaagagaaaaatgggcttattggtaagagacctttcttttcctttatttactgctgttacttactcattaaaatagcaagcctgttatttccatatgtggctgtgaagcgatatacaaaaatcaattttagatgtattgtagaattcaggagacatattggtaaccatgcaaaaatcataggaagcatgtacaaagcttgattttgaataagatttctaagggaattttattttacttcagactgtgttatagatttatttatatagcttaaatgtaatgcaggtaagaaatatctatatatacatatatttaaaaagttaaaataaagaatagtgacttatgtagaaatacataatttcactcagttgccagaaggtggcataccagatttttttaaatgcacaaagaaaaggaataatattaatagggatataaaataagctgtatttaaagacattttgatgcattttaaagcaaagaaataatataattgttattttttggtagggcttaattgtaaaacatgacagatatgaatttgacctattatagctttttatcattcaacaataatgtttatgtgtatagcattttaaaagtatactttcaaatagtactgtcattaaggagatgctgttttgaatttatcattccaaaaaagaaaaaatattttccacctacttttttcataggaagttattagatttagtatcacattttggataaggtctttgtcaaggtctttctaaagatattattaaactatgactttgatatagttatggatttaataatgcagtagtgcttgtgagatgacccagaaaaaaccaagacagtttattttgaaaaaaagtgagataaggctaatgcttactttctatatgctgataacaacataaatgaaataaatggaaataaatgaaattttatattagagctcatcaaacatttgccagcatactttaattttttaagagagttgactgtcaacagcctatactgtagtgcttctgtagtggtctctatttttaaaactggattcctgaggcagtaccagaagtatgtctatccaatgttgctttttgtattagcccaaaagagctagatgtatgacagaacttaacaaaaaccaaatcttctggttaggagacagtatatctatttatgtgtttttattaattacaagcagtatgaaaataaaaagaattggtagtaaatgaacctagaagaacattagccatctgttctctgaaagcttgtaatatgtgtcatttgctttcaggtttttatggcaaagaagtatatcagcaaagaattgacctttaggcttaaaaagctacaaaatggcaaattattccaaggggcgagtatatatttactggaaaagtgtctccttgtgtccaaatttggctagtttagtcttttagatcaactgccaatcattgttatgcttaatgcccatctttattccagactttctgagacattaagaaagcttctaaaaacaaataggatcttatggctttctagttaagggtttttaaaagttaatttacatagtttaaaattgttatgtgtggttttaactgttcaggatttataaatatggtttattaatttacagctaaaatgctgtcagggtatgctttgaaaaatttgaactaaatataataaaactacaattaaccaggtttctttttgcactccactttcaggagacggaggcaattgtcattaaaacaagccgatttcaaggatatattcaaaaaatcaacttcagggtatgtccaggggtctacatttttcctcacctttttttttttttcagtgcgaattggttttcatgaaagaccctgagaatactagaagacagttatcaagtatagttacagtaatggctagggcactgtgtttattaggaaaaaagtatgtaaatcatgctgttaaaaatgccacgcatcattgtattgtgccttatattttccaacatgctttcacaaacataaattactttggttttcacgacaacactgtgagacgggcaaggaaagcagcattttccctattttacagatgggggaagataacactggaggtcagaaagctaaccagggacacagctgcagttggaccacagatgcctagctctgtctcttctgccttcttcctcatggaaaaagtttgaaacaagtttttaactttttaatctgtattacacaatcaagataatttgttttctaattgttgtacctcacagtttcccacttcgcatctgtctgtctgcctctgtgcctgtctgccagctggagaccttactttcagactctcccagacctagaaggatctggagtgtgggagggcaagataatggatgtacagtttgctatgacaactggtgttgagcagccagtgttcatatgctaaggcaggccagggactgagaaagaagacaatcttactatagctaagagatattcagcaggaattagcaaccttgactttaaagcagtgtttctctaatagtttagtagacctggtgtgataatcagctgtagtacttgttgagaatgcagagtactgggccccaccttcagatatctacattttaaataatcacctcatgtgattcttatgcacactaatgtttgagcacatctgccttaaaggtaaagaacttttcttttggtatatgtattgcagcatagagaaaagaaccacttttctctcagcaacttctgtgttccatgtcaaaccatattaaccagggcagtggggagcaaggggcaagcaagagtgatgaatgacagatattatttgcacacattgctggatgtacatctgaagcatgtcacaatagctactgttcattgtggtgactttgacgtattttataaaggtttgtgtctattttagacatgaggggcagaaagatttctgccaaaaggtgaaaaataagtgagttttgatattttaataacatctcccagttgtttttattgtaaagtaatttaaaaaactgtatagaaaactaggctattcagggttctggtagttaagggtttactgtaacaatgtatttacactaatttgtgtttcctatgtgtatatctagtctgcctgattagattataatggtcttgtggccagggaacatgtgttcttttgtgtatttgtaacatctagcaaagtcataagttattgatacttattgatgactgaaataactcactgagcatgtatctcctttctaggggttttgggctaggcagagtaagttgattgatttcatttgtgaagttaaaggagacaatcttacactgtcagtaatggttaatatactaagaagttttcagttgaaataactgtattttagttgacagatgtgaaagtgtggtcctaattaataaatgtgctttttccctgtttagagtatccattcaagctcgatcttgcctcttcaccctttttggaatacatgttatgttgttctgtgctttacaaatctgaatctgaaaaattgatatttctagaaacccctaaacataaatatttttgtttaatttctgaacagtatcatagaaatttaaacaaatgcctagaccctgtagtggaagattcataaaaatgctcaagtgtctctgacttaaatcaagctgaataaggaaataaggaatgaatgaataaatgtatgctagctaaagggaaaatgtagcttcagaattctatgagaagtaactgattatttaaaacatatatttgattttgaagacatgaagtggttctgaacttattagttgaagtagacagacatagaaaggaagtcaagaaacccagatttagattacctctagcttaaatctagattcaacctagaagatgaattctgtttttattcaaaatggaattactttggttagtagtagaccatgagataaaggaaaagaaatgatttccctttcattggatagccattgcatccaaataataaagctaaacctaatgccaaaacaagctgtgattattttacaacacatgaacacttgatgtggcatgtgctaatgatgttgtacatcataggattttaattgaatttctgtttgcaggcacagcaattttaaattacatacttttcagctagagtctacaatttagacctatgaccatacacttggcatctttcagtataactgtctctgtactctttagctgtttgtagaatttaaaatcgctaaagagaagaattctaaattggaaaacgaaaaggatctggaaatagtcatgaaaatagaagtattgaccaggttgctaagtctcttggatagtggcatagtgggcaaataacattaccataaggacatctttaagaaaactgttgggtttcatattatggcaatgggtcacaaggttcaagtttgaaattgagccttttttgaagtgtaagattttctcattcattatttggtcaaaaccttttatttttagatgacagtagtttctgtgggcatatgtatatgaaattcagttttaatgattaaacctaggaaatggtaaaagttaaagcaattgaatataaatggctctttctcatagaaaatttaaatagtgttaaatagtcttaattagtcattaggattagctttctgtgaaagtgctgctggttagcaaaatgttattttgattactctataagtatttttaaccaatatttataaataggaagaggaagagattggataaccaggtgatcttctaacctcatttttggttataacatttatgatgcacatgtgaatgttgtaataactttttggatgtaaatatacatttttcaaggtagtagtactatttcattaatttaaaattgggatgttgaagaaaatatactcttctaaagatctttcagaaattcagacttttagaaaagtataggtatttctgaaataatatagaatatggcaaatgttgaatttctgtaactggcatgtcttttgagatttggtatgtgatatgcttattactgaaaaaattttcaaccatcataaataaacattattagaagttgtttattcttaccaaaatagtgcaggatttacaaatataaagatttcagtattccttacattgtcttcatgccactttggcagtcttgcttctatatttgatgctaccaaaattaaaaaaaataagtgaaactatttggaaagcttcatatgaatgtattttcattcaatagagccatattcttaactgttcagttgcactgtacattttaagtggctttttattttgataagttcacagattcaatcagaaaagctaacaatagcttgactattttatttactcaaagtagtttaaggagatacttaggaagttgctgagagatgactaaacaggtgagtgatcactatttcaggtgatagagatttttttattggaatatttattttatttaagaaagtatatatatattctggatgatttccttcaatatatgcttatttttaataagatagtatgtttctacatattttttcattttaaggagattatagcctaaaattatcaaattaacagataaatatccctcttgacctctgcttttggtaatagcaggtttaacaacagtgttttaaaaatctttcaggatatattctggcttcaatatataattctgattttcactcctctgtttataaatttccctttcaatttactcaacaaatacttattgagtgctttccaacgggccaggaatggtgctagattaggaagatacaaagatttagggattccttcttgaaggacacataggaatttgggaaagacatcttgggcagatgaagtaaaatagctatagcacagggtgtggtaatagcatggcctctttttggagcattggatatgttacccctactgatgatgataaatcgtctctctgtattgctcttaccaaacaatttaaaaatggtaatctaaaatcacatatgtaaatagtacatagtatatatacttaaaaactattgatttgccaggtgcagtggctcacgcctgtaatcccagcaatttgggaggtcgaggcaggctgatcacctgaggccaggagttcaagaccagcctggccaacgtggtaaaaacccatctctattaaaaatacaaaaaattagccgggcgtggtggcgcatgcctgtaatcccagctctttgggaggctgaggcaggagaattgcttgaacctgggaggcggaagttgccgtgagccaagatcgtggcactgcactccagcctgggctacagaatgagactctgtctcaaaaataaaaaaaataaaataaaataaaaaccattgatttccactaccacaaccccaagcatacacaaacatcctggtttggagtttaaagcatttttttttttaaacagatgggaatactttgaagcatacacgggtagaaaaaaaaaaaaaaagaaaagccataaagagtatagatagtgccagaaaacaaaatgaagaaggaagggcaagaacttctgaatttcccattcagtgttactcctttttacagccttagtgaaggagtaaagttagtcataatctgtggatcatcgggtccccaacaactggatctttgttctctgctcagtctctctgtatttttgcccactcatcccagctcctatcttagccccataacctctttcatctgacacccaactataaaaagtattatgtaaatatcaggaattactaccactctggctttcctttccccttacagccagccattaccttcctcacccctattgtcttctcctttggatccattacctagtgttcctgccttttcaacacactagcatctcttattgctgttttttctctgcccaacatggcacccttcttatcttaaggaaatgttacagataggaagaattactgcccttcacattgcttatgccatcatggtgtgaggaattctctacgcatatacatgagtgtgtgcctgcataacattgtttgtattgtttgatgattttgactaatttatatttcttgatacctttgatataaatccaaggcatagtcatagctacaaaagggaatgtctttgtagattctttgttggcctactaggtttcacacagttctgttaaagaaatttctaatgtaaaactttccaatgtagttgtctttgagaaacatctgggattttccattttttattgtggcaagactacatatctgagtatctagtaagaaattttaaatgtatctgatagtttcctgaaacaaataaaggagacacacatgcacgaatatatagtcatatatgtgtttaagagatacacacaaacacacatgcatgtaagtgtataagtgtacatagccatgaatgtgaacaattttatttcctgtaagaaggaacccttaatgtatcaagaattttgctttgctgtccagaattttgtgtgtgttttaaagggtttaaccgtcctatttggttgctatccaagtacttttactgattggtggaacataaacaaagcacacaatttggcatgatctgcagtcttgtctaagcattgtgaataacatggatattttagattaatctgaagagacatttcagaactgaaaagattacacagtgcctgttcatacaaactctggctagggctattagtctttagctgtacctaccacaggattaaccaaaacttgcatgaaaaagtagataatttcttaggggacatcaggaaaaaaatggagcaagagattagaaacatgatatattagttcatttggtgaggtggtactggtgacaaactatactagtcagttagcaaattaagttttactataaaattatttaggaacatatgcattgagaaaaaaaatcagagtattggcaatatatttacgttttctcttatactgtgactgcttaaattatattttcttcctgaacattcttaaacatcttctggaattaagattttggaaatggttcttcatgcacagcttttcttttatggtgtttttctcccacttctatttttcagtgaacatataattggaggagttgatatctctttgtaatcctgtttctttagaatacattgagacatttatagagtgtggttcacttcaaatagaaacatgcatcttgtggaatggtctcattgggaagaacagtagggattctacaagagtcctatactaggagattgaaatttggtttctagtttctcttttgctgctagcttgtgatacaacattgggcaagttagcttctctgggtttcagtgttttcgtttatacaatgagggtactgagaaaaatgaattcttagagtcctaaaatttcaacaaatcttctccttttacattctaagagttggctctttttgtagccttggccaagacccatcattgtcctttgtttgttacgtctctgaactgtgcatttcacaggtattttttaactgattagttaatgttcataaaatgcgtcgaagagcttttatgtatgttgtctttctctcctgttttatgcaattgtacataatagaagccaagtgttctgtaatcaaaataagtgtttcctacgatgtgaccaagggttttttgacatttgctattctaaatattaaagtagtgggacactgagcctgcataaaattatatttaaaatatatgttgaatcatttttgttcattccataggtgaacatatttttagttctagaatgtaatgggaattataattacactccatagttatgactggattctccaccagggtagtaacatctgatttgtttggatgctgccaacttgtaattaggatgattttacctggctgaagtttatttctaaataatatgtgaggaatagtgttgttaagtgaattaatagtgtaaagtgttgttcatgaactgtatttctgattaaagggattatttttaaggactttggcataatagttgtttgctcatgagaggtaattataagtgacttaataatttattaaaggaaaagtaagaactgaatatatatacatctccaccatcagatataatgcttttagggttttaggtgttttagagtgctgaggatggggtgtagggaggcagccttactttcttttcatgctgaacaaatattaaaattattggggtaccacaaaaacaaatattaaatattaagtctgcaaggaatctagactgaaaaattgacctggaagattcatggtattagatagcttctttggagcccaatgaaattcgacaaaagtatgttgttttttttgaatcagttgattgtttatagaagaataataacttatagaaggatattcttatagaagaataataatctttacaataaaatgatcttcacttgtttgtggtggttccctttttgggaatttggaaaactctaccttaacttgcctgttttccactcatcaatgtttgagaagtcttcatagacagataaactcctggaaacacttcactaccatgttttttacacaggtttttggatcttcattctcagaaggtgaagtagaccaggcacggtggctcacgcctttaatcccagcactttgggaggccaagtcgggtggatcacctgaggtcaagagttcgagaccagcctgaccagtatggtgaaaccttgtctctactgaaaatacaaaaattagccaggcatggtggcaggtgcatgtaatcccagctactcaagaggctgaggcaggagaattgctgcaacctgaaaggcagaggttgcagtgagcctggattgtgccaccgcactccagcctaggtgacagagggagactccatctcaaaaaagcaaacaaacaaaaagattcataagctggaaaatgattgagtctcttttctaaaacatcacctccttactacataatatatagctgctttatgttttatatttttaaatgtttgcaaatgcttcgggttttgaaaatttgtttgaaactcactgtggaataagacatttcaaacttgatgtgttcatacatgtgtgtggctgtgtgtgtgtgtgtgtgtgtgtgtatgtatttctccttctttggatttcaaacaagttgcccctgctgattatacctgaggcctttttgctatataaccattaaggattattgcagaaagccttctaatgtaaaatattgactataatttatgtgtattaatggcaggttaaaaaaaacttttaaatatattttggccactagcgcattgataaatattcctttctctgactcatttgacaatttctgtgagtctgttttgtgtgcaagtactaaaaggagttggatatgtaatttaaccctttaaaatgcttgactgggtttttgggggctgtttcttttgtatgataggttgaataaaaattgtatgtaaggtaatgatggctgacataattttaatatttacaaagttcatatattacttgtcaatctttcaaaataagctttctctttccatatatgtatgtatgtgtatatgtacatactgcatgtacatatatgttttgtgcttcacaggaaaatagtagtttgtctttttgccttgatattggtctgtatcttaaaaggaaggcatttgtgattatgttagttgatttcatgctgtatttcttatatactaaatttggtattttggaatttttgaaaatagttccttactgtagaaacattcatgtgtgtttctaaaatacagatgaaaaagcctcttaggggactaaatctcaatctttaaaaactaggaataatttggaaagaatattcgaacgctaactatttaagttggaagcatgagtttattgtttggatacagacttgaaagtaaatatgagctttgttcctgcagtgattttttaaaaataggtagttgctttcatgtcaatcatgatctgcctttactaagcttgcattgatggaaatggataattctgtttttaggtagaagcagaagggtactatgattgtgaattgcctatatcagaagtaaaattcttcagcctgtaaataaacagttcagcataatactcatttaacctatattcactttttagaattgtgtagaaaatttgtgagtttgttttggtgctttaaacagaagcttaaaagtcactttcagggcatttacaacgctattttctggcagtattttgaaacaatatagatgagccctttatttgccattgctttcatgaaatacctcaagctgcctttgacagcagcttcaatttttgaacctccttgacaatcgctaatccctataggttaccggacccgctgttgagctttggagtggtccctgctggacacctgcttggccagcagtgttggtctttcctctaggcaatttgtgagctgtctgcgggggagggaggggaggagtggggggggtggtgaacaagaggggaaaggggagagaaggggagggcagtattgaattagattgttgatagcgtccctctgaggactgctattaagagcatgctactctgtacttcgctgctgcagaagagagagtgatatttgtgttactacagcatgttgtaaatgtgtgagattttgctcatctcagcttggaaataagaatagggaaaggagagcaacttgaatcagaagctactagaagaacctgcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtaggtatgttgttgtttcattttcatatgaaacccatctatgttttttcttgctactattggtcagaaatcaggttaataggtgcagaatatagtacagtgctgcagtatccctgttaaggtagaacaatggtattgcaagcttaaaaaaaaaaagcctggctgcttttattaaataaagctgcattgtatggtatgcacagtgcagtcctaaaaaaatatactgcagtcaacgcttttctggcactattgttgagttggaatgattgaatcatcatattgctttaggggacagaagaatttaaggaggtaccttacagccctattttacagattggaagcatcggtttaagggcactggcagaatcctttgcttgttctccgcggcagccactgctgtgtcagtacagtgtggaatggaagtcttagttggtagtctgttatggaaacgctctttactgttattgtagtaccgtggtgacaacatgccattgaaatggaaaacgagctctcctgctatctggaaattcccagttcctgtgcttaaaacatccaggtcaactccactttctccagcatacatgtaagtgagagaaaataggatattaaagtgggatttcattcatgaatctaccttgtggcaaaatgggggcgggggagcccccaaacagcaacatccaaaaacctacaggattaaaaacctcaagcttgcttacatttaaagatgttggcatgcccacacttcatcattgttttgtttttctaaagtttatgtttatttaaagtgtttaatggtaatctaattaccagtgtgaaagtacaaaggcatacctaaggaattgcaaaagaattaactttaatatttaacatatgttggatttgtttgaatttttgaatatctaaaacacttaggatgacttcttttgtgtaatggcattaaaaattgatgattgatggtggtgtgttaaatatggtaatgcctctttactattttttcatgaattaaaaacagagttaacattgatcagaaaatgagtcttttaattgagacttttatactttagttgtgtatgaatattaatatgtttgatagtacatctttctcagttttatcattcaagttctgaagtgtaagtttgaatttgtgcaaattatatctctatgagcagttatattatggggattgaaaaagtattctacaaatgtctgttttaaaaatgtattttaagtaaatacgtactgaagtgcactgggaagtctttctagaagttttcaaaatttttgaaaatctttttaaatttgcagtgttgctttaaaggcaaaatccaggagatataataaaatgttcttttaaagtattgttcatgatcctttttggtggaggaaaaccgaatctttttttaaagaaaatattagtacgagaaaagcttttgaaaagaatgttttaaatttgagtgttatttttaaaatatttatcagtaggaaaaatgtggaaaacttctcctgccttagtttaattgtgtatttagagctgtggtgagttgccattttttaacttagtttttgttttatgtgaggtagagatgcacaattatatctatctctttctttgaaaccctttcagatgctgaggaagtgtggttatgctctcagtccaaaagaagcaattccctggaaagtgttgaaaaatgaggccatttcagagttaaatcctgtggtcattttattttcagattttttaatgctcctttccgtttatgctccaggatatttttatctctttgggtgttaaactttatgaagtaaaaaaaaaaataggctagtttgtaaaaataaaccagctatatttgtttttcaaaaactgtttgtcaaaagcacaaattaatggaggtgacaagttaatggaggtgagaagttaatggagctctttcacataattcgagaaaataggatgcttcctgactttatgcatcttaactggcaagaaatgactaaagatttaccaaaagcaactttattataaaaacaaaacaaaacaaaacctcactaaaatcaggttacaattataatggttattaatgtttctaatattcctactatatttgattgtctaaaagatccaaattgcagcccttattgcccctgatttgtcgatttttagagatggtgaaataaatccccatgttttattaaattcatgccagccacaagctcagatacaactcaacacaacattttaaattaatcactttcttccttttaagtgcttacctctttgacctgatgatatgagtgaatcaatttagaagatagaacctacaaaatataatagatcttgcatgttgactgttggttgttggtagtacacataggtagaatggaaaaatatattcaaagagcttatggtaggctgaagtattttgacattgtaacagactattttgacattacaacactctatattattgaattggtcttaacttatttttctttttatgtatattaatacttaatagtaagtaaatatgcacagatagaaatttatgtgaaatgtagcaagactagcttggggagtttaaatcaggtttttaaatatgttgtttagtttttgaccattttagatcacagttcattgcctcacttggccaaaaataaaaacatcatgtttaacatgtttttctcatcagtacttctctatattcctcaacacatttacacacaaaatgatacttaagtatagcataattccacttcaaaaatgataaagactgaattagattactgggtcaagtaacattatatttgttctcacaattgtttggctggcaaacataggtttaaatggttacttgtgtcttttgggtctaaactctttgcactgaaatagaattgttcaattctgactcctcaataaatcgtgatatataggaaatttacctgtaaaataatgtataagtatttaaagtagtattttgaatatagaattcttcataggtgatataagatctttttgtacgtatgcttgtgtagcatcagtattggtttgtaatgttttatcattacttaccgtgctttgtcaaatatacattacgtggttttcattgaagacttgagtactttgtcaaagactgaaatttcaatatgaagtattttaggtagtagtaaaaatgtgttatagtgattgagcatgtgtgggaaaaatctaaacgctccatggtctctttctaaacccagtgtatgtgctgctttgctgtagctcttccattgatgctacagatagggcagtactgctgtgctagtgaaggctacaatagagaacattttacttactgcaaacatcgagcagcaagactattacttttttccttgtgggtttaaagtccatgtttgttttctttctgtttgtttagaacttgaatgacagttgaaatgtcccaacatttttaagttttctttatgatgaagactatagtatttgtggcaatattagtagaaatagcatcttatatagtataaagcacttaaaaaattttgctgtaatgtcatactagaaaagtgggatatcttaaatacgaaagattcaggaaaataatacttcagtctctagattgattgatgatcaaatagtctttattgggtagacatattctttcagctttagattttagcattgcagggtggtgtgccatctatgtggatttctgaagggattgtcttgatagaaatagagtgcttggtgacatgtgtttgctttgcactctgttcaacagtaggttgaagttcaaccttagcctgagggaggatctcctggccagtgtaaactgcattagtaaagactctgcccctgacaggtgcaaaccatataaattactctgtcatttagcctaaattaataaagctgaaagagcaatcacatctaagtgtttttatggtgtttaggtattcattgttttaaaacagcaaatggttccttcaggcaaatattatagggttaatgccttgttagatgctaaggacacactgaaatagaacaaaattagcactagtgatcctttcatcttttcttttccagcagcgagttttgacaataatagtgtggcaaggaggaaggcaattaggtaagaattaaccagtgaaatataacagtgaattctagcaagacagaccctgtgagttgttttccttagaatgttacctttctcaatctaaaagacaatgaatgttagtgaactagacttgttctcctttagtccctgcacttacattcagttagcttcctatttatgattttttgatatgtaaaaaatatttttatagtaaatgccaaaaaacacaacattctatagcaattgcctctgtaatgtcttcaataaaattcagtacctggcatttcctgagaaaatattgtgtatattgtataaatgctccttgtttgtaggtgattcacagcacagacataataaaaatatgaattttctaaatttgacatgtttctatcccctaagattgtcttttttttctaatttagtaaataaaagaaaactttgtggttacagaaatctttcttatctagcaaaatacttattaaattgataatcatttgtgattagagaaatctttcttttctagcaaaatacttattaaattgataatctcaaaatagaaaagaatgtttagttgctttgagaacataaacttttacttgctttgtgtctacttaattttgtttttattacttatgcacaatttaacaaaattatgtggaaaaataacacaactaacacctaagataaattttgtgttagtctgcaacttttgtggcatgttctttgggaatttgcattgtctgagcttgcagaaggactaggttgtcatttattaatggaaaatcatagagatagaagtgaccttaaaagtcatttagaaagtccaaaccccttttaacacaggaactcattccatgacacctctcgaagatggcattgcatgtccttcttgaacactgtcactgacaaagggctcactacctcaccaaggctgcaccctccattcatggacagcttttccttgcattgagcaaaatcagttccttgtatcttttctctcccgttcccaatgcagccttatagagctatatagaaaaaaaaaaattctattacatacacgcttaggcgtcttctcatgtgacatggttttcagacccttcactcttcctggttgtcctcacgtggatggttttttcatgttaatctttatgtaagacactacatttgaatgtgatgctccacatggggcccaaatagaagacaattctcttcctttaagcagaatctctgcttgtcttaaagggcctgagattatattattttttttaattataggattcacactgtcccctagtgaatttacagtttgcaaattgcctttttgaaggccttacaatcagattgcttgctcctcactgtctgtgtttattcttttagcttcttcagatcttttagtctgaggaagcctggcatgtgcaaatgaagttaacattttgttttaaagcctattgtgtattttttaaaaagacctcttgaaatcatttaatataacagaaaaatattgcacacaagacacttgcaagacaaagagctagtgttcctgtcactttcagatatttcaaagacattcactggtcaataatttatctagattcctttttttatacttagtgtatcttccaagtaatcgcttcccccattgcaaagaaaccactttctacagagggaagagaggcagaatttcatatctccataccatcatgggaagtacggagttactgagaatttcatacattctgcttgaaacttagaatatttagttgagacttaagtatggccaaacttggggagacggagcgatgagaaagaagtatgggataggcaagtatttgtgctaataacttgcagttgaagagttaagaattacaaacaacatacatgataaaattttagattgacatggctgccatgatgtattgctttatatcctcaagactttgagaaaggcggtataaacatgagattcttggggaatcagtacataaataagttactgagtaattcattttagaaaatgctcagttctggatattagccctttgtcagatgagtagattgcaaaaattttctcccattctgtaggtagcctgttcactctgatggtagtttcttttgctgtgcagaagctcttgagtttaattagatcccatttgtcaattttgtcttttgttgccattgcttttggtgtttcagacatgaagtctttgcccatgcctatgtcctgaatggtattgcctaggttttcttcaagggattttatggttttaggtctaacatttaagtcttcaatccatcttgaattaatttttgtataaggtgtaaggaagggatccagtttcagctttctccatatggctagccagttttcccagcaccatttattaaatagggaatcctttccccattgcttgtttttctccggtttgtcaaagatcagatagctgtagatatgtggcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggcaatgtgggctcctttttggttccatatgaactttaaagtagttttttcccattctgtgaagaaggtcatcggtagcttgatggggatggcattgaatctataaattatgttgggcagtatggccattttcatgatattgattcttcctacccatgcgcatggaatgttcttccatttgtttgtatcctcttttatttccttgagcagtggtttgtagttctccttgaagaggtccttcacatcccttgtaagttggattcctaggtattttattctctttgaagcaattgtgaatgggagttccctcatgatttggctgtctgttttctgttattggtgtataagaatgcttgtgatttttgcacattgattttgtatcctgagactttgctgaagttaggaggagactttgctgaaggagattttgggctgagacaatggggttttctagatatacaatcatgttgtctgcaaacagggacaatttgacttcctcttttcctaattgaataccctttatttccttctcctacctgattgccctggccagaacttccaacactatgttgaataggagtggtgagagagggcatccctgtcttgtgccagttttcaaagggaatgcttccagtttttgttcattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgttgttagttctgtttatatgctggattatgtttattgatttgcatatgttgaaccagccttgcatcccagggatgaagcccacttgatcatggtggataagctttttgatgtgctgctggattccgtttgccagtattttattgaggatttttgcattgacgttcatcagggatattggtctaaaattctctttttctgttgtgtctctgccggactttggtatcaggatgatgctggcctcatcaaatgagttagggaggattccctctttgtttattgattggaatagtttcagaaagaatggtaccagctcctccttgtacctctggtagaatttcaaacaaatttacaacaaaaaaacaaccccatcaacaagtgggcgaaggatattaacagacacttctcaaaagaagacatttatgcagccaaaagacacatgaaaaaatgctcatcatcactggccatcagagaaatgcaaatcaaaaccacaatgagatactgtctcacaccacttagaatggcgatcattaaaaagtcaggaaacaacaggtgctggagagcatgtggagaaataggaacacttttacactgttggtgggactgtaaactagttcaaccattgtggaagtcagtgtggccattcctcagggatctagaactagaaataccatttgacccacccatcccattactgggtatatacccaaaggattataatttatgctgctataaagacacatgcacatgtatgtttattgcggcattattcacaatagcaaagacttgaaaccaacccaaatgtccatcaatgatagaccggattaagaaaatgtggcacatatacaccatggaatactatgcagccataaaaaatgatgagttcatgtcctttgtagggacatggatgaagctggaaaccatcattctcagcaaactatcacaaggaccaaaaaccaaacactgcatgttctcactcacaggtgggaattgaacaatgagaacacttggacacaggaaggcgaacatcacactctggggactgttatggggtgggggaaggggggatggatagcattaggagatatgcctaatgttaaatgacgagttaatgggtgcagcacaccaacatggcacatgtatacatatgtaacaaagctgcacgttgtgcacatgtaccctaaaactttaataaaaaaaagaaagtgctcagttctttttcaatcaccttgtatattaagtttataacattcagcagttactcaactgtctattatgtgccaggcataactctgctgaggattaggggcatagtccttgtgatcattcaaagtgattattttttatcttccatactatcttcattcataagcaattaaatagcttaatttattctcctgctgtgaaaatttggaaccaagacaaacaggttaaataaattcttgcttactgtactttcaatattgataatggatttaagggcaatggaaacacctcagaagaaaaatttgtctggactaaatgaggagacttgaactggaggtagataacacatgttaaagtgcatattgcacaggatggaaaatgaagcaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaaatgaagcaatttatgtttaaagttcatagtgtctttttaaacaacaagaatggaatactattctttacattggacagggaataatttactgtttgtgtgctttatagcacacaagtttacatatattaccttccaagcagtaataatttgatctcaaactctaagattgaatcttagtttaaaataaaattatattgtgttttcaattatactaaaatatttttcccagcataacttactatgatgaggttatctgttgtttttacccatttcccccccacatttatgtcatgctaaggcaagaacatgcccagtttgttggagaggatttcttataatatagttcaatggagtaatgaagtaacttatcttcaataacaaaaaaataaaaacaagtttcagaactttagattaaattttaatctagcatgtataacagatattctaaacttcatgagacatattccaaatttttaaaatgtcctagtttagcatagttaaatgtaatacaatttattttcctctattatagaagtgctaagcacttaatttcattcctcccaaaaagccctgtaagtgtacatcctctcactattttacgaataaggacacaagttcagagaggttaattgcttaatgttacacatcaaattacaagttgagccaaaattcagatttagggccacgtgatttcaaagcttgtaatttctccaatgccttttcatttttatagacttttgctactttcatgccatctattaattatataataccttactagggttagaagaaaagggaaatatggtagatgggaaaagctttttgaattgggtggtggtataggaagaggttagaaagctttacttgcttactgtcaagtggtgaagttgaaggaaaatattgaggcaattatctttacttgctcatatgatatcgggattaactccattgtctcttgatgtttccatagttccttgaagcactattccatcttcattgattacacacatttcccacccatggtaattagctgccacggacagtgctgtagctggtgtactctttttagcacgttccaagggttctaccccagtcagtatatttagtactttcctgcagacattatcctcccactgcttaattgcatgcaaatactcaatgaaaaaaaaaaacccaaacctctatgtatttcttttctattgctgccatatcaaattactgcaaacgaatggcctaaaatgtcacacatttattatcctacagttttttttttttgagatggggatctcactgtgtcgcccaggctggagtacagtggcatgatcatggctccctgcagcctcgaccaccggactcaagtgatcctcctgcctcagcctcctcagtaactgggactacaggcacgcatcaccacacccagcttattattattattattattatttgtagagatgaggtctcgctgtgttaccaggctggtctcaaactcctgggctcaagctatcctcccgtctcagcctcccaaagtactgggattacaggcatgagccaccatgcttggcatattatcttacagttttttcagatcagaaatttggtactggtctcacggggctaaaataaaaatgtcagcaaggctgaggctctaggggagaatctgtttcctgctcattcctgtcattgacaaaattccgttctttgtggctgtaggaccaaggttcctatcatcttgttggctataagttaaaggacaatttcagcttctagagattgcttgcattccagccccattcctccctcgttaaggccagcgacagcaggttgaatccttttcacattgccttctggctcactcttctgccttcctcttccattttttcaggactcatgtaattagattaggctacctggataaaacaagacacgccccatttcaaagttcgtaacctttatcacattttcaaagtctcctttgccatgtaacaacatatccacagattcctggggttaagatgtggacatctttaggaggtcatttgttgtatctacaatactctagttgaacacaatcatgttgggcttacacatgcgttgtagaaagtgttccaattaacccaagtggttctacaaattttgcattcctgtaactaaaccatatttattaatctctggatcagtagttttgttcttgaaaattataatagtttaaacattacataggcagttctcagcccttgcaacaatgatttcctggaaatcttattaaaaagtggaattatccagtaacagaactataatctggggttgtgttgaaaatatcatgaaaacaagtttctcctattagagcttttattgtgctctacattttataaaataggcacaattgttttgattacatcgattttgcaagcatatacaatcatataaaatacagatatgagtgaaattgaagatgctagttatttaaaaactattttttttgaaaattcagtctattttgagatggttcacatagcccaagtctcttattaaaagttaatagtaatagtgctaccttttgaataaaatcatgaaattagttttcttaataaaatttgatgcaacaagcggaatcattcagaataactccactgttatcagagccatttaaaaagtactaaagtgtgtgcatagtacaagttggctgatgctgattgcattttattgcattgaaaaaaatttcaaaggactctacatttctaccttcccaaaacattttcagtttattcaaaagactgttcaaaatcagattgaacataaaggctaccagaaaataatagttaacaaccagaaggtctttgcatgtctctggaaattcaaataatacaggttgttgagaaccttaaaaatcttcaaaacatagtactgaattagctagcagtggcatatgattatgtggttgttgctaatgcactttagtgtttggtgtttggcaggtgcagggggcaaatattgaaattttgagtgtcaggtaacatctactgagtgaaataagaacagttaaataacaggtgaggactgtctatgctactcagtcattgaccattatgtttgattcttcagcaagttatggcctcagaagtggcatttctaaacttggaggtgcatccaggaaagttctgatctcagatctggttaccaaactttctagacattgtctggctcctattatggcaggtgcaggggcttgatggtattttaatttattatttttactttttttttgtagagacaggatattgctatgtttccaagactggtcgtgaactcctagcctcaagctatccccctgcccccaacctgtgccccgcaaagtgctgggattacagacatgagccaccacacttggccttctgatggtattttaaatttaaaaggtttagattgaaaatattgtgttttagagcactaaaatttagagaaccaaatattatgagaatgatgaattggagtggcaagctcagttgagtgtatgtgggcaattgggcttaatttgtgcttatgcgatccctctgtacctaactgcactcccttcttgcttcccacatttaagtctctcaccgcagctgtttctaaaagttctaaatgaacttgcttaatcatttacaagttgccctgtaacatcttttattttcacttttttttctggtttcaaaaatatagagcttttcactgatcaatgagataagaccttgacatcatataatgtgcataattatcttaatcagggttctttcaatccacaagctgataggaaccttagaaatcactcttttggtcataccatttaccttgaaagagaatgtgatattaatgcttgatcacttttcctccatctgtgtacatttgtatttgatgatttaacccagtcttaatttatatttccttttaaaaataccatttcttcaactgcattaaaattaatattaaagaccagctctacaaaatcttaactaggtttctctttattaaatgtgattatatcagagctcttctcttgtctgacagtgaaacatgttcttaattaatagtctgatctagctttagtttgggtggacctacaaaatatttgaaatacaattttgaaaagtatatggatgacactaaattgtgaatcattgtccaatagataaccccttagcatcaccaaattgaagtgattttctcattcgttacgatcactttcctacagagggtgcgtgcatgcagtcatttctgaatgattcacagctaaacaaagttcgtgaaactggaaacaaaggtttggttttaagtagactggagacttggttcattaatatacttttcatagaaatgttgctgaagcatatagatagatacaattagagtgttttttttaaatgatgtgcagtactatcacatcatcaagagttttgactttcttccatataattaaaattgcagattatgtttttgaatagtgaatattgtgtgattgctgatccagccctgcagatagcctgatctggaacaaataaccctttaaaataatagtaaggaaagttgatattatttatttatttttatttggtgcttatatgctaaatatgaactgatacccttatggattagagaaaaaagttggcaatcgttttgttattgtggtttctatgaattatacaacatgatatttgttagtaaagagtggtaagcatttattataattttatatcatttaattatttggaaagtaattgttttttattatcatctcttagcaagcaagtatcctgactgctctttgttttattatcatctctttgcaagcaagtatcctgactgctctttgttttcctatcatctagtgtggtgcctggcacatagcagatgctcaataaatgtcgattttataaatgaatttagagaatagtttttaggtctgtacctctgtgcagatcacttcacatgaaagtgttaagtttattcatctgatatatgcagtaattgaatatagtagttgtcccttatgcatgatttccaactccttggaatgagttacccatggttaaccatggcatgaaaataggtgagtacagtatgataagatattttgagaaagagagagagaaaaagagcacattcacataacttttattaaagtatattgttataattgttctatttattactagttattgttgatatcttactgtacctaatttataaatcaggtagttatgtatgtataggaataaaacgtagtgtatatggaatttggtatatccatagtttcaaacatccactgggggtcttggaatgtatccaccgaataatgggggctattgtgtatcatggtcttgttagagaataagttatgactgtatttcctatgaaaagaactaatcaaaaatccagattctgttcattgttgctgagaaataccatgatactggcacagactgaaagtaattttactagaagcaatctactagtgaccaaaatactttagtcatggttcatcaaattgtaactgataaggaaaataaggtttttttaaaaatctgttctacgatagaaactactctcaaagttaagagttatttgacttatttttgcatgctgttcatcataatggagaaaactatttgagatatttatgttttgaagctaatatgcttttacttaaatgataatgtgttttgtgtgtatagtttgataaaagaaatcactgactaggagaaaaagaagacctgactagggtttaggagaaataaattaaaaattaacactcaaaaaagtatttacatttatgtcctgaattttttatacttaaagggcttcaatctaaccataaaggtttagctgatattatatttaaattaaatgaattttctttgtgttaaaaatgattaaatacaatggcttttacacattacttgtttagcaagagacaaaaaatgcatagctgtgaatatgtaaaagcaatatattccaaagcaaaacaatttgtagtttgtaagtaaatttggattttcgtttgttctgttgtcattaaacaaacatttattgtgaataatttgctggactgtgcaattagttaaggagggtgaggccaggaagccttgacttcaagagtgtaggatttggcttctgttcggcaagcagtgactcactgaatacctttgagcaagggagtgcttttctgagctataaatacaatcacagtatgtataaagaccattatgtatgtgaaaattataattaaatccaggtaagaggtaatacagacaagaactgtggtagaggcagtgagagtggatgggggttgaaggataggagcattctagagagagattcagttgaacttagcagttgattggacatgggaaatggggaagaagcaagggtcaaaggtggtcaaataattttggtgagagcaattgccttttagaatccaaatattttatctatagttcttttgaatgtataatatcaggatacatcggagatttctgaaatttcttctgactgaccaacattttaggaatggtcattaagaaatatgtatgtagtcaaattcattaccattaagcatatctttgacatatgaaaagattggattttgaagatgtaaaaatgatgattgcttcaacaagtatctcatggagatggagtgagtgagggtagtagcattttccgactagctagggaaacttttaacaccttgactccctgctactctcatctacatggtgactcttctccccttttgtctgcttctcatctacactgagagtcagaaattatagtttggggtgtgaaacactggtttaaaggactgtataaaaggaaggaaaggaatacttctcttttttcatttatctcacacagattaaggtaagtacttcattactacttcataattcatagattgcttctgcaaaacacatgtacacacaatctgaaaacgctccagttatcttcaatttaaaattcccatttaaatgaccaggagatttgaatgcttgatgcctactatgtcatttttatcacaatggtatgttctacccaagaacacatagccttcttttagccagagaacatggtgtttctacaaataaacatcttacccctaaagagacaaattccttgatgatttataatttggaatagcccctccccaaatcatcagtctgccttccagaaaaacattataaattttgtaaataatttttaatattttaggtaatgatgtatagttgtgacacataaatattttgcccaaatgaatccttctttagaattactgcaccatggataaacacttatggtagttttggtagagcaatttttgttattcacattagcagagttgtctgtggctagatactgaaattgctctgtgatatggactggaatattatggtgatcttaattaaactggctttctaggagtgtagtaaaatggtggaccctaaaacattttaggtgaaaaaccaggaaccagttctagagctaaagaccacatatatactcttggagtatggtaactgtgaatatgtagataggtgagtgggctgtaagtaacagtgaagactttttgcatctcctaacaacctgagagcttatggccagcaatggatatgtttctttatgggaagcatagtacaaaagggataaactgaagtcttataataaagttttgtggaaaaaaacccttaatggtgaggcagatatgcagaaaagggacaataactttaatgttaaaaaatgatacttagagtctttgcttccattgagccacgtatctgtgatgagcttgaaagaactatcctaagagtgattctcagactcattaggttgagagcctgtcttctttttttgtattattctcccctgtcttaaaaatactggctgtcatattgaaaacgtatgactgatttgatactaattttttcctacattcattgaaataattagagatgactccaggccattacaaaaatcaagactgagatttggtaaatttattacgggctttgaatacatagagtcattgggactcttagggctgccaactatatttcttaaaacatggaatgcaatggttactactttgtgagtcttactcttaggttttttcatgtttccccttaaaagataaataaacattctcttaagacctggtcatgaattactgactttgtgaagttgaatagaactgggaaattcaggaaaggataggattttcaccaccttttagcagttgattaatgaatctcctgttcccaaatcgatttatctcagttatttctaattggttttgagtttgtggaatctgctttaataataaactctaaaattgggtaactcagatgtttgaatatttaataaaaatcttaggaaggtgaaacacagttctttcttaacgtgctttttgattttaatgcaccttagcaaaagagtcaaattttaaagttgatgagctacagataatgggagtaaaatgacaccttggttaacaagtcctctggaagcaaagctcctagaaaattggcctgagcattgaaggggttggaatacccattccagtttcttcatttttggattaaagaaagagaaggcaagctcactgctgcagatatagagacttctcaaagggcaggctgggtgctagctgtagggcgaagcatccttctagagggcctatgcttcaccagaggattgtaactatttcctctgtgcactgggaaggggactcttgacagtgatgggagcacatgctgtttctcctagcccacttctacatattgccatctccctaccaccattatcacatgtgcattctttcacctatgtggttttataaaagcaaggaagatttgaattcacttgtttgtatagaaggtatggaatcaacatttagaaatgcattcatcttctaattatttttaaattacttcattagaaataaaataattatctcattcagaaaatagaatggattcttacataccttatctacctaccattcatccatccatgtatccctttatccatccatccatccatccatccgtctacctatctaccaatctacccatctgcttatcttgctttcacacaaatataagaaatgtggagaatgagaaataatatataaactaagctttctaaatagaaaacatttttggtcaagatgaattggacatgatgcagtttaactggtatataaattttaaaagatgaagggacactaaagtcttgaaatatggtaagcagagggagcaaatattattttgaagttctttaaggacaagattgagatattcagtggaaatgccttttgatttgggtaattaactttcatcctgttatagttatctaatggaatatcatttgtctagcccaattcccttatctacgtcatagtgttatatctgttattgtgatggttggcattagagttcagaatgtgttcttttaaatgttgatatcagtatgtgaaattctccccaaatttcatctgagttattttctaggatttactacctccctaccccataagtgttgggagaatagcatgaaagatttttagtgttggtattgtttttatggaaatagaatggtaaaagtaagtgatcttcagattgaattaattaaaccagaaaattacttgcctataacagaatgtatctctctgatatcctccttgtgcttataaattaagcattgaaatgctaagtgacttatagcctctactgtctgctatttttaattttttaggcttggtataaatgggaacaatgtaggctctggattcagatgtgggttcaaatcatagttactagactcatggtgaggccttaaactctccgagcttcagttccctgtctttattttattttatttttttattttattttattactattatactttaagttttagggtacatgtgcacaatgtgcaggttagttacatatgtatacatgtgccatgctggtgcactgcacccattaactcgtcatttagcattaggtgtatctcctaatgctatccttcccccttcccccaccccacaacagtccccagagtgtgatgttccccttcttgtgtccatgttttctcattgttcaattcccatctatgagtgagaacatgcggtgtttggtttttttccttgcgatagtttactgagaatgatgatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatactcagtaatgggatggctgggtcaaatggtatttctagttctagatccctgaagaatccccacactgacttccacaatggttgaactagtttacagtcccaccaacagtgtaaaagtgtttctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcaaaaattttctcccattttgtaggttgcctgttcattctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccattgcttgttttcctccagtttgtcaaagatcagatagttgtagatatgcggcattatttctgagggctctgttctgttccattgatctatatctctgttttggtaccagtaccatgctgttttgattactgtagtcttgtagtacagtttgaaatcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttaggtagtatggccatcttcatgatattgtttcttcctacccatgaacatggaatgttcttccatttgtttgtatcctcttttatttccttgagcagtggtttgtagttgtccttgaagaggtccttcatgtcctttgtaagttaaatgagttattacaaggattaaataggatactagaatgtgcctggcacagtgcttagtacacagcaggtgctgggtaaatgatcttattcctatgttaaaacagacagaagctatttattaatactgttctattttaaatgtgacagacatatgcatataagaagcctgtgcaatagctttttatagcctgtgcaatagcttcttatagccttggaaagatagcagctattttataaaatctcatctgtaactaaagagttccattagtgaaatgatttcaggtagacaataatatatttatgtcattaaaaaaactacaaataactaacaaaagctttatctttcttgattcctttcaggcaaacacctcattaagaagatatattctttaaacaacaattaatttatgccttattaatagatgttactttcaagctcactcttgttggtatttgaaaaagaaaaaagagagagaagttgctatgatatttataatttctttgtgtaatgatactataaatgacattttagttgggggacaaatctttcaatatttgaaattttaagtttttaatttttttcaacaaaaatgccaggcttattttatatacattagtttacttcatgagttggaaattttgttcccgattttttcaaaacatgttcctttgtttcataatgaaagttgagtatgtgtacactcaaacgtttgtggtatcattcagcttttgtttgggaagtgtggagaaagagaggagtagaaaagctattaatatctttcgaattcaatgcagtatgaatactttgactctatcttaaaaagccaatggaaaatggcttctaccatcttaagtttttaatttatttctcaagggtggaaggaaataccttgacagatttagccctgaaattcaaatgagtatgagaacaggtggtgaaatttcttctccacctgccatgcaactttatcacaagaaatgtttcatttagcaaatgctgctgctagcagacacttctctgtttcagagcagaaaaacaaatggatggaaagtactttgaggaaagactttttcttgattttctttttaaattgtgagtgtgagcaatatgtattttattttcctgggggttgggtagtggatagtcagtgccttgattaaccaacctgttttgttgtgttgttaaaccattcatagctttcttgtttttgttttcattttgttttgttattgttgttgttcctgtataccaacccactgacaccaactttagttaaggtaatattattaatctggggaacttgaaatatctatattatacttttgacactaatgcaagagactttcttttttttcttttcctttttttgagatggagtttcactctttcacccaggctggagtgaagtggcacagtctcggctcactgcaccctccgccccccaggttcaagtgattcccctgcctcagcctcctaagtagctaggattacaggcacctgccactgcgcgcggctgatttttgtgtttttagtggagacggggttttaccatgttggctgggctggtctcgaactcctgatctcaggtgatccgcctgctttggcctcccaaagtgctgggattacaggcgtgagccaccacgcccagcctgggactttcattcttttgttgcagtgaaattgagtttttagcatatattgttagatttaaccttttttggtaatgaaatgatggcagttaaagcactatgaaacaaatgagggaactaaatagaaaagtgttgttcatatacttttacctttctagcttttctctaattcatttcttcttttttcccttcagaaattacaaacagtacaggaaagtgtagagaacagtcttttattcatagcagtatcaagatgttgctttttatttgatgtgagctagacattaatgtaccagtgcatgaattggcacacataacctctctaccaagaaaagttaagtgcttttattgtgttttcatgatgataatctcaagaagcaccaaaatgttcccttttccttgacaatgaaatttgaccacacctgggtttctgtataacatgaactgctatttgcaatgatagaaaccaagaaattgaagtacacattttataattgatcaagatgatatcttattttttaaacacaatggtactggtttcagtggattgtcgtgggatttatttaggtatggagattgaggagcattggaagattatttgtggcttttgagtcaaatgatgcaattaagagatgctttttccttcctcatatagcattccaacaaacatatttactataatgaattctaagagtatatggttctctatagaacgtctaccaaattaaacctctacagagggattcactgaagaaaacacatttaagtcagatcagcagagcactcttgctttggcccacctaccaggacatagataccaggacacaattcttcattgtcatgttgcttgctattaaaaaaaaaccacatttgtccatttagtgagttttaaatttcctttgaaaaaatccatttggatgaacaattctatgcagacagtagtaggagtttatgacatgtttgcactagcaattttgagagtatatcttgtactctgataattttgcaggtttaaagatagaatctttgtgcatattctggaatactgatgaggttgaacatttttgtatctgctaaccattggcaccttgatctttgtgaattgtgtgctcatatcacttacatgtttccgttcgggtaattttaaatatgtggacatttcgaggcaagattacaatgttggcagccctttgttaacatatgacaatggcttaggctttttttccttttgtctttaaatgcagtgcagagaaatgccacagtctgtgtatgtttggtttgaccacgtttacaatgctttcagtaaaatggtcagacagtgcctccatctctaagctaatactcatcaaaaaagtagttgttttctttgagcaagcacagttgagtgattcacgtacactttgtgaaagattgctcttgtgctttatggttggtcattgtttcaagaataagacgtctgctgtggtgattgggtaggcggggggtggcatgcaagcaatatgcagactataatattgtagggaaaagagaggtttaatttttagaaacaaaattcgttaatatagtctctcccatgaataatcttgtagggctggtgaaatgggactatttagacagaatttgccagattctaacttaacatgtaaaagtggatccaaataacaactgttttatgcagatttaggaaattattattcttacatgagcttatgtaaaacaaaagctttgctgcataattttcttataaacttcaaagccattatctacttttttactcttagacttgagttttcaaattgatgggcctgtggagagcagagatattctgttaggtagccttggaagaattagtgataattaataatcctgctgtgtttcatattgctagcattacctcatggattcaaccctatgactgggaaattatttaaatcatgaaattgcttgagaaaaattttcatgagacagtaaattcctctatattaggatttctcacctttggcacttgacttttttgcctaagaacagctttgacctagagaactgtcctgttttgtaggatgtttagcagcatccccagttgtgacagtgaaaaatgtctgcagacattatgaatcatgggggtggaaggaggggcaaaatgcctcctgctccccctccccacattgagaatgacttgtatgtatattgtatttaactatatgagttgaaaaaacatcagattaaaaactgttattttttttcttggaattactcagataatcattcctttaagcatagattgatataattgtggcttggggtttgcagagaagtgttacctccttgcaatgttgaagaacagtgctcttcacattcaatcaataaacttaataaaggggagatagatgggaatattgaatctgctaagaaggttaacatggcatgtactgttaccaaagcagaaattagtagggagtgttttgaatgttaaaaagtcaaaagatactgataaaacatcatgaaaaagataattttagtccaggcttcttcagcttttgaagtaattaattaaaaaggcaagcatattatgttggcaagaaagggctgcattttcactttttgctttctgtttttaagagcaagagacaaatgacaaagtaaataagttgttacttgtagtttactcaaaaaagcaatttccgggatatgtcattgtggcaatgtgaattcagctttactcctatcccttttacatctgcagtttcataagaatgataattgatggtcatttaagcactgcataataaagaaatgtctttggaatgatctacagaaagaagattctgtattcattcagaggacatatattaagtctttcgtgctaggctctgtgcagggaatacagaaactaataaaacagtctgcttgaatatcctattaatataatctggatgaatagacattttctggttagggataacagtcaccatcaatcaatttctgacttttccaattgattctgtaattttaaacgtctgtccacaaaagttgtttaaaattgtgtgtgtgtgctatatatcataaatataacttaattctctttaaagctatctctgaaactctggtggaaggctatatccagtttcttttatgctttttaaaatcttaagttattctcttctttattaaatatctatcagaattgaattaaacatggttatatattattaattcatttttggttatactatggctctaatatcattaagaagaattgatgtcatccttaaggccagaatttttgctaattattgcaagatttaaaaccacttagttggtgtcataattcaaaaagcagaatctttagtatggtctttttcttgttaaaactgatcaacttggggttttaggtatgacaggaaaaaaaggtgaaacctttctgatattggatagctcagttagacagttagaaaagcaaataattcaaaattgaggaaattacagaaaaaatgaagagttccagcacttgaaaatctgctctccttcttttttcctaatgtctattttagcagtctttttagcagtctgtatcatgaatgcagaaccaaattcatgagccatgggctccccactcttaggcaggtgatccagagattattttagcaatgtatacctatggagaaacacaagatctcttctaaggaatgatgaaaggttattaataatggcacatttttagtataacctgagatttttaaactatcaaatgtattgtcatattctctttgcatctaagtgacctactgactaaggttctcctattcttacttatgccccttgaaaatactattgctgcaatacatgcaaatacagaattgcctgtatttatatttttagtattcatttctttgaaaagatggaaatgtgactagattgtagctattaaacaatcccaaactggtaagtgagagatactgctagaaaaagaaattatatcatgtgaaaaattttgttcagttggggttgattagaactactactaataacagaagataaagtaatgcattaatatataacaattaatcttttacttttattaatgggggtttggagtgggaatcagactagacctagattcaaaccctgggccaaccactttaataagtggtttctgacccttctttagtctgtgtataaaattattggcaagtacctgctatataatgactattcaataaatggtagctatcatttttatcttttcaaaattaggtgttccaaattaattttaactatatgcagcataatttgatggcattgctatctaaatagtaacatatcaacagtaattactgtggcctttaaaaactctgtgactataattttgaaccaccttttaagttgatttctcagttatcatctgtatattctgtacttggaaaccattttacaaatatacatttcttctaagataaagagtggtacaagcgtataatatagtgaaacaatattcaccatattgcatggtcatatgattgcaatagtgactgattatttttctaaataatctcattgtaaattgtacaagttttaatttccccttctttcttatgtaaaaaaactttcagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacaggtaatttaagctgtctctttggtagtgtttacgtagctttaaaaaacccaccatggattttgtgatgcaggatgtcagtagtggaggaggttgtgggtgtgtatgtgtgaataggaaatgtatggtaactattttttgctcagttttgctgtgaacccaaaatggctctaaaaaatgaagtttattaagtaaagaaacaaaagacaaaaactaaccaggagagaaatcttgatggaggaatgcacacattcctgaggttaaaaaatcctcagaatcaattttttgtttggtttgtataaaggacattttgccagtatgccactttcttacagaataccatatctgatttcattccatagcaatcaaagtaagtattacaaggtccctacactgaattttcctagttcctcattcacagcctgttttactatcatctttgtaatggttctaaagattatatttatttggtgtcccaactcgcattggtagtagtaactgtgggagaagaggttaggactgctggatgcaaaccctctgatacatgtaataagtaataactaaaataaaagcaggggacagaaacacagtagaaagccaaaagaacatgaaacacagcaatctggagctatttagcacggggattagaagcttaagtacttctgacctttgtggacattttctgacttctgtgggcattgctgaattagagagcaatatggtactggatgtccattaatgtcttctaaagatagttaaattatattggtcctcttactacccttaataagataaggaaaatttgcctttctaaatgcatatttaaaagaaatctccccagatggatttcatgcatatccctgatcaagaaccattatagtaaagctgtatatagaatataatataatgagggacaaggtttatacttgctgtgcatcctctgtgtttaaatgtaatttcaccggatttcattttccttatctccaaaatgtgactcttgactagcatacctctaaatttcctgctagtttcaatctttgaattcagtaaaatcccatttccccagtatttccgtttctaattggagctggggtctatctaaggttcattgtcctgtgggtcatcaatagatatgtgagtcaggaacgagaatctttccatctcctggcatcttaaagctgtgtagggaaaagggaagatggccgaatagaacagctctggtctgcagctcccggcaagatcaacgcagaaggtgggtgatttctgcatttccaactgagcccccactggtgatacccgggcaaacagggtctggagtggacctctagcacctctagcagatctgcagcagaggggcctgttagaaggaagactaacaaacaagaaaggaatagcatcaagaacaacaaaaatggcatccacacagaaaccgcatctgaaggtcaccaacattaaagaccaaaggtagataaatccacaaagatgaggaaaaactaatacaaaaaggctgaaaattccaaacaccagaacacctcttctcctccaaaggatcacaactcctcgccagcaaaggaacaaaagtggacagagaatgagtttgacaaactgacagaagtaggctttagaaggtaggtaacagcaaactcctccgagctaaaggagcatgttctaacccaatgcaaggaagctaagaaccttgaaaaaaattataggaattgctaactagaataaccagtttagagaagaacataaatgacctgatggagctgaaaaacacagcatgaggacttcatgaagcatacaaaagtatcaatagccaaatcaatcaagcagaagaaaggatatcagagattgaagatcaacttaatgaaataaagcaagaagacaagatcaaagaaaaaagaatgaaaagaaacgaacaaagcctccaagaaatatgggactatatgaaaagaccaaacctaagttagattggtgtacctgaaagtgatggggagaatggaacaaagttggaaaatactcttcagggtattctccaggagaacttccccaacctagcaagagaggccaacattcaaattcaggaaatacagagaatgccacaaagatactcctcaagaagagcaaccccaaaacacataatcgtcagattcagcaaggttgaaatgaaggaaaaaatgttaagggaagctggagagacaggtcgggttacctacaaagggaagcccatcagactaacatcagatctctctgcagaaaccctacaaggcagaagagagtggggaccaatattcaacattcttaagcaaaagaattttcaacccagaatttcatatccagccaaactaagcttcataaacaaaggataaataaaatcctttacagagaagaaaatgctgagagattttgtcactaccaggcctgccttataagagctcctgaaggaagcactaaatatggaaagaaaaaactggtaccaaccactgcaaaaacataccaaattgtaaagatcattgacactatgaagaaactgcatcaataaaggggcaaaataactagctagcatcataatgacaggatcagattcacacataacaatattaaccttaaatgtaaatatgctaaatgccccaattaaaagacacagactggcaaattggatagacaaggcccatcggtgtgctgtattcaggagacccatctcacatgcaaagacacacataggctcaaaataaagggatggaagaatatttaccaagcaaatggaaaacaaaaaacaagcaggggttgcaatcctagtttctgataaaacagactttaaaccaacaaagataaaaaaagacaaagaagggcatttcataatggtaaagggatcaatgcaacaagaagaggtaactatcctaaatatatatgcacccactacaggagcacccacattcattaagcaagttcgtagagatctacaaagagacttagactcccacacaataagagtgggagattttgtcaccccactgacaatattagacagattaatgagacagaaaattaacaaggatattcaggacttgaactcagctctagaccaagcagacctaatagacatctacagaactctccatcccaaatgaacagaatatacattcttctcagcaccacattacacttattgtaaaactgaccacataattggaagtaaaacactcctcagtaagtgtaaaagaacagaaatcatagcagtctctgaaaccacagtgcaatcaaattagaactcaggattaagaaactcactcaaaaccatacaaatatagggaaactgaacaacctgctcctgaatgactactgggtatataacgaaattaaggcagaaataaataagttctttgaaaccaatgagaacaaagacacaacataccagaatctctgggacacagctaaagcagtgtttagagagaaatttatagcactaaatcccaataggagaaagcaggaaagctaaaatagacaccctaacatcacaattaaaagaactagagaagcaagagcaaacaaattcaaaagctagcagacgacaagaaataactaagatcagagtagaactgaaggagatagagacacgaggaacacttcaatatctcagtgaatccaggagctggttttttgaaaagatcaacaaaatagatagaccgctagccagattaatgaagaaaaaatagagaagaatcaaatagacacaataagaaatgataaaggggatgtcaccactgatcccacagaaagaaactaccatcagagaatactacaaacacctctatgcaaataaactagaaaatctagaagaaatgggtaaattcctagacacatacaccctcccaagactaaactaggaagaagtcgaatccctgaatagaccaataacaagttctgaaattgaggcagtaattaatagcctaccaaccaaaaaaggcccaggaccagacggattcacagccaaattctaccagaggtacaaagaagagctgataccattctttctgaaactattccaaacaatagaaaaagatggaatattccctaactctttttatgaggccagcatcatcctgataccaaaacctggcagagacaacaaaaaaagaaaatttcaggccaatatcgctgatcaacatagatgcaaaaatcctcgataaaatgtaatccatcacataaacagaacaaatgacaaaaaccacatgattttctcaatagatgcagaaaaggcctttgacaaaattcaacacaccttcatcctaaaaactctcaataaactaggtattgatgtaaagtatctcaaaataataagtgttatttatgacaaacccacagccaatattataccgaatgggcaaaagctggaagcattctctttgaaaactggcacaagacaaggatgccatctctcaccactcctattcatcatagtattggaagttctggccagggcaatcaggcaagagaaagaaataaagtttattcaaataggaagagaggaagttaaattgtctctgtttgcagatgacatgattgtatatttagaaaatcccatcatctcagcccaaaatctccttaagctgataagcaacttcagcaaagtctcaggatacaaaatcaatgtgcaaaaatcacaagcattcctatacaccaataatagacaaacagagatccaaatcatgagtgaactcccattcacaattgctacaaagagaataaaatacctaggaatccaacttacaagcgatgtgaaggacctcttcaaggagaactacaaaccactgctcaaggaaataagagaggacacaaacaaatggaaaaacattctgtgctcatggataggaagaatcagtatcgtgaaaatggacatactgcccaacgtaatttatagattcaatgctatccccatcaagctaccattgactttcttcccagaattagaaaaaagctactttaaatttcatatggaaccaaaaaagagcccgtgtagccaagacaatcctaagcaaaaagaacaaagctggaggcatcccactacctgacttcaaactatactacaaggctacagtaaccaaaacagcatggtactggtaccaaaacagatatatagacaaatggaacagaacagaggcctcagaagtaatgccacacatctacaaccatctgatctttgcccaacctgacaaaaacaagcaatggggaaaggattccttatttaataaatggtgttgggaaaactggctagccatatgcagaaaactgaaactggaccccttccttacaccttatacaaaaattaacttaagatggattaaagacttaaacgtaagacctaaaaccataaaaaccctggaagaaaacctaggcaataccattcaggacacaggcatcggcaaagagttgatgactaacacaccaaaagcaatggcaacaaaagccagaactgacaaatgggatctaattaaactaaagagcttctgcacaccaaaagaaactatcatcagagtgtacaggaatcctacagaatgggagaaaatttttgcaatctgtccatcatacaaagggctaatatccagaatctacaaagaacttaaacaaatttacaagaaaaaaacaaaccaccccatcaaaaagtgtgtgaaggatatgaacagacacttctcaaaagaacacatttatgtgtccaacaaatatatgaaaaaaaagctcatgattactggtcattagagaaatgcaaatcaaaaccacaaggagataccatctcatgccagttagaatggtgatcattaaaaagccaggaaacaacaaatgctggagaggatgtggagaaataggaacacgtttactctgttggtgggtgtataaattagttcaaccactgtggaagacagtgtggtgattcatcaaggatctagaaccagaaataccatttgacccacaatcccattactgggcatatacccaaaggatttataaatcattctactgttaagacacatgcacaggtatgtttattgcagcactgttcacaatagcaaagacttgtaaccaacccaaatgcccatcaatgatagactggataaacaaaatgtggcacatacacaccatggaatactatgtagccattaaaaggatgagttcatgtcctttgcagggacatgcatgaagctggaaaccatcattgccagcaaagtaacacaagaaaagaaaaccaaacaccagatgttctcactcataagtgggaggtgaacaatgagaacacgtggacacagggaggagaacgtcacacaccagggcctttcagggggtggggggctaggggaggcacagcattaggagaaatacctaatgtagatgatgggttgatgggtgcagcaagccaccatggcacgtgtatacttatgtgacaaacctgcatgttctgcacatgtatcccagaactttaagtataaaaaaaaaataaatccctctaatcctctaatatatgaaaacgagtcttcggctatttttgtttgttatacatatgaggatagatttttaaggtgctcaaaaaaaagctgtgtaaatggtttacttgttgatttttcaagttatgggaagagagaataaggggtcaaacagataggaaaagtatgtgaggaagaagtgtttttggtatactaaagtgctctcgctaaagaaaaataagaaatacctcactactatactcctacctaatgtaatgcccatagtagtcatgagttaaagccaattattgtggtcctgctaatttttaaaatttactagaaaccgaacaatgattgccactgtagtgcagtgagagatatttaaagcaatggttctcaaattttagtgcatgtcagaatcatcaggagggcttgttaaaacactgaacgctaggtcccaaaccagaattttttaataaaaaactctggggataaggcccaggaatttgcatttctaacaagtttctagatgatgctgcagatcaaggaacatagttttaagaccattgttctagaggtgggaccttcttccaccgagtcatggccttttcttttctccctatatattttatggaggttataaattattgttacaatggataaacattagagataacttaaatatctatcagtaggtgaatcgttgcatgaaatatgttgcaccaaaactatgcaatgctgtgcagccaccaaaaagagtaatatctgtacatattgaatggaaagaatataagatactaaaaaaaagtaacagggaaaatgtgatacatccatacaatgtaatatgatccagctattttaaaagatgaagtactaatacatgctatcatatggatgaactttgaaaacattatgctaattgaaagaggctaatcaccaaagtccgtgttttatgtgatttcatgttttatgtgattccatttgtatgaaatgtccagaataaagaaatctatatagacgtaaagtagactattggttgcttacagctagggaaattggggggatatgagagtgaaagctaaaggtacaggatttctttttgcagtgataaaaatattctaaagttgactctggatatcattgcatatatctgtgaatatactaaaaccattgatttgtgcactttaaatgggtaaattgtatggtattcaaattgtatctcaataaagctattaaaaatgtaacaaggcaatatgtattgtataatcctttttatcagtagaaaaattatacaatatgtatacacatgaatgtgaatgcatagcaaatggtatggaaacactagggaagctgaggaataatgtcatcttttgctctgtaaaatcctataatgtttaatttttatttacaatggaaatatttttctgcataacctctgtaataaaaaaatatataacagctgacaaaacaagtgtaactgggtctcagagcccttagctctgccatgccttagctcattggtccaggctgagaaagaacagtgatgtgaaagtaacctgaaattttgtgttacttgaagataatttttcttcaactgattttttatgttgttacaatatttcctgtggtaccatagagataccactctatgttgctattaaaacccttctatgctctatttaaaagtctattaaaaattatgttttcacaaattgagatttttaaggccaagcactaacagggaacatttttgtatcaatcttaggtgtggtgttgtcaagagaacaagctagagaagtgtttaatgtgtaaatgttatcattgttttaaaattagcaataacacatactccggcttcaaaaggcattgaaagtagctgtcaggggaactgatccatggggagaaactgttgtaataagcctcactctgcaggattacccactgccaaattgtagtgagaaggacatgggtttcagccaaaactagaattctaatcgtgccccttattagctagttatgtgactttgggaatgtcatttatactctctggcccagctttttttatttgtaatctgggtaagagatttgaggattaagtgtcacaatttatggaaataaggtgcataataaatattcatttattttccttccacttgaggtaaatggagaaggtctcacagggaatagagctgatcagaagttatgggtataccacagggaactcctgagcccctgcgtcattaatggaccaggctctggctatgggatgtggttcctctcagactagggtctttcctctttctctttaagtctcacctagacagagcagaacagtgagggtaggagtcatggtgtctcccactggataagattgggcagatggatgaggccacttattttctgccaggactattgaagaaaacagaaaatagttaatgaattaaatgattatgtattaatatgtgattatataataaaaaaagaagttatgggtataccgaataaggtgtccatctggttggcttgagcaggcggttggcttgagcaggtctagcaggttactcatctccattaaatggcttcagcaaactaggctgtcaaagaaaattcctagaaagtcatttgatacctaacaggcttggattcctagaatcttgaacaagttccaggataatccatgactgagttggcagggcaaatgacttttactcaagtaagaaagattaactaaggttagcttaagtagtgattggtaaaatcaaggattatttcatttccctcactccttggctactactacatctgtggttatttctcatggaaaccttctattctttcacttctccctattattccaggttgtcagcatctttctcttactgtcctatcatatggtaattcactgaatgataactttcctagcaccttcagtttttaaaataatagctttattgagatatgattcacataccatataattcacccatttattgtgcaaatcaatggcttttagtatattcacaggattgtgcaactgtcaccacaatcaattgtagaacattataatcacctcaaaaagaagcccatatttgttagcagtcactccccagttgcccccaactcttttctcaatatggcaactgattggtttggctctgtgtccctacctaaatctcgtgtcaaattgtaatctccagtgttggaggaggggcttggtgggaggcaattggatcatgagggtggatttcccttttgctgttctcgtgatagtgagtgagttctcaagagatctagttgtttgaaagtgtgtagcacctcccccttcactctcttcctcctgttctcaccatgtcagatacgcctgtttcaccttccgccatggttgtacgttttctgaggcttccacagccatgcttcctgtatagcctgtggaatgatgagccaattaaacttcttttctttgtaaatgaccagttccaggtatttctttatagcagtgtgagaatggattaatacagcaaccatttatcttttctctgtttctgtagatctgtctattctgagcatttcatataaatggaatcatacaatatgtggtcttttgtgactagtttctattacttaccataatgttttcaatgttcatctatattgtggcatataacatgcttccttcctttctgtgttcaaataatattccattgtgtagatattttgtttatgtatccattcattgataagcatttttttcatacattttggcttttatgaataaaagctatgaatattcatgtgtaaatgtccgtgaggacatgttttcatttctttttggtatataccttagagtggaattactggatcctatggtaattctgtctaattttttgaagaactgccagtgttttccaaagtatctgcaccattttatattcacactggcagtgcatgagggttttaatttctccacattcttaacagcatttattaactgtctttttaaaattattatagccatccctgtagatgtgaagtagttttgatttgcatttctctgattgctaatcatgttgaatatcttttttttttatgcttatggccatttgtatgtgattctggaagaaaaaaaatcttattcttgttctgtgccaagtcaccaggaaagaagaaaacaaaccaaaacaaaagaaaaagaaatcctttacccatttttcagttgggttgtttatctttttattactcagtagtaagggttcatacacacatatatattatattacatatatgtgtatatatatattttacatatatatgtattctagatacagatcccttatctgatacatgatttataagcattttctccaagcaccttcagctttatggtcccttcttgttctgctaattgctttgccattctccaattctttatccattcagccatataatctttgcttctgtattatcttggcaaagttagtaggagagagggtcaaggaaaatgcctagaagggtttggatttttcactattccctaaacatatattgtgtgttcatatgccagtgcatttgtacacattacctctccctggaatgcccttacttcacttttcctgtctgataaacctcaatttatttataatgacctttctttctttttaaaaattatttatttttagtttagattcagggggatgtgtgcaaatttgttacatgggtatactgtgtgatgctgaggtttgggcttctaatgattccattgcccaagtagtgaacatagtacccaataggtagtttttcagcccttctcccatttctcccttcctccttttagaatcccagtgtttattatttccatttttgtgtccatgtgtacccaatgtttagctcctacttataagtgagaacatatagatattttagtttctgtttctgccttaatttgcttgggataatggcccccagcagtatccatgttgctgcagaggacatgatttcattgttttttatggctgtatagtattccatggtgtatatgatccatcttaaatggatggtacctcttctgttaaacttttcttgacccaagcagagttagtagcttcttctattcatacattttatctgttataaatatcacctatcagtgagctcctcaaggtctaggatctaagttgttgtttctgtatgcctatgatcagtacatgatgctgcttaataaatgtccaccttttgtattattaacatactagttatcattaaaagagatgctactttgctataaagaagctttttagtttgatgtactctcatttgtctatttgcttttgttgcttctgcttttgaggacctattaaaaaaatccttgcccagcctaatttcatgaacatttatcctgtattttcttctagtagtttcaaagttttggattttacttttaagtatttaacctatttatagttggtttttgtgtgtggtgagagactaatttcattcttccatatgtggatatccagttttcctggcaccatttattgaatagactgtcctttcctcatgtgtgttcttggcacctttattaaaaaaatcacttggctgtaaatacatggatttatttctgggttctctgttctgtcccattggcctgtgggtctgtttttatgccagaatcaggatgttttgtttactatagctttgtaggatattttgaaaccagacagtgtaatgacatcaatttttttatttttgctcatgattgctttggctcttcaggctcttttgcatttccaaatgaagagacaacctacagaatgggagaaagtacttgcaaactatgcatctgataagaagttaatatccaaaatgtataaggaactcaacagcaaaaaaaaaaataaattatccaattaaaaatgagcaaaagacctgaatagacatttcatttctcaaaataagacatacaaatggccaacagatatatggaaaattacacaacaacactaattatcagagaaatacaaatcagaaccacaatgcaaaatcatctcatctcagttagaatggttattataaaaaaggcaaaatataacaaattctggtgatgatgtggagaaaagggaactcttaaatactgttggtggaaatgtaaattagtacagcaatgataaaaaatagtatggaagttcccaaaaaactaataatggaactaccatatgatccagcaatcccattactgggtatatatccaaaggaaatcagcatgttggagagacattggcacattcatgtttattgcagtagtgttcacaatagctaagacgtggaattaaactaaatgcttgtctacaaatgaatggataaagaaaaaaattttatatctacatctatatataaatgtgatacagatagatagatacaatggaataccattaaggaataaagtagaatgaaatcctgtaatttgtggcagtatggatgaacctggaagacattatgttaagtgaaataaatcaggcaatgaaagagaaatactgcatgttctcactcatatttggaatctaaaaacgttaatctcatagaagtagggtaaaatagtggttaccagagactggggagggtaggggagaggagaggactgggaaagattggtcaatgagtacaaagctacagttaggaagaataaattttggttttctgttacacagtagggtgactatagtaaataacaatgtaatatatatttcaagaaagctacaagagaagattttgaatgttattgccacaaagccacaaagaaatgataaatattgcagatgatggatataataattaccctgatttgttcattatactatgtatacatgcattgaaacatcacattgtaccccataaatatgtacaattattatgtgtcaattataattaaaaattaaattttaataagaaataatacatataaagagcttagccctgggatagagaaagtgctcagtgtctttttaatgctattattgatgttgtttgtgaaataaattaatttggatggcagcttataaatcactttcatatatactttcctcattgatacttgaaaaaaatgctatgaggtacaaaaggcaagaattgttatctccattttatagataaggacgctgaagctcagggagattaggaggcttgcccaagttcacatagccagtaagtgataaatactgagacagatttgatgatggtgtagttttgtatttttatttctactagtcttgctctaaattgtcttaccttttaaaatacaatgtctataaatattgtgttcattaactataaatgtaaaaacatgtattagcaaaggctaaaagatagtttggaatgaatgatataataaatattttattcttgatagaaacagcagaattacacagaatgtcttcttgctggcttgcctttcttccgttcacctactgaaaagagaaaaaaaaaatcagggagaaaaatgttaactgccagttgaaaacatccctttcatccttaagacctggaggccataacgagggtatcatgcttcagctggtggcagtgtatattaattacagaatacttaggtatatggaaacaaatcatttcctgattactggcgatactcaaacctataaaggtggaaaatgcctcgttactctggctatgtgggcctctagttgatattttctcattttaagattggtgcctattggactgctctttttgtgttttcctcacttatagctatttactttctctcttcatttttagttctaaagtcaatgtaggatatcattttatagtcttatcctctagctaatagaatgttaaagaaatgggttattgtaagagcctatacagattaacacgtgttgcctttccctgggttaatttctctgaatgtttatcctgaggtaaatgcttgggttgctgataatgtcatgttgatgaagtatatccttttttctcaacattatgatcataaaataaacaactttaaaaatataatgttagtacgttgttaacataagaaacaggcataatgattaagataatttacattttataaaataagagttcaaatagtctagattcttgtggtttttatgaaaatgatacttttaatttcttttcatttcctgaatggcagctagaatatagggaaatgagtccatagtttttcttgggcatagctcttggggcactcaggttggggtacaataagttattcttattcttcgaattgactgtgcatctttaggataaaagttggaagactgtctgccgctttccctttttaggccacttcagtgtgttcttgtcctgctctctcaattgagtatttttggttatttgctagtgtcgaagtgatagagagggctatcacataccaacttgaaagtcaactatgctggaatacataatttgaatttctgattgttgctagtatacagtaatacagtttgttattaattattgatctggcattgtgcaaccttggtaaactgacttatcagttctagcagcttttttggtagattctataggttttcctatataggcaatcattttgcctataaataagcctgcctgcctgcctgcctgccttcctgccttcctgccttcctgcctgcctgcctgcctgcctgcctgccttccttccttccttccttccttccttccttccttccttccttccttcctcccttccttccttccttccttccttcttccttttcatcctttcttgccctccctttcttttctttcccctttcttcctttctttttctttcctcttttcttttttctttccagtctgatgccttttttttccttaccttattgcactggataaaacctctagaaaaatggtgaaagcaatcagtctttcaccattaagtatgatgttatctgtaggtttgaggaagttctctcgtattcttagcttgctaaaaatttattttaattttctaatttttttttgagacaaggtctcattctgtcacccagactggagtgcagttgcatgattttggctcactgcaacctcctcccaggcacaagcaatcctcctacctcaggctccagagtagctgggactatatgtgtgtgccaccacactcgactaatttaatttaagttttttttttttttttttttttttttgtagagacgatgtctcactatattgcccaggctagtctcaaacagctgggctcaagcaatcctcctgcctcaacctcccaaagtgctgggattacaggcatgagccaccacatctggcgagtttacttttttaaaaaaacaggaatggatgttggattttgacaaatgccttttttttctgtagtcattaagaaatgatcttagcatttttctttttcagtctgttagtatggtgatttatattgattaacttttgattgtgaaagcaaccttgcattggagttataaactcttcacttggtcatgatgtatttattattcttatatatcagtaaatttggcttgttaaaattttgttgaaaatttttacatctttgtgcccgatggattttgatcttggctttctgtgattgtcttgtctggttttagtattagaataatgctggccatgtagaataacttgggatatatgctctcctcctaatattctggatttgtttgtggggtattggtgttctttcttccttaaatgtttgatagatttcaccagtgaaaccatttcatcttagagttttccttggggaaacaattttaaattaaaatttaattttatagtagacatgtagctatttagtttatctgtttcttctaaaactttagtagcttgtgtctttcacagaatttgtccatttaaactgagttgtcaaatttattggcatgaagttgttcatatttccttattatccttttaatacttatagaatctctagtttatgccacttctattcatcctggcattggtaatttgtatattctctctttttctcacctaatccgtcttgttagagttttgtcagatttatggatcttctcagaggaacagcttttggtcttattgctttttctgtttttctgttttctatttcattgatttccactatgatctttattattgcaattctcctgcctaatttgggataaatttgctcttctatttctagttttttaagaaggaaacatctttcataggaggtgtttcttcttttttaatatagtcattgactgatataaatttcccctaagtagagcttcatctgcactccacaatttttgatgttatattttcatttagttcaaaatgcttacgagtttttcttttgatttctttatgggttatttagaagtatgttttagtttcaaaacatttggggattttccagagatttttctatttttgatttctaatataattaagctggggccagagaacatattaataatttgtatgacttgaatccttttaaattttttaagactagttttatggcccagaatatgatctatcttgtaaatgtttcacatatacctgaaaataatttgcatcctactgttcttcggtgaagtattctgtaaatgccaattaggtcaagttggttgatagtgttgtttcagtatccttgctaatttctgtatatttactggtttttgtcacctttaaaatcaattattgagagaatggtattgaaatctccaattataattgtaaatttgtttatttctatttgtagttctctcagtttgcttcatgtattttgaaactctgctattaaacacacagacatctaaggaatttatgttctcttggtaaactgacctttattatgaagttacctgattaatttttggtactatgctctgagatctattttgtttggtattgtagtcatgctaggtttattttaattagtgtttgctttgtatatcttttaccatccttttacttttatttttgtaaattaacatacagtaaaagtcaattttttattagtacatacttttatgagtttcaacatatatattgtttcatttaatctccagaattatgacacagaaccattccatgacctcagcatactccctcctgttaccccttggtagttatacccaccaccatccctaaaccctggaagctactgatctgttttctgtcgctttatttttgtctttttggaaatgttacataaatgacattatatgatctgtaagcttttggggctggtttcttttacttagtataatattttaagattcattcattttgttgtctatgtcaatagtttgttcctttttactgttgagcagtattccatggtatggaactttgtgaggtctcttcttcattctcctccacctggaccatcttccgaattctttccagttgctagggctctattttggccctttggcctgaaagctgggaccttattttccctgctctgccacacagttatcatggctgcacccacatcttggcccaaagacaaagagagaggaactgaattgaatattcaccacagaaagacaatcactgcttctctgaccaaggagaaaggttcctcttttacagggttttaggcatctgccacccccactgtcaccattgtcactcctcttgctaccaatgccttgaaattgccttgggatccaggccaggccgggaggggcggggcggggcgaggcgaggcgtcctctccaagctctctgagctttgagaatcttcttctctttaagaaagaagtggccgggcgcggtagctcaggcctgtaatcccagcactttgggaggcagaggcgggcggatcatggtcaggagatcaagaccatcctggctaacatggtgaaaccccgtctttactaaaactacaaattagccgggcgtggcggcatgcgcctatagtcccagctactcgggaggctgaggcaggagaagggcgtgaacctgggaggcggaggttgcagtgagccgagattgcgccactgcactccagcctgggcgacagagcgagactccatctcaaaaaaaaaaaaaaaaaaaaaaaaaaaaaaaaaaaaaagaagtagggggcttctcctggagctttttctgtctgttgacaggtgactgtttccagcttacgtgatgccctaagtccaggtcggggtagactgggaaatataagatagggggtggggtgaggtggggactcaccatcagcttggtgagagtttgcattctgattttctttcttaattcatctgctctcattaatatgtggttttcatttacttttaagctttgtgaaattgcaccaggccagcatttattctagagcaaactttcccccagtactgaggcagaatccttttgacgatggtgacagtgggggtggcagatgcttaaaaccccagccttgtaaggtttccactcatggtttgaatagaaacgacttccagccctttgtgaaccttggagagtattccttgtgctcttttttggcggttctttctgcagacaaagatgtttatcattactcgctggaatccttgagggtgactgtttttcgagctctggaatcctctctgtgtgctgatctctcttcttatattctgtcctatctgccttgatgtccccagactctcagctctaggagaatactaggttttgcctgggttcccactccctgcacctctgtctgaaatccataggcagtaaatttagacagtcatagggctcacccaatttgtttcttatctttcacagatccctttccttcaatgtttttaaactttttttccatatatttttgtttgattttaaagagtttcaggacgtaatgtaaatcgaatctctcttactggaaacataaatttataggatataattgaataagtaatggtgaaatccaaactaaaaatgcctaattattttagagatgattgtgtgagagatagctttacaaaggaggtggaatttgggcaggtgtggtgactcacacctgtaatcccagcattttgggaggctgagacaggtggcggttggggggcatccttgaggccagcctgggtaacatgatgaaaccccttctctacaaaacaacaacaacaaaggaggtctaatttaagctagtctttgaaggaggaaggatattccaggtgaaaaaaaatttttatcaccaatgtgatcgtttggagaacaacctgataagacgggtcagagtatatagggaactaataaaaaataaggttgggatcagatcaaagaagtctctgcaaaccagaagttgtgctatattgcagtgatggaaagtctttacgtttttaaagtctaagcagtgttatataataatgagcacagagtttaaaattaatataaacatttatgtccagcctatatatttgttttaacttaagtgcatctgttcctttttctgtcctttgaataaaatgaagagcagcctcataaaaacatggctggtattgtttttatctaatacattacatttacataacactggagtaaggccatttcttaactttctttagttccttaatctttgttcatagaacatattttccattataattttaactactcttttcaggatgtgtttcgttttttctctacttaaaatgacaatgatcaaaactagatataatatgctagtaagtttgttctaatgtagaatttagttgaattatttgtttatcaaattccttttaaatacctgacagtatcaatgtagctttttttcacaatagcattatatttcacttgaaagctattgacatccaagtaatttttatacaaattattcatagcttgtctggtttccatgttataatcctgtaatatcaagtcatattctattctgttttaatatgatcattttaaaatttatcaaactcattagatgtttcagactttctttgtttcctggtattagatatgtacctctctctatttaatagaggttgaagttttgatacattgggtaagtttaatacagtgaagagaaaaaacatgtttaaaaacattaaacattaaacattaaaacattaaacattaaaaatagcattaaaatgctattttccagcatcaaaatagcattaaatgacgctatttttccaggatatggagaagaaaataaaggaagatatggggagatttatagaagaagaaagggaaatattaaagaaattgaggacagacaaacccctcttaaatcaaacccaaggcacagagacagaaaagtagagaactaagataagtgttgagatagagagactggaaagatgatgagtttaaatcaacagaagcagttttaaggacattctgaaaaactaattagaaactgaacaatttgcctaaagcagagctgcataggtatatggtatactagcatatggaaacagacaaaaatgttcatgtaaatctttcaagaagagtgagtacaagtttggtgaaagaaaatgattttacagtaaaaggacttatttcgagtgtgcaggaatctttgaaaggcttcttaaataggggaaaagatttatgagtgaaagcaaaaagtagatatatagaaggcagatgagaattttggaagataatgaacctctctctttttcttttaatgtatgcatacttcactagaagattagagaataaaaggtgtttagagaaatgactgccttcttgtacacaacaatgtgtatagtcagaaggagcttctctttagacagaactgggatatctggaaaataatatacaaacaagatgtttagaatttgtttgaaaacaatctgaattgacagatatcatttggataaagatagacataacgtagaataaaattcactaatatggaattggatagtggggtcattcatttatgcatataaaaataaaggttatgaaatgtttagaaagggacactgtatgttgtgaaaataaatgtaaaaccttacaaaagcagataacttgccaaaggtagatacattaagcgtggaataaaagacactccgaatttgttaaaaatgctctaggtgccttaacttcttttcttttgggacaccagattatactgagaaaggttaaaggattttttaaaaatgatagtgtaaagggacacaaaatgataaaatctgtgaaaagaataaaagctcccggtgtcttagctgagcaaagctgtccagatcttgagcattgattacatacctccacaagcagtttgaatggaatatggacaaaacaagaaattacacagctgacgatacatgatgcacaagctactcctcttttcagagggaaaaaaaagtaatatgtagtaggaatggaacatactgacattattcaattccaattgtaaaatatttgcaggaatattttaaaggcaggaggctagcaaataagccaagaaggttttgtttgtttgtttgtttttgttctttagtggaagaaaataatggatcagatacaatcattgcttttgaataaataatccagaatttctttataaagatattgtctacgtatgctttagagaagaagaataaaaaactatttgataaataaacataaagggggcatacagtacctagactcatctcattagtatcttgacatctcttttttatgccaatgcccaaggtatgttacttttcccaagaaaaatcaaatcctttaacttgccattagctattcaaaactttaaaaataaatatccttcgaaccaacaactccagtcctgagaatatctcccacagatatacttagacagctaagtgtatgtacaaggaagttaattgcggcattgcttataactgcagaatttgagggaaaacctgagtgttcaactaagcgggaatggataaataacttatgacatgcccctactgtagattactgtgcatgcactaaaagaatgaaataaatcctgtgcactgagatagaagactatctgtgttatctgctcaagtgaattttaaaatgcacaacagtatgtatagtaacccactttaaagaggcctttatatattttaatacaagcataatgtagattatgatatatagagaatgaggtcttgaagtatgcttactaaactgttaacagtggttacttctagtaagtgaaagaggtagcctttaagtttttaacttatatccttctgtattttgacttcaaaaaacatacaagcacatatttaattttttaaacctgaaatttatatgagggataaaacaaacacaagtttgggagccaacgttttctccccaactcctggttcactaccttttctcttaccttaacctttaccactaccacaaactaccacaaacgaacacaaacgaacactttaagcacaactcattttattattgggagaggtttcacaaataagttcctggtttccagttaacttgttgcaaagtttacatcctacccaatgtgactacatggctttaaagttaccagtggtagcttctgagtaaaattttgtttgtttgttcatgcgttaatggaacatatattaagtaccaacagtatgccaaacactggggaattcaaagatgctagtctctcaactgtttcagctgatgcttgactatcctctcccacaccctagtgtcctcattcactgcttcccaatactctacatttgaaaggtgattcccacaaatttattgcaatttagaccccatatatcaatgccgagatcgcgccactgcactccagcctgggcgacagagcgagactctgtctcaaaaaaacaaaacaaaaaaagagctgaagtgactcttctcatgccttcagcatgagaatattcccttaaaattggcatctctttttataagatgagctattattattttacttctacttttctaaataacagagacagcagacgaattagtaatggaaaataaaaatagtggcataggatatataatgtttgggtttacaaagaaaaaggggcatttgtgaaagatttgatatttgttaacataaacatgtcaatcattgttggaaaaagaaaaatatgatatataatcttgttttaaagtgtatgtataatgtataaatatttttggaataaaaatattcatctctttccctagagggagagtggctggatcagatcatctctttgaagttccagttctgtaattcaagcattttctttaaaaagctttaaaattaaaatgagaagcttaactagggtttatactacacatatgtgtaggatcaatatttttaaaactgcattcttaatatgttatgccttttgctctttaaatctgtgaaacaaaacatagttttatttgaagtcattaaaatatgaaggggacagagtaatcaatgctgttggttcttactgtattatattattagaaagcaatttgtgtattttgtgtatctgtcttcctggttttttataatgaaacatttctatctttgaaactacagactcaatcttgccaaaatgttcattttttgtatcattgttaaattgcatattgttcccttttggtgtactttagtagcctgttacaatctttttaaattcgttattcttaatcgacaaataaacattatatataatttgtcatgtaaaacatgatattttaatcacatcatggtaaatggggtatccatcccctaaagcatacatctctgtacccacaaaaattaaaaataaaagataaaaattgaaaaacatgatgttttgaaatatgtgtatgttgtagattcaacctgttataatcttaaaagtgattgtcattcttccaacttatatcaatagaacaactgtctatttgtcgttagttgagaccatcagggtgtagtgaaaaagctaatcaacaaggattcttctcaccagagctctgtcactcctctgaattgtggctgctagcctgttaattctccactaaacctttaggcatttggagacaattaagtctcatgttggggtttcctgggcttttttttgttttttttcaaacaaagataattaagtctcaaacttgaaacttgaaagatatttggccaggcagcagcaatgtactgagtataggcttctcaaagagatgaagtaatacaattagtagaaagaactatcgtgtacttaatacagttgctctctacttttctttctcaacctcccccaaaacaaaacaaaaccaagatgcttcagtcaagcactataaaaggactattaaattatcgcgaaaaggaatgttaagacagtctaatactctcattctgcagatgggaaagtagaagtgcacattgtaattatttttcaaaataaggtaaaagctgataattgtgtaaataagcaaaagtatatactttttccttaatcgtttttaacctaaattagtcttaattttgtgttattcctacagtgaaagaaaacatgcattgtcacatatcaggaaagttgtgcagttattttttcttctcccgaatattctgttggctttatgttccacatatgttgcaccacattaatattcaaacaattttagcacacgaagatttgtaacctcattttaccttgattagtgactcaactcatgttcttgttgtagggctttgaccagcttcgacttgaaggattgctttgtgatgtgaccctgatgccaggtgacacagatgatgctttccctgtgcatagagtcatgatggcatctgctagtgattacttcaaggctatgttcacaggtagtttgccttttaaaactctgaaaccacattaaaacaatatgaaaaatccgtgtttaaatcttttttatttctaacatgaaatttggttcttttggaaacagcttcaaaagaagtacacaacagtatgtatggttttcggtggtgctgttttaacatggaaaattgatgcacttttttcatactgtccatctttatctcacagcttttctttttcaagcttatatctagtgggccatcagagactctgtgtcctcctagtacaatctctactctatgtcaaaaaataggaagtgagaacattttggaagcacttgcatcatatatgacctccattagtatagagattatcttttttaagtactttcttttaacagtaaaatgtgcagcagactgactctaatatgactgcttatataagataagactttcctttgattttattgcatctaattagcagcagaagtgagtttgaccataattatccaccttcatttaattgaatgtctttttatttaaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtaagatattttgaaatctgatttttcctgtggtagactctgatgtagcctgtttaggactcatgaaatctgctgtgcaggaatgtgaaacttgccattagacagatgtgtcttgttgtatgtggtctgtaagcaaggtgagattgaaacaggtgcatttttatgaaatagaatcatttaataaaagcctctgtgttggccgggcatcgtggctcacgcctgtaatcccagcactttgggaggccgaggcgggcagatcgtctaaggttgggagttcaagaccagcctgaccaacatggagaaagcccgtctctactaaaaatacaaaaattagctgtgcatggtggtgcatgcctgtaattccagctacttgggaggctgaggcaggagaatcgcttgaacctgggaggtggaggttgtggcgaactgagatcacgccattgcactccagcctgggcaacaagagtgagactccatctcaggaagaaaaaaaaagcctctgtgtaatcaaatgacatgagatactaataatgtttgatgaagatatatactttaactgtttgataatggtatgtaccataatctggttttattcaccttaatgactatacaagcaggcttcttaaatgtaattgaatggaaaagtaatctgagcttctagaactctttaaaatttcttcttttaataagggagctagatcttaagaagaactaatacctatgggcaaacctgtaagaatgtaagtcttgattccatagaaacatatcacctactgaatagtgtttagccattttttaatagataagataggacacatacaactaccaatcgatggagtacttaatgatagtcacccagttcctgaagagagtgttttattttagttgagacctttaaattttacttctggggagataaatggctacattggacagaaatattgccaagacttccagaggtcttggagcttgtttttctgattaagaattctggcaatattaatttttggtatattttctaactcattatgttgatggatatgttttctataattttttaactcatatgaatcttaatataggtaaataattgctgttagatctttacaacttacattttttgaacatggaaccttctttaaaacactaagtttcaagagagccatgtccttaattattttattattaaggtacttaactatcttaaaagtcagccaataactaatttaactggcctattgaaagtgtgttttttgtatgtttgattttagaaaactcagactgctgtctcacaattacttataaaatttgaactaattgctacttttaagggtttttatggcagcatggtgctatattgttgacttgtattgtcttctttattgcgaaagtagcccaagtgaagttggttaattcccatgctattgcttgcctccattactgaatttaggtgctaaattttatttaaatttgatcatgcaaggcccattccctcaagagctattaggatctcacctctggttgtgtcactggcatgatataacaacttcatttcaaggaaaaatgaatcatattgaatgtgattttcaaaatgcctcaagtccagaatttaatttagtagtaacacttaaagcttgtacttatagactcttaacattgctttacactgatcttagcaacacatggtcatcctgagccaaattaaggaaagtgccatgatttctttggaactaatcattaacaagagacattgttggcctatcctctaatgcagaagtttagtacttagaacttcaggtattgattgtgatcaattcctttacctgaaagaaaatgaccaaactggataatacacaatacaaaaaagttatagtaatattactgtcacaataatagaaaagaattttgttctagataactgtatttaaagcaattttatttaaagatgagaccatagtcactttgtattgctaatttccagtaattagactgttggttccttaacctgtgttgaaacatttattataattgtttaacaatttagaaatgtcttcatttttataaacacttaatattgccttaaatatcatgttcattttttttttttgcatcctttgcagacatcctaaaacctatttctaatggagaagaggcttctctgtagcaaagattacttgtgatagagtttactcctacctctcagttttagaattttcttgcctatgaacttttaggaattacctcttttctttgcattattctaccttacttgtccttcatccttttttgcagaggatatgtctgtatggttttagagtagaaatctcttccctctcagaatccattgtaatttttgagaaaatctggcagatgattagttccaggaacatgcaaaacccaagttttcctttacccttctttcatgcattctgtttttttagttaaacctatgttcagtcttgctctatttatttcccctttccttctcagcaatcaagtgaaaaaggaaaaatagtagcccagtgtattttctacttataaaaactgaacatctcaagatactatattttttaaaggaggattttttgaagttcttccatgagctaagttattatagataaattttaatataatgttctcatgtttaagaacggtgtgctgaaataagatgttttagaggaaataggctttatgtttttaatgatatagtgatattatagttcacataatcaaaacactatttgggtttgaacttttagacagaaaaattcccttctaatacaattctgttctatcctattctcaatcatttgtgtggaggaagaagaacagtggtacgtaaagtgtgaatcagtaacagtggtatgtaaaatgcgaatcagtaaagaacctagaaaacatgtatgtattagttttaaatgataactctagatacattagtaaagccacactcacctttggtgggatagagataccagttttctataacagagcatcagtgttaatggaacaagagccaacctcccttctaactttgccatcatttgcagtgttacttagtggtttataggatgtggcatttttgtttttgctatgttattttcttggagttatggaaaagaggacaatgaaatgaatacagaaggatgacaatgaaggatagatatgaagcatggtaggtaaaaatttctgtaaaactaaaaccacttttatatactatgaagataatggaaaattgcctttgtttagtcatacctaaaaattacattggttttgtccttatgacattgtataactacaacatgttaaatactgtgcccattagctagtgtttttttttttgtttgtttgttttgttttttgaggcggagtgtcgctgttgttgcccaggctggagtgcaatggcaggatcttggctcatcgcaacctccgcctcccaggttcaagcgattatcctgcctcagcctcccgagtagctgggattacaggcatgcaccactgtgcctggctaattttgtatttttagtagagacgagctttctccatgttggtcaggctggtctcaaactcctgacctcaggtgatccacccgcctcagcctcccaaagcactgggattacaggcgtgagccaccgcgcccagccccatttgctagtttataagaaagttgtgtaagttttgtttatcctttgtttgcaatttgaaatttttagcatctagcatttgccccacggaacttttgttatggaggattttaggctagttcacaaaacaacctaatttaatgttaggttgctgaaatagggcatctgtaattgaactcaaaagattacaatttaaatatacaaatatatagaatgaacaaaacagaataaaggtgagaaagaaatcactttatgtttgtataaaagcattttttaacaagagaatgagatatgtcattgggctttagacttggggataatctttcttaaaataattttttaattgtgttttccccccttgatgcaggtagattactggtttcacctgcacatttgttatcagtgatggggtggagagcttacaatgaagtagagagaaagtttattgaggtgactggaggtgatgaagagttggagacaaaataaaggaggtacataagtgggaaggagacaagagagaggaatagggagaatatgtttctctcaaaagaaaaacaaaaagaatcagaagtcattggagaagacagttccttttgctttgcctctgttactaaattactgaggatttcctgcatagtacatatatttcacatttttcatttaatctaaattgtatttacccgtaaagattaacagacatgttttttaagatttttttttcacttttgagggcaatttaatgcaagttagagacaaattgtatagataattaaaattaaaaatgaatcaaaattatttccctccccaccaaaccagtcttgacttccttattgacagggctgatattgggcaaatagtacatagaaggccatccccgttgcttatggtcggccatccattctgattggttgatacccatcttttgtggtttttaaatattctaaatatccctcctataaccttgagcacccattcttgcctatctgctatctgggactctgtctgggaagaagaggcctagcctgggctcaaacctcttcaacctcacaaaagccattgtaataactaacattgcattcaataaaggaactgcattcaaagtgcaaataaatagagaattgaatattttgggctggagacaccagtggcattcacctcaaatagcatttagaaactgaagaaagacaaagactgaaagagagagaggtgtttattattcaattatccctttgttcttaccaaagtgtctcttctttgtgtcctgtgatggtctcatctgtggaaggaggcttgagaaaagatacctgtacattctctgcctgctgaagtaccttgttggatttcttcctagtcttattctgtggacatggtttcattctctgcattgattgtactagatatcaggctgtcattttaataaactagatagcaccaagtagaatttggcgcattgaatggctaaggagttccccaaatttttgccagatttcttagtctttgcatttcccttgagagtacaaaagcagatactggctggtccgagtgcagtggtgtttacaactaattgatcacaaccagttacagatttctttgttccttcttcactttgactgcttcactcggctagccagaaaaaaaaaaaaaaaagcagatacccatttttttctaaatgggaatttctttgtataaaacaccaatcttttaaaaaaagtcctagatttcagatgaaatcttccattaaaatagcaaattatgttaatgacagtgttttgggtacatcagttataatttgaatagtacagcagcagtgaggaccagtatgttattgagaataccacttgcaatattatgatgttggaagtgcctttaggatgactatgactgttgtttggttataaaagaataatttataataatttatatcaaagaaatgtaaatgagcagttgattattttaagaacaattttataggttcccacaggtgcttgaagagttttatccttttttgttgttcttttttttttttttcttttttttgatggagtcttgctctgtcaccaggctggagtgcagtggtgcggtcttggctcacagcaacctccgcctcccgggttcaagtgattctcctgcctcagcctcccaggtagctgggaatacaggcgtgtgccaccacgtccggctaatttttgtatttttagtagagatgggtttcaccatgtgggccaagatggtctcgatctcctgacctcatgatccacccaccaaggcctctcaaagtgctgggattacaggcgtgagccaccgcccccggccttgttgttctttttaaatgccaatgtagttatttggattaacttctgttataactctgtttttaagtgaaccttctttggaattgtggccaggttttcagatgaaataaaagatgaactcagatgaaatttctacttagaaatttttaaaataagctttaaacttcatattttatattttcaatgtgtattctattatatatgtaaattgcattataagtccaattatccatttatggatatccaattatccatttatccttttatgtatccagtggataaacaaacacatgtatccatttaaaaatactgtctaggcttaatgtttggagatttctagctgagtcacttttaagaatcatgatggagaagtggattaaaatgaaccataatagaatattatgtatttctctgggccattgtttactataattccatcagttttggtctatttatattgttaattattactgtagactttgcttctttaatttctatattctatgattaatttttaagctttgattacatatacttgctaagaattaatttcctattacatatttttcttgtctgtgtctcattttgaaattaataaggttttagtaatttgctacattaattcaacaggtatcctatttttaattgcatctatcatcgtatctttactttttatatttttgatacttgtagtatttagcctttgttgtatactcacagtatagtagctgttgtatatgagctatagaaaatacttagtcttgggtaccccataaatatatataccaactatgtgcctacaaaaattaaaaactgaaagaaataaaaaaagaaaatacttagttcttctgtcaagaagataacagttcggaaggttatggaatacctttctctggtgattttaaagaaaaaagtaggcagctatttgtattggttagatggtctgtcaaagtcttttctagtcttgtgtgtctgtatatatgaacgtattgatatacagaaggtattttccaaatgcctgtaaataaaatttaagtttctttctcatgttattctagcaatcgttttctcactggataaatttgaagagggaaaaggtgaaggaattaaataccttgatcccatttctgaattatacagtttggcttttaatctttaatcttgctctgttttacatgctataaatttagatttcagtttggtgactggcaactggtagtatcattttgtcttcttaaagtacccattctttgttgttttttagtaatcatatcaataatgatgagaatttgcatacttgggaattatatttgtgttgtcatcaacttttgcttaactgtactaataaacatcttcaaaagtataaatcaccttcactctggggacgagataattcttacttgtcttgggaagtgaattcatgacctcaaattccttccactcagggtgaattgggaaaacaggtattgactgtaactccatttacaaaacttaaatttttgaaccaccgacctgcagctcctcaaattggattaaatggactttttattaaccacgttagaaatccagggtatttatacagtgttatgctgtctatttctagagactcataatttgttaacttatttttctatttttttatgttacagttatgtgttaggtattttaaaaatatgtagctactaagtaaaataagcaattaaacatttttgtaaagcaaatcagctacttaaaagagcacaaattctttttgagtaataaatcaatgatagactggataaagaaaatgtggcacatgtacaccatggaatactatgcagccataaaaaaggatgagttcatatcctttgtagggacatgaatgaagctggaaaccatcattctcagcaaactaacacaggaacagaaaaccaaacaccacatgttctcactcataagtgggagttgaacaatgagaactcatgggcacagggaggggaacatcacacaccagagcctgttggaggctgggaggctagaggagggatagcattaggagaaatacctaatgtagatgacgggttgataggtgcagcaaaccaccatggtacgtgtaatacctatgtaacaaacctgcacgttctgcatgtatatcccataagttaaagtctaattaaaataatctatgaaaataacaatgtgtgtgtgttaaccttagagatttcagtgatattatatcctaactgggctgtcattttatgcggaggagtaatgtttttagctttgtttcagtttttaaagaaatgtcaacaggaggattattttattttctcttaaccatctgccaaatctgttaactatacaggtgtgaggttaacaatacattgataaagtttgtgtgatattgaggacacataacctgacaaaattttaaaaacaaccaaacatttaagtcttttgcctgtgatctgtgtctgtttgtatacatacacactggcattttttattgtaggcttgtttttgtggtttgttctttgtattatatttgctaatattatttttcctatttttcctttgatgagtcagttattagagcattgaaaagaggttctactgaggaaaggcctctctgtcacttctcttctttgtcagcttttcactttatggtatattttgctctatggtggggagatggttctgggctcatgttgacgccagagagaaacagaatgtgctgaaagtaagagtggctaaggaaagctgtgttgcccagatggaagcagtcatcacagataccaaaatctcatttacatgagagatttgttgtagatatacccctctgcccttaagaaagacatttccttgcttatatttccagataaataatgttgaaaattaatttgccctagggataattatcttattaaattattttcattatgagtgataactttgaaggaaccaaaatgaatgatagtaatgagtgatgcctatttacgtgaaagggaaatctagggtttgggtattagagcttttctgttcatggatctgctagctgtgtggtatttttaagaataatgactaagaagtggattgagatgaatcataatagaacaaccttctattttcccaagtttccatctggcaggaattttatcagtattttgggggtgggggtgggatacatttttgaggagagaagagtaactggtttggccatattccagttataacattgtttcttagagtagcttctaacttactgactttgatcattttcttttagtcagccttctagtggattaagtaaaggtggtttgcaaattatctgtttgtagatcattgatacatttagataagaatcctatttgtatctatttgaacattaaaagcataatttactcttattctagaacaggtatttgtgctatcaagatgtgattgccatgaaagtagtcatgttttaattttttttaattggcttaataggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcgtaagtgcatttatattaagcatagagacaaatttcttcactcagaaattcttatcaaatcataaaataagcagtcctgtaaaatcagataaaaatgtagttagggttttattttaaaactatttttctgagaaaatattgaagaccatctttatgccttatctgggcatatatcgttggcaagggaacaaattgtacgttacaaatacatcagtatattgtagcatatttcacctgtgcagtatatatggtcttcatcttgaaggttcatctaaagagtatacttagctcatttaaattataataaggtcttggatagaagtttggcatgttttctcattttctgcttttaaaaggccatatgatattttactgaacaggttacaatccttcattacagaaaactttcattgtttcttcttttacaaaatatgttacctattagtggccacaaagataattttctttatagattaaatgtacaaagttcaacattatccaaagtttgttcactgtgaatattatgatctatgactgttttaaaaataattctgttgacgtaatatcagatagttttcttttccataagcccatctggtaagctttatttgatggtcacctttttgtcttcccagtataaaattggtcataaatgtactttgatgtagaatactttggctatgtaaattaacccaaaaaggtaaaattttattatttcagataaaattgggatagtataatttttccaaaaataaaggcaggaagtccacattttatgttgtgacatatatttgtcattaccattattgtttggccttgttttcaattattttattctctattataaatagagtctgtcacagggaggggaacatcacacaccagggcctgtctggggttggggggctaggggagggatagcattaggagaaatacctaatgtaggtgacaggttgatgggtgcagcaaaccaccatggcacgtgtatacttatgtaacaaaacagcacgttctgcacatgtaccccagaacttaaagtataataatataaataaataagtaaataaataaaaaatacaaaaaagacagaaagacagaaaggaagaaagaaagaaagaaagccagatgtggctcatgcctgtagtcctagctgttagggaggctgaagcaggattgcttgaacacaataaataaataaataaataaataaataaataaataaataaataaataatgtccttgtagttgaccaattccaggctccatagagctgggaaagttcaaaatattggcattggctctggataagttcagagtaattctcagaatctttatttttcaatattctaagaaataaaagatagtttaatgtatttgagactaagctatttatcagagaatagaataactgttctcagcttttatactttcctgtttataaaaccctttcttgttagtgacatggtctttttcctgatcttttctacccaaagtttttttttctttgttgttacaatgatatttttttctaagaccagattttctagattgttggactatgtcgcatgatcatgaactgcataggttttccaatatattttaataattggacttttaaaagcagttaaggcataagtgtccttagtgtacaattgttctttaggcctcctcagtcaacctacacacattattttcatgttattatactattttaaatttgcggtatctggaaatatctagaaggtgcaagtagtgacttggttgtttcttagaaaatccctgtataagataatgttttcttaaatattttcttcacaaataacaggtcattaacttggtcagtcttcttttctcaaaggaagtagctccgtttttcaaagtcagtccttgcttgttgatattatcacccctgttaatatgcggctacttagctttcaatatatagttcctaatactaattaaaagccatattcttctgggagtttttaatcttcaggccaaggagagtcattacataaaaccaagatgctagaggcttctttctttgaacctatcccaactctctttcagctgctcctatggtatacccatctaggaactagaaatagaccacactgttgggcaagtggctcatacacaggaatccttgctcctgaccttcagaaaccacccctccatctctgattaaaaacagtcttctgtgtttcattttgaaagggaaaagaaacaaggaaatcatgcttttcttagggtattcctaaattcatatttaggctttaacaataaaatttctaaagcttaacctaaggataatgacttaaaaaaatttcccctctaatggtaaatataggtccattttaatcttatttcataaactgcatttaaaaaaaggcacatgtcattataatacaggcacaaaccatctattccaagaattctaattctagttatcatccaattatttgatattttattccatttgaaatgatctatagattacaaatctataatgacctcatagatttgtaacctataagtagctaaacttttgtagaaaatgattgcgtcccttaaaatcagcatacccatcaaacgcattctgtactaaacattttattatataatatattggaagtttaaaaaatattttgtgattgacttagtaagtgcattcaaatttagagtcttgatttcaggagaaaaaaggccaaaaagagtcattagataaagccaagaagcaagaggtttcatttgtttctgatccactccaccccctttgagttctttctatgttatactcaaatagaagcaagaagtagattgtcttgtcacgtcacatcctgtattacggaggtaaccaaacttgatgaaacctgccttgattactattgctcccaaagaataatattaatgaaatttcctgaattctatccatgatcgtgtttctctttatataaataaaaaatgaatttgtgttagttggcatttccagttttcttggacccattgtttttgcagaatagcagattttgattctaaagaaactcttgcctatatttctgaatgttcctgccagaaactgaggttttaacatttcccctaccctacaagcgctttttaaaaatagaattcctccttcaacgcacacattaacatctgttataataaattaacattcccattgtaactgattaagttgagacattcatatgcctatgtaaatagaaggaggtgatgggaatgggtggcaggaagaggggattgatgggaaagtcatttaacaatttaataggttgattagtaccagtatatcacttcatacacacagtaactattgcctgtatataattataaaaagaaaaatttgatgggtacaaaaatagttagaatgaattaataaggcctagtatttgatagcacagcagggtgactatagtcaataataatttaattgtatgttttacaataagtatgagtatatataattggattattcgtaacacagaggataaatgcctgaaaggatggatactccatcttctatgatgtgattattatacattgcatacctgcatcaaaacatctcatgtaccccataaaaatatacacgtactatgtacccacaaaaattaaaaattaaaaaaaaaacagtggcaacatttgcaagacagtttagatcactttaatgcattaggccttttaaaatctttccatggggtacttggaccaaaggaaacctaagcccattgttcatcaaaaaaagactgtgtgtgtgtgtgtgtgtgtgtgtgtgtgcacgcactagcacacgtgctcacctggtttagtgctgaaatataattccttcaaaatgctgctttcctttgacactggttacaatgggaaactaggggaggcttagagtagctgtcacttaagtgtaaaaggagtcagttatttctggcatctttcaaaattgtgtcatataagaaatcaatcttctattgaggcttcctatattgaagaagattatgacagctccaatatctttcacttcagttaaatattaataagttaaggtttcaaataatgaaataacttatagaaaacatgttagatgtttttcaaatacatgcacaataaaactactaaaatttattaaatgcctctataccccccaaaggatttgggggtttcttgatcactcaccagcgttctatgtttctagagtccatctcccctgtatgacagccatcactgtttaaatgattttctttaggctgatctctttcctaatcttaaagaacaaataaattccacatcctcttctgggaccgattctggattcctatggaattatctcagaaaataagaactcctgatatatgtgagataaccaacctaagtataattcttaaattggagagattctttaatgtaaacactaggccaccaaactactgaagttaattctctagattaggggccagcaaacttttgtaaagggccagaaagagtctatttccagctttgtgggccattaaatctctgtcacaagtaatcaactctgctgttgtagtgtaaaagcaaccctacataatccataaacaaatgagtgaggctgtgctccaataaagctttatttgtgaacatgaaatttgaattttatagaattttcataagttacaaaatagtcttgattctttttcaatgtgtaaaaaatgtaaaatcattcatatttttatcttttgggccctacaaaacaggaagtagactggatttggcctatggactgaggtttgctgccacctgctctagatttttccagttgcctctttaccatttccaactcttatagactacgattgaagcactgctttgtggctccaactctttgccttgcatcatcccttactccctcttcccatcagagttgttggtactaacctatatctgagtgtcgtgtaaatatggaaaatggaaataagagcatgtgtatctactttttaattagatgtattttattttaaaataaaatactattgattttactgataacaatagcaactctgcatggagaattgcatgacaataaaagttgacaataaaaattaaatgcctggaacagctaaaggagatgcatttttagctggaaaaaagcttaagaatgatggactattatatagtaattttgttattggtggttaatagctatcttgaactgagggcctcctgtgtgagaaagtacaaatggattcttataaccactattaggggaaaatgcaattaagtcactgacagaggaattatctttctacataggaaaatattaataataataaaaagtgaataagtattcaaattctaactccactataaaaagaataagaagaaactaatggaaatcacattggaacagtttgaattaaacataagaaaggacagttacaatccaaaaatttcaaagtttaagtcagagtcccgcattaagaaaagtgtaaaactatagtgaatcctgtctttggcttcaagcagatgaagatgatatctggaagtctttttagaccccgtttctgataggatgtgtggtttaattacttctaaaagcttcccattaatggctttgctaatgccaagtaccaatcaatgcactaggttttctcttatgtggcgagagagagagaaggagagagagagagagagaataataatgtaggattttgcttgtccgttaggtaaaagtcatgccaaaggcaaatagaaatgaacatttgaaaaggcatccagtgactggaaatagtaaaaaaaaacaacagtactggggcatgtggcagtttaacttgttattaattttagaaatagggtttaaaagaaatagaattggcaaggatccaggcctaaagcaatgaacaaagccaacaaagcagtaggtaaaaatgagaatagtaaaagcctttgaaataagactgaaaattcaaagctaaagtaagtggaaaaggaagtcagtagagagatacaagaagtggcatgatataggtgtgcttggaggagaaaagcatactttgcgtagtgaatttgatgatgaaatgaaattattgaatagagcggaaaagtagtctctctctctctctctctctctctcgctctcctctctctctctctctgtgtgtgtgtgtgtgtgtgtgttttgcctgtcaccatgttatttttttttaagtagagaatctcattcaaaggttgattcatcaggattgcatttggttgcaagtagctaaacctaattccagtggcttgatcaaattgtcctactcaataaacttctgcttacccgtcgctgcccagaactatatcatatggtggaccaaagcttcaagggaacctgctaaattaaatttcgtttttagcttggtgtagtgcttccctaagcagtgttgtggttctgttagtttaaaaaagtagggttgggggacgcaagaaattggattagcagttggcagtgtctgcaataaataatatgaacttttcaagtcaatctagacctcatgcttttgatgagttctcttaacagcttctctgccttttaaaaagtgattacattttccatctttcttggtgacattgttctgttcttgaggttataacagactgattgaaagatacttaagtgagttgaggtcacttctccaaaatacattatgttaaaagatgataaatacattactgacaggaagtattcttaataaagatcttcatattatgccgccaaccatcttcaggttaagagtagtactggctgcaatgatggtgggtatatacgaactattagctttaaagtataaatgtagagaaattattatcagtgtccattttgtagtctgtatatgaattaaagcagtgggcttcagaacataaaccaagaagtgtgtatattttcattctcaatgtaaaagtttgcttcttatgtattaacgtttgtttctatcaacatggggacccagaattgaggagtttttcatttcttttgatttttttcatcctttcttcctatgtttttagagcaaagaaaatggagaaatgtcaaattataaatatgtaagcagattacagaataaatcttagtgatttctgcaatgacagaaatttgttagattcttacactatctagtctaatgtaacatgtactaatggtttatattattaatatagtctcaataattactgtaagagctcccccaaagtcttacacatatctatcatagctataatagatatgtttcaagtgtttggatattattactgttccacttaagagaaaaataattaattgctaaatttgaagttaaaaataattttcttttctttttttttttaacagccacagtagaatgttacaatccaagaacaaatgaatggacctatgttgccaaaatgagtgagccccactatggccatgctggaactgtgtatggaggagtgatgtatatttcaggtaaacaagtatcatgtgaacacaatataatatataagcttttaactatatggttatctttccatatagtggtagtaataataataataattcaggcgtcaggagtttgagaccaggcgggccaacatggtgaaatcctgtctctattaaaaatacaaaaattaactgggtgtggtggtgcacgtctgtaatcccagctacttgggaggctgaggcaggagaatctcttgaacccagaagacggaggttgcagtgagccgagattgcgccactgtactccagcctgtgtgaaagagcgagactccatctcaaaaaaaaaaaaaatccagaaaaacggagaatcaaaatataatttatgttgattttagaaactatttttgtgtgtatttgcatatgaatgtcttgggcattctgtaaatttataagagtactagtaaaccaatcctgttgtaaggtataacttagaaaaaattggaaagcattcaaattttgctttccagtccccatgctctgtattctgataaacaccattcatagtttctgtagcaacaattaattcattttatttaagatttagctaaactatgtgaaggagtgtatcattatataacatataagttctcctatgcataaaacgtgcttccaatatgcataatagtacataataatgttcattctctctttcagtatagtccataatatgggtttccttcttccttagcattatagggggattctactatggtgtcattgcataaatatttctgtgctgattatctgtattttatgcacatgaagatatatttttctgttaaaaaattctgaaatggctatagtttgttcacagtgtcccagtagcaactttcattctcaaattgttggtgtttaaatcaatctactgtagaatttctttctttttttaatgcattttctgctttcattctcctgtagaatttaggaagaagtctcactttaatgtaatgaccacctctggtattgacatttaactttgttagtcaggttattatcatttggccctgacacactctgcctgggacaattcttccccatatgaaggcctgccagtgccaggccagcagttacattactagagaccaagggtgtaaaggcactatttgtgacctgattgaccactgccttatgaaatttttaatcaataagaatcaatgaaaggcctatagtatatgattggcaggtttctggtgttaaattcatgagcaactacagaatgtcttatattggaagagccatccaggtaataaatatgctcccattaatcaatgatttacaccatctatctattttatgtgggcagctgctgtaccattataatgagagctccaactcctctgagaaaaatgacacctgaattgttttagtggtgttttggcataactggcgtatattgcagaaatgaccttcccaatcaagagtggttagaaactatagctgattttcaaaacaatgaacactgttttgctttctgggaattctgtaaagcacaaggaaaatatttttaaaaagcagaaggaaacagtgatagtgattggcatctggccatttgacagtaaaggtttgaatgatttgactaaagattagcttacttctttcccttgtctacagaaggtatcgtttaatactttcattgtagagactggtttatatgtgatctaagagtacactttgtagatgatacagactaaattagattaacaacaaattggtgcatgtataaaattccacgtatattcagcattctaattctttagatttttaaatatgcattctgataagagatgacattatccaccctcactctgcccacagaaaactctataaacataaacaattctgaatattcttataagcttttacacatgtgcaagactttcaactttttcaaagcattttgataaatatctcacttcagagtcacaatcctgatgcaataactagagtagatattgttttgtgacaagtgaggaaatgggaacctggaatttaatgtgctctagcccagtgctcagtacccagagggtacccactaaaaggcagtaagtagtgaatgatgctttgtagttggaatttactacagacccaactctatcagtgatcaaaatatattttccttcagcaaagccttttaaataccagggatctacatttgagaaagtcattgcaataatgtaagtgattgcaaaaaaagtaattgttttgttctttaagaagatgaaaatgctattttctttacttttaatccagagaatgtatttatagagggaagacagtcctaagaacagtattgataaggtatatgtcataatatgtgactaaaagttatctgtgacagagctcctttaattacttttgcatttctataattatttacttcaaaactattgttttcattctttaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgt

SEQ ID NO: 3647 - DNA, 219526 bp, human
tagaagagtgatatttgtgtgagagcctgggtcaggcttattttgagacgtgggccccactgaggtgaggtggcaccgcttccagggcacaccctttgctcgggccccgccgtgactatgaggaggccgaggccacggctggcagaatgcacgggtggacctccttggagtggctaacccggggcggctgcactgttgtccctggatacttgacacttttcactttttctgcctcccggcactagaatccatgtgggctcacaccagagcctcccggtttccgaggcgtgagggccacttagcggtcattcagcttcagggtccggccctgtcacgctttcgctacagcctgggagttccgttcggaccccacacaccgtcctagccccggctccccgccaccctgcctcccgcgcaggcgccgccggggccacccccgccgccatgtttcccccgcccgcgcgctcccccccccactgccccctccctccccaactgggttcccgcccccctccctcagcagcccccccacaccctggtgaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaaggtgaggcagggtcctgaagtcacaggggctccagcagccgcttccctgccttcggacccggcgctgcgcggtgcgcggcgaggagttgcgatctgtaccaggggcagaggagcagaggagcagggaaacagcttcattttgcccgccgccccctctttttctcccgcgtgctggtgcgcgccctcatccttacaccttcgcatccctttctgccggtccctctggctccgtcggacgcctgggttcttctaggaccccagaacccggctttcctgtgcttctttgtcatctctccaagatcttctcctctgggcctcgctgttgctgccctgacggtctggggtcccgctgcccgccccggccctactgtctcttgccctctaacagtttctgctttgtgcctcctaatccatctctccttcagaatcttctaacttaggaggctcctctgctggctcccaagtcaggagcacactcctcttcttcctcgaagcttttaacttagctctgaatgtcttcagctctgaatattttgacttttttgtttgtttgtttgtttaattacagttgactaatgattttcttggaggcttatagtctaggctacagtttactgaaagtgatgagatcattccttcactaaatagccttagtaaatatcaactagggaactttaaagtttctttctaggtttcattaacttagtccaagaacaatagccacttaaaatgtatgtatatatgttggtacgcaatcttcgtacatggtcctaaatctgattcttccctggctgctgagcaggcctgagagagaggattggtgggaattgtgatgcctggctccatttctctaattgtaaactaggatgttaatcgttttaatgtagtcagaggactttagtggtttgggataaagtcgctcaagttagcataggctggtaactaagcacattgaatggagactaagagacgctgggatttaaaactgtctctggagggcacctgctttcttttttttgaagccacagtttcttaacagtagatttcatgtttgtataaaccctctaaaagcagcatattttaaaaccacgtagttacaaaaaagactactcactcttagcgatatcgctttctccccatgtagttgtggtgttagctcccatactgaggttcatttgctcactttcatactgcaattagtgtgtgaagaaagctgaatggagaagcacaaagtggaggcaaataccagtgaacaagcacatgctgacatacgcagctgtgtttttggaaatagactgtatctagtgttcaaatttaaaaactgagaaaaatgaaataattcagcatttatgacatcattttacatctaaaaatattagctcccttaactgcaagttcttattaatatcctcatacttaacggtaaaagagttgtttgcctgatgtatgaccaagtgttgccattgacacagtgtgcactaattggcagcaatctcagaagaaaccaggttgtgaatgaagataatggctaaatttcactgtcctggtagcacgtcttatggcagtgagatgagagtagtttctgctgcaacatcaaatgatgtatttaaaaaacagataaataagagcttcaattattaaaaagcccaaggttttcaatctgccatttttataagcacacttcaaaaagtgtagtgtgattatataaggctcagttgatgttctgaagaaagtagttttcacaagaaaagtaaggcctattgcttatcaatttagttagataacttgcagatgatttgtagtttcccaattgatttggtaaattcctgagtttacttgaggtttattaaaaaatggaatgtagtagggaaagggtacttattctaataggcccactttctaagtctgtaattttcttagcaaactattctcaaaatacataaaaacttacaactttttcaaggaaaagagtttatactattttcttacttttttcttttcatgcttattattgatacaaaatctaagctaagattgctgctaatgtgattgcatagtaagactatttatatttgccaggaaaagaataaaggtggatgagttagccataagcattttgctctgaatcttcaatatgactcaatatgtgtttgatagtccatctggtacacctagaggttagcagactggatatttctgatattactaaatgtaactgcacttacttattggattatcttctttctcattttatgtacatttcaaattatgcttcttcatgtaatttgacttgcagtagtgaaatgagactgaccaattttcaaattgtttgatttttattgatgtttgataaaccactaaaacctcttgaaaatatttttttcttaaatccactgattgaaaccgatgtatttttattgctatgaaataatacaacaaatttccaggaattatttcagaaaatgtggaaagactgtagagaaatgaatagccctagagaaaatatctcaaaattataaaaatggctttctcaagttactgatattcataacaatcaggtttttatgtatcattcattcatttactaattcattttacaaaatctactgggtacttgtgtgccaaggccctgtgttaggcacaatgataaaccttataaggcatgatctttgctcttgtggagtatcacagtgcttatattctaccagagaatacagacaataaacgagcaaacaaatgaagaagatccttatagactgtagtaagagcaatgaaaataagtaggggaatatgatacagatagctaggaagggcctactttagtgtgggaagtcagaaaaggcctttcagagaagatgattgagcagagacctgaaagagaagagagaataggcctaccttgtcaggatctgggagaacattcccgagataacattcttgcagagagaagagtaagagccaaggccttgaggggggaaaaagagacttggcgtttttgaagagcagaaagcaagccagcatggcggattaaagaagatgttacagagcctagaagcagctcaataaccgataaataggacttggaggtcctgagaaagaatttgggtttgattctcagaacaataggaagccactgaagagtctttcctggggaaggtcattggcttaaaaaaattatccagggaaatttaaaaaaaaatgttttgcagaggataaatagaatgtctactcattcagtcatttatattaatacctgagaataaaaaaaactctatgatcagtatgctaaataatcatgtaattcggttcctctactctgtttaggtaaggggatgggggaatgggaaccctgaggtgagtatgttaaaaggcagtttactttccactgtcacattgtgacttgtgctacaaggtaagttgtcaccaactttattaaaaatcagatcattgttcaacttaagaatttatttttcaaagaatgatatcttattttctcatggaaatatgtttcctttggaaggttggaaattttattttgtataaaggaataacctaggttttagaaagggcctttggaattttaagaagggcttatcattttcttttacctgttgcctctccaacattttcaaatggccatacctttattccttgagagattagggttactgtgtttcctgaggcttaaatgaatttattgccctaagcccttccttgaaagcaatccagctttgaggtctagttggtcccaaataggaatgcagatgattattgacattccataggagtaaatcctaatattgtgggggaataacctgcaaaataaccttcatcagtgcctgcagggtcaacttgatttgatcccagcctactttcccatatgtccttattattccctttcacaaatctctattggtttaaactgattttccccagtttggaacttttgtgcttagcattattcctggcatagagtacgtgcacagtgggtgcttgtcaaatggatgccatgcctttcttttttgtcatttcaaattccaggtcctattacactattccccattgaactagatctccccctctgaaggtgaacagcagtcacacacttgccctgttgtgtcataattatgcttatttgatgcctggccatctccccacttgcctctggcttcatgaaggcgacctagacctcatccggtttgctcattgttgtattctgagcacccagcacatggtatgcactttataaatagttattgaataatgaataaatactgtcttgtgatgtttctcctattaattttttgatgttagatcatttaatactgttttacttttcacgtgtttggtgttccgaagtggtttctgagagaggttgtagagcatacttgttaagagctcaagctctggagctaggccacctaggtttcaattccagctaggagacttaatagttgtgagacactgggtgagtcagtaaacctccctgtacctcagttatctcatatgtaaaaaaggggtaatagaacttgcctcttatggtacttgcaaagattacatgaattagctaggcccactttttcttttctctttttctttttcttttttttagacggagtctcgctctctcactctatcgttcaggctggagtgcagtggcatgatcccggctcactgcaacctccgcctcctgggttcaagcggttctcctacctcagcctcccgagtagctgggactacaggtgcgtgccaccacgccaggctagttttttgtatttttagtagagacagggtttcaccatgttagccaggatggtctcgatcttctgacctcgtgatccacctgcctcggcctcccaaagtgttgggattacaggcgtgagccactgctcccggcctaactttttatttttagtggagacagggtttcaccatgttggcgaggctggtttcaaactcttgacctcaggtgatccacccacctcgggctcccaaagtgctgggattgcaggcatgaaccacctcccccggcctaggcccacaatttgtttgcaatttttaaatttctaaagctctgaaaactgaaaaagattttatttggtaacttagatgccaaaactcatgtggtggcaaaacctgacttaaactgacatagggtatttatagtctttattctacttaatgttgatctttattttgttttgctatagaattactaatatgtttatggggttgcaccatagaccctaatggtgtattacataacatatggtatataaagtatatttcctgtctaaaggtctggacatttctaaattcagaaacacatctggcaccaagatttttcgatgagattgtacaccttgcagtaaactgcttaaatcagggccttgcacatagtatgttgttgctgtgggtggtggagattagggaggtaaataaactactttatctttcccaatagcttgctcataatagttaccatgtaaatatatactgatttactcatgcaataactgtaaatagaggactggctgtgtggttctcatgtcataggaaaatagatatggcagggtcatgtaattgaaatgagccaagactcgtctgttagtactctcatctggtaccattcagagcagtttagtttttgtttttctgttgttatttaaaccaacctatgcttctttagcacaagagagtcttttgtgggggtgggggtaagaaattcagttaagaacttatttaatgtgattagacacttatttttttgcagttgttgaacatttattgaactgctaatgtgtatagaaatctgtattaagagcaagagaaggccgggcatggtggctcacgcctgtaataccagcacttaaggaggccgaggcgggcggatgataaggttaggagatcgagaccatcctgaccaacatggtgaaaccctgtctctactaaaaatacaaaaatgagctgggcgtggtgacatgtgcctgtaatcccagctacttgggaggctgaggcaggagaatcgcttgagacagggagttggaggtttcagtgagccaagatcgtgccactgcactccagcctggtgacagagcgagactcagtttcaaaaaaaaaaaaaaaaaaaagaaaaagaaatagaaaagtagaaaagagaaaggtagaaaacaaatgagacatgattcctgaccttccttagccccagcgccctgcatggttacatggggacatgagtgtgcgttacaattctttattttcctctgtaaacttgacatcattaagattaaaaacatgcaaaggaaaacccaagagttaattgaaaactcttcttagcgtccatgatatgaattgggttttaattatcctaacacaacccccctcagtattatctttatataacatcttgacagccttttcctttctaactaaactaaaacaacatggattttcttgttctttaccaatacacaattggtgtattttcttttgtttttggtagagatgaggtctcactatgttgcccaggctggtgttgaacccctggcctcaagtgatcctcatgctgtggcctcccaaagtattgggattacaggcatgagccactgtacctggcctgtttttttttccttcggttttgtggggttgccagtaattacatgtctcaaaggattttttctgcagttttcttgcagttgaaaactagtccttgaaactattctgccaattcattcaacaaatacttattaagtgcctattatattccaagcattgtgctagtctaaacaaatagaatctctgtctagtgctctttccattactttgggtccttcaaagtggagcacatgtactgattgagcagggtggtgacaaggtggtgctcccaggagccacaaaataaagcagcttgtattttcttgaagcatctgttttacacagagatttaggagaacattaactggtagctatttaaaaatctttaaacaaattcagatacattctgccttagaacgcaatattcatagaaaatctgaggcaaaccccaatatttcagagaaagtctctgcttgcaagggcagctgtggtaaccctgagatgaccctttggaaagcactgaggtggtgctgtactgcccgaatctgttcttttagtcaaacacccaaacattttcatagccgtaaattcccatgatgacctgtgggaaagttaatggacataaatgtttttctctgttgcgcaatttcaagggtacatgttggttacccttggtctaatggtctaaatctaaacatgtgttgagttcttacagagtttttaatgttggtgggtaatggctaagagtgactatgaaggacctgcctagggaatgatattttcagaatagaggttattaggcctgacgcagtggctcactcctgttatcccaacactttgggacgcctaggcgggagcattgcttgagcccaggagttcaagaccatcctgggcaacaaagcgagaccctgtctctataagaacaaaaaaaaatttaaaaattagctgggcatggaggcacacgcctatagtctcagctactcgagaggtttaggcaggaggatcccttgagcccaggagttcaaggttgccgtgggctacaatcacaccactgctcttcagtctgggtgacggagtgagaccctgtctcaaaaaaaaaatctaaaaaaatttttaaaaaaggctagaggttattagaacacaaggaccacaaacttaaagcagcacagttcatggtgtcaaagctttgccttgttctgtgcacacttgcctgtctcactgatttgaagttcacttttgctaactttaaagctgctttcatttacagcatagtatacaaattggtttgttaattgctggccactgaaatagttaatactagaagaaagttgtcaaggattaagtgctttgaggttgataaaaggtttctacagtttgagatggttttgaaaataggccagcagagcattggaggaatgcctgttacaacgtgatggtttaatttgctccagatgagaaagatgaagaagaaaaaggcaagtgaagaaagggggtgaaagtaaatggagtaagtcaaacactaaatctttcaactgattttcattattgcagtcccactttcattgttgttgttccatgccagacatagttcacagggcctgacattgttatattgttgtgttactgctcaaatcttgtaaggacatgggtatagaggattgtgattagtggatggtctttatcgtctacaggtgaagtgcttttacagtctattcagtaaaaggagataagagttttgcttgtagtttgtagagttttctttcttggtcccacttttaaaaaaatggtgatacatttctaaagatcacttcatttcaacaaagttttctgttccactcttggatgtttcttttttcttttaagacagggtctcattctgtcactcaggctggagtgcagtggtgcaaagtcaaggctcactacagcttcaacctcccaagttcaagtgatcttcccacctcagcctcccaagtagttgggactgcaggtgcatgccaccacgcctggctaattttatgtattttttgtagagacagggtttcaccatgttgctcaggctggtcctgagctcaagcaatcctcctgcctcagcctcccagtttgctgggattacagacatgagccactgcacctggcctcactctcagatatttcttagtggaaaggcagtagagcttaatggctatgatcttgaaccctggaatcataggcttgggttcaaatcctgactgccttttgttgggcaacttgcttcacctctctgagccttgtttatctcccttgtaaactatctcatctagtttaaggattaaattaataatgcgtatagagtgctaagcacacttaagccacatatgaaatataactatacttattattattttcatagatttgtggctaaattagttgataacttggagcatactataggaccttggccaatcatatatgaagcagaaatgtgaggggaaattgtgtgtcttctttgtttatattgtcttaatcctagctggaatgctatttttcgaatgtgcatctcgtaaatggtgagtagactgtttagaagtaacactagttttctggcagacaagaaagtttatggtgaatgttggcttattacttactcaaatatggcatcacattgattccaagaaaaatgtcagtttttaatacaattagcccaatatatatttaaatgtgatactgtttgggttaataggattttaaattttaatatccattttgaaggaaaagggttatgcaggataatgtatactatgaacaatgttatcttttaaacatgaaaacatttggttttctgataatcacaggggtcacacatttttctgatttatctctaattgttccagattttaagtccccaaagaagaaaatactgaagcatttgtaatagttaagccattgggaagaggtataattctgttgtgaataatgtcttcctatggattttgagttgttatggttatttcaagtttttatcatggttactgtaataacaaatcaaataataccctaagagaagataaaagtttgatagtacctttgataaatgaatggataagtctaaatggagtattgagaacagctttaggtgttagagggatagactaatcttttaagttgagagtacatgaatctacctttcctactttcttacatgatgccctttagttccaatgtcagacaaatgatgagagagataatccttggtgatgaaatgccacaggtgcacagaagggaaaagaccaggtaacatattggtcatatactgtatattcacaggtttttatgaccgttattaagataatgtatattcaagtgcttgaaaagcttagctcactatattgatgaaatatattatttattagcagtgatgtctacatttataaatagtgatcattctcagtatcatttgatgataaaaaggcagtattcaaatttatatattttttagaaaaattagacttactctaccattaggtcattagctcaaaccttaaataaagataataccctttatttttagagcatctttcttttgaagcatgattaactgttcttattctgtttattcctgtggaatatgcacaatgagtttaagtaaattgcagaagggttacatcctgtgaggtggagctaagagtaggcctttagtttctaatccaatgcttttgtactaatgatataaaaagctcttggccgggcgcggtggctcatgcctgtaatcccagcactttgggaggccaaagcgggcggatcacgaggtcaggagatcgagaccatggtgaaaccctgttctactaaaaatacaaaaaaaaaaaaaaaatagctgggcgtggtggcaggtgcctgtagtcccagctactcgggaggctgaggcaggagaatggcgtgaacctgggaggtggagcttgcagtaagctgagatcgcgctactgcactccagcctgggcgacagagcgagactccatctcaaaaaaaaaaaaaaaaaaaaaaaaaaagctgtttagaccaaaggatcctttaatatctgtagcctttcaattgatggggttaaagcaaaatgtcagtaattgtgatagcaatttggtatttatcaaaatgagttttggattcagtaagaattttataagtacttttggtatcatataggtacagtatccacgtgaacatttatgaacaagcaattatacgtaaagcactctactaggagggagaaaatgtattcactgccctgaaataggttacagtcttgccaggggcaacagagaacatgagtcaatttgatatcggccaatactaatattattaccaagcagccagtgactaataaatcattattgcactcattatgagcctgggacccttccaagtgcatctgatgcattgatacatttaaaccacataacaatactatgaggtagaaactattattagccccactttacagatgaggaaactgaggcatatagatgctggataacttgcctgtggttacacacctaatatgtataagaactaggagtaaaatccatgtagtctgattcttgagtctatgcttttaaccacaacacttcctttcatgctatctctgacagaggccattatataacagagcatgatatctaaaaaaggcatgttagaaaacagattctagagaaataaagagaaatgatcagatgagggtgttaaagttggaaagatagtttgaagaaggcacttttaaaggaggtcttattgaaaagcaaggaacgtatttctgaatatttcaatgctcaaagctatgtgtacatatgtgcatgtgtgtgcacaggtgtgtgttggtatatgtgtgtgggcgtgtttattttaaactggaaaaaaactttagaggttaaaacaaattgacaatctttttactgacagctaatcagagctctgtttttgtgtacaatattttgacttcacaatcctgtgtcgaaaaaaatatttaacggctttattaagatataattcactcatcatacaatttacctgtttaaagtaatataattcagtaatgtttagtatactcacagagctgagcaactgtcaccacaattttagaacatttttatcacctcagaaagagaaatttgttttgaaacaaatgtggccacaaagaggatggaactagtgtgtctgttggtactactgcttgtctatcaaaatgttcatgatttatgctcagtctaacacagacctcatgctgtttttctgcagtctagctccaaattgctgtagagctcctcctcctttgaatttaattttgatcggtgacagtctttcaaggcagtatgtattgatctaattttgaattctcaattcaagttgattgtatatttgtatttgtcataaaggtattgatcttagttctaaatagcaaagccagactcgtatttaaaacaaaactgctaaacccactagtatgagtggctacctccttgtctgtgtatgctctatagtgggccagagccaaagatttctgagaaattttatgtgtatacactgatatttttaattacttctaaaagttatacctgatataggttactagtggacagatgattgaggtaaaagcaactcctccacgccattttttttggctggggcatagtattggggtggtgtgttatggaaaatgtcttttttttgagacagggtttcattctgttttctaggctagaatgcagtggcatgatcacagcttactgtagccttgacctctggggctcaaatgtttcttccacctcaacctcctgagtagctgggaacacaggcgcacatcaccatgcctggcattttttttttttttttttttttttttagtggaaatgaggcctcggtatgttgcccaggctgttcttgaacttctgggctcaagtggtcctcccaccttggcctcccaaagtgctgggattacaggtgtgagcgactgcatgtggctgaaaaatgtcttataaaatgtattccatgatactatgtacagatagtatgaaataactggaattaaaaaaaattcggccactgacttttcagctatttagggttcaaaaaagatacagttagtgtttatagtcaaggactgtgtttctgtccagtgggagttaccaaaccaaatatctctgtgtgtgttgggggaggcaggctgttcccaggtcttcattaaagtaataagctacagtcagtgttatctttcagactaaataattactatttcctttctattattaaaaaatgaccttcagacataattaaatgtcttaaagaacataggtgtcttttaaaatgtgttaatcttaggttgctctctttttcttcttacaatttttcttacttttaattttaccgaatttttctttcagaatgatcttgaaatgtcattttacactttttcagtatttttaaatgcctattatctacttgggttgtttctactcaggggccaaagtagttttagttgaagttaaagtgagttgataaaatgatttcctgtgaatcttaagtaaagtttttatttgcatagatggaatttctgctttgccatgtatggcaaaaggtgtggtgatctcacagctagtaggtaggataaaatcaattaaggtggcactgctgtcactagaataaaaaatctatgcatacctttatattaattagatgaaagctcctctttatcactaagctcaacagttgacatcacctggagtcagggagtcaggtgccgtggagttaaaaacagaaagcatgctcgatttagaaattctggcatatatgtatgatgctaccttttctcacaactagattttggttattaagccattgtgatattgggctatgttaaaagacattagaaacctgttcatttaagacaagccaaattggtctgatataagagggtcatgctgaatgagaaagtatcacataatttaggagagaggattttgagtaatgtgaatattgagttttctgtgacttggtatatcatttattgattttaaaaaatgaacccattacattatactcataaactattacttcacaatagtttgattttctgcttaaatcagtgcctaaaatggtaaagtcttaaatggtttagaatgactctgcatgtaggttaggtccatctacctgttttatatggggatctgctttatctgcacataaagaagattcgctagctttaattagccttactatgtagggcagcactttctctaatgagagaaaatgaggtattttacacaaattaattcaacagaaattagtgactaccttctttaaaccaggtgatggggatgcagtggtgaacaaagttctatcttcattctatgaggtactcacagcattatatgcactctctttgttcttttctaagaacattccattcaaaggaataggaaaagtggcaggagaaaacacactcctttcctttaaggatgtagtttagcatttgcacacatcacattcacacatatcccactggccagaacttaatcctatggtgatacctaagctggaaaatgtggcccttcactgcatggacaagcaaaaataattattactatatgagccgggaagaacagatattggggaataactaatagtctctgctatacattgtccctaatgtaaacctttaatcattcatcaatttttgacttatctggagatattatctctatgacatcagctacacatttgcttcatggtaaaaattaagacttctcagcagagtatacaagtccatcatgacttgactcctgcctgtccctttagcacctctctcaccccatccaaagttgcagccttatggggactacttggacttccccaaactagccatgctctcttaccacacatttgtacttgctacttgtattagtttgttttcacactactataaagaaatacccaagactggataatttataaaggaaagagttttaattgactcatagttttgaggggaggccctcagaaaacttacaatcatggtggaaggtgaaggggaagcaagcaccttcttcacaaggtggcaggagagagaagagtgaaggaggaacttctaaacacttataaaaccatcagatctcattagaactatcacgagaacagcatggggaaaactgcacctgtgatccaatcacctccctcccttgacacatggggattacaggtccctccctccacacttggggattataaattgagatgagatttgggtggggacacagagccaaacgatatcactactcatcctaaactgctgcctactttttgtccttgaggtttcagtttagatagcacctcttctaggaaggttttcttgagcctcctgtacctcacacccctgttatgtgtttctttcatgtatttccatagtattgttcatgactctctttagcaacctgtattacaagtagtgtttttccttctctgtctctctccctggattatgaattccttgaggacaggggctaactcagttatctgtattgtctgtcatgatacctgctccagagttgagtttacttaatgtttgttggtaagaaaatgaatgaatgaatatttagtttactaattatgactccttgattaagatgtcaactcttcctatttaccatctggaaactgcagtacttagagtattttccagtagctaggactgggtaattttgtaagaggtattgataaaataaaataatttgaaataaacatcagatgattaatatatgaattatagaaggcacaaacaattgatgtgtaagagttaggaagagccctagggatcatttaatccaacccttctagaagattttaaaaggacacacgactaatatatagagagaagttaaattacttgctcaagggcctccactttcaaggatcttgcaatatcgttaaacagatgatatgtatagacatgaaagaggtgattgagaaaaaattgccgaaggaatagaaatgattggaatagtcagggtaggtttgatcaaggatcttggctttgcagtgagccttggtcactgggtaggattttgatatgagaagacattcaagatataggcaatgtataaataaaagtggaaagacaaggatatacgggagaattttgagatctctttagttgagtgatatttagtagtaagagagaatacagaaaaattgggccagaaaatggagggatttaaataccaggctgctgagggaaaccattggcagttttaagtaggcgagtaatacagtttttgtatgttgtatctgactgataggtgggctgggttgaaggctgaatgggtcatgaaactggcatattgtctaatgtgccaatttaaaaatatgaacttaatgggttctcgtttttgctcaaaagcaaaaacatgatatactatcaattcccatgataattaacataacaatatcagtgtttttcttaatggagaaagtgagtgtaagtagcaagcttatagtattagtattgcatatgtattagtcatgacataccatagataattgtataaattttcacgttacgccaataaactgtaaaaattccagaagtaactgagaacgtggtagcagctgcagcatcggcccatgctattttgccagccattcggagactgcataaattaactagtggcatgaactctcctggtgcattttggagccattttattcaaaaattgttttgtagaaagtgaaaatgttatactgtattttggcaaaaataagaagaacaataagcagagctctctttagtgtattaagcatcatctaaaaatgaaaagcgtgaggggagaacctttacttcatgtgcctgtgaggaaattttgactttgtatagacaaaaagtatgtacacagagaaagatttgttatataaatagtatagctcatttgtatagtcaagggtgtcttcctttccttccttccttccttccttccttcctttcttccttccttctttccttccttctttccttccttcctttcttctttccttccttccttcctttcttctttccttccttcctttcttctttccttctttcctttctttctttgtgacagagtctggctctgtcacccaggctggagtgcagtggcaccatctcagctcactgcaacctctgcctccagggcttaaggaatcccccaccaagttgctgggactacaagtgtgtgccaccatgcccagctaattttttttaaaatttttattagagacgaggtgttgctgtgttgcccaggctggttggtctcgaactcctggcctcaattgatccagctgccttggcctcccaaagtgctgagattataggtgtgagccactgtgcccagccgagtgcatttatttaatagctgtgtacacttggacttaactcatggctttaacccatggctggctttaacttagccttttgaaagtctataagtttatagcttcagacacatattaatacttactttttaggacctaatgaaaacagtttatattatcatttgtctttctactaggagttggaaggaaattttcagtttaatgaagttttaagttatattaatttgagtctagaaaatttgtacaactttttttgggaaaccttcaaaagtatttgtttcagatggtgtaaaatgaaatgcataaatacctatttccataatatctttgtacttgaaaataatataaagttaaccttatgtacccttctgaaaattaaaagcatttaataaagtataatttttttaaattttattattattatactttaagttttagagtacatgtgcacaacgtgcaggtttgttacatatgtatacatgtgcaatgttggtgtgctgcacccattaactcatcatttagcattaggtatctctcctaatgctatccctccccctcccctctcccccctccccccttcccccaccccccttcccccaccccacaacagtccctggtgtgtgatgttccccttcctgtgtccatgtgttctcattgttcaattcccacctatgagtgagaacatgcggtgtttggttttttgtctttgcggtagtttgctgagaatgatggtttccagcttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgctataaacatacgtgtgcatgtgtctttatagcagcatgatttataatcctttgggtatatacccagtaatgggatggctgggtcaaatggtatttctagttctagatccctgaagaatccccacactgtcttccaccatggttgaactagtttacagtcccaccaacagtgtaaaagtgttcctatttctccacatcctctccagcacctgttgtttcctgactttttaatgattgccattctaactggtgtgagttggtatctcattgtggttttgatttgcatttctctgatggccagtgatgatgagcattttttcatgtgtcctttggctgcataaatgtcttcttttgagaagtgtctgttcatagcctttgcccactttttgatggggttatttttttcctgtaaattttttgagttcattgtagattctggatattagccctttgtccaatgagtaggttgcaaaaattttctcccattctgtaggttgcctgttcactctgatggtagtttcttttgctgtgcagaagctcttgagtttcattagatcccatttgtcaattttggtttttgttgccattgcttttggtgttttagacatgaagtccttgcccatgcctatgttctgaatggtattgcctaggtttccttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgttttcctccagtttgtcaaagatcagatagttgtagatatgcggcgttatttctgagggctctgttctgttccattggtctatatctctgttttggtaccagtaccatgctgttttggttactgtagccttgtagtatagtttgaagcaggtagtgtgatgcctccagctttgttcttttggcttggaatcgacttggcaatgcgggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttctttcatttgtttgtatcctcttttatttgcttgagcagtggtttgtagttctccttgaagaggtccttcacatcccttgtaagttggattcctaggtattttattctctttgaagcaattgtgaatgggagttccctcatgatctggttctctgtttgtctgttataggtgtataagaatgcttgtgatttttgcacattgattttgtatcctgagactttgctgaagttgcttatcagcttaaggagattttgggctgagacaatggggttttctagatatataatcatgtcatctgcaaacagggacaatttgacttcctcttttcctaattgaatgccctttatttccttctcctgcctgattgccctggccagaacttccaaaactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagcgttgctgaattttgtcaaaggccttttctgcatctattgagataatcatgtggtttttgtcgttggttctgtttatatgctggattacgtttattgatttgcgtatattgaaccagccttgcatcccagggatgaagcccacttgatcatggtggataagctttttgatgtgttgctggattcggtttgccagtattttattgaggatttttgcatcgatgttcatcaggcatattggtctaaaattctcttttttggttgtgtctctgccaggctttggtatcaggatgatgctggcctcatcaaagagttagggaggattccctctttttctattgattggaatagtttcggaaggaatggtaccagctcctccttgtacctctggtagaatttgtctgtgaatccatctgatcctggactttttttggttggtaagctattaattattgcctcaatttcagagcctgttattggtctattcagagattcaacttcttcctggtttagtcgtgggagggtgtatgtgtcgaggaatttatccttttcttctagattttctagtttatttgtgtagaggtgtttatagtattctctgatggtagtttgtatttctgtgggatcggtggtgataccccctttgtcattttgtattgtgtctatttgattcttctctcttttcttctttattagtcttgctagcagtctatcaattttgatgatcttttcaaaaaaccagctcctggattcattaattttttgaagggttttttgtgtctgtatttccttcagttctgctctgatctttgttatttcttgccttctgctagcttttgaatgtgtttgctcttgcttttctagttcttttaattgtgatgttagggtttcaattttagatctttcctgctttctcttttgggcatttagtgctataaatttccctctacacactgctttgaatgtgtcccagagattctggtatgttgtctgctttgaatgtgtcccagagattctggtatgttgtgtctttgttctcattggtttcaaagaacatctttatttctgccttcatttcattatgtacccagtagtaattcaggagcaggttgttcagtttccatgtagttgagcggttttgaatgagtttcttaatcctgagttctactttgattgcactgtgatctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctgttaggtccgcttggtgcagggctgagttcaattcttggatatccttgttaactttctgtctcgttaatctgtctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgtatgtgagatgcatttcctgaatgcagcacactggtgggtcttgactctttatccaatttgccagtctgtgtcttttaattggagcatttagcccatttacctttaaggttaatattgttatgtgtgaatttgatcctgtcattatgatgttagctggttattttgctcgttagtagatgcagtttcttcctagccttgatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgtcgaatattggcccccactctcttctggcttgtagagtttctgctgagagatcagctgttagtctgatgggcttccctttgtgggtaacccgacctttctctctggctgtccttaacattttttccttcatttcaactttggtgaatctgacaattatgtgtcttggagttgctcttctcggggagtatctttgtgacgttctctgtatttcctgaatctgaatgttggcctgccttgctagattggggaagttctcctggataatatcctgcagagtgttttccaacttggttccattctccctgtcactttcaggtacaccaatcagacgtagatttggtcttttcacataatcccatatttcttgaaggctttgttcatttctttgtactcttttttctctaaacttctcttcttgcttcatttcattcatttcgtcttccatcgctgataccctttcttccatttgatcgcatcggctactgaggcttgtgcattcgtcacatatttctcatgccgtggttttcagctccatcaggtcctttaaggacttctctgcattggttattctagttagccattcatctaattttttttcaaggtttttaacttctttgccttgaactaaaggaggaggttcgaacttcctcctttagctcagagtagtttgatcgtctgaagccttcttctctcaactcgtcaaagtcattctctgtccagctttgttccgttgctggtgaggagctgcgttcctcagttggaaatgcagaaattacccgtcttctgtgtcgctcacgttgggagctgtagactggagctgttcctattcggccatcttgtctccacccccgagagaaaaagtataatttttctgtgattccttttcctactctgttggaacatctgctaaactttagcccatcatacttcttatgcttgtataacaacatgaaaacctgtaataaccagtttttggcatcatacattattataagactttgtcataatatttcaggaaggtaatgctgttgaatgtactaataagttacaaaattaatttagatgatttcctagctataacctattgaaaatcatttgttttggtttccaatctgattgaaatcctaaaaatacttaaaataatttacagagtagcatgtaataggaatcgttcaatatacatcagcacacatcctgtgtattcattacatgaaatggtactcgaacattgtgaatataaagttatggtatagttttaattaagactgtggactctaaacctgacctaaaatctgattctgtcatttgctacttgtgttacttcattttattgcgtcatggtttcctcatctctaatggaggaacaagagattttatagaaattagataaagtagtgtatgtgagtgttaagcatagtacctagaatatgataagatttaataaatgttagttattattttatataactagtattatctggttatgaaaggaactttggcttttagtttcaaatttatctttctagccattttatttaagacgtttatacaagaagaaatacataaagaatgaggtaaatgacaaattagcaatgtaattgttatcaactagtggaggcacttttagcaggcaaattactcattattatggtcaattattttggcaaataattaaagaaaatgaaaaagaagaccaccagactatgaatgactttgcctttaactgatgctgatagaatttgttttaaaattttttcactattaggaagtagcctggttttgactaaactttttaaaaagaaaaaaaagtttgtttgaaataattacagattcacatgaacttgcaaagatagtacagagaggtcctgggtacctgtcacccagtttccccaaatgactacatcttatgtaactgtagtatattttcatagcccagaaattgatattggtacaatgtgtgtatatagttctgtgacattttatcacattatggattcatgtaaccacctccacaatgatgatacagaaatatttcaccataagagacataaattacagaactcaagaggagggggaaggaaagaaaatttgttgtattgacacatattttgcttaccatgttctttcttccttcctgatgttccaagataccctcttttatcattttcttttggtttagataacttcttttaactaatagggtaggtatgctggtgacaaaatcttagttttcctttatctgagaatgctttaatctcccctttattcctgaagattttgtttttgcttgatataggattctgagttgacagttcttatctttcagcacttgaaaaatcctttgtgtctcttctttatggcctccatggtttctgatgaaaaatctgctgtcatgtgaattgtttcccctgataggtaaggtgtttctttcactgctttaaaaattttttatttgttaacaactttcaaaagtttgattatgatgtggtttagagtcaattttcttattttatttatgtattttttaatttcaatatgtttttgaggaacaggtggtgtttgattacacgaataagttcttcagtgatgatttctgaggttctgttgcacccatcactcaagcagtgtacactgtacccagtgtgaagtcttttatcccttgccacccccatccctttctcctgagtgtccaaagtctaatgtatcattcttatgcctttgcatcctcatagcttagctcccgcatatgagtgagaatacatgatgtttggtggttttccattcctgagttacttcacttagaatattctgatatgtatataatgatgctacctttatccaggttgctgtgaatgccattatttcattccattttatgtctgagtagtattccatggtgtgtgtgtgttgtgtatctccacattttctttatcctagagtggattttcttgggtatattcaatttgggatttgcatggcttctcgattctgtaggtttcttatctctttgagtactttttcagccccaccctctttctctctccttcttatctctcatattgcaaatgttagatcgtttgttatagtccctaaagtccctaattctgtattcatatttttttcagtttattttatctttgtttttaaggttggataattagtgttcttctgttttacagttcactgatttttcctctgtcttttccattctgctgttgagcctatctgttgggtattttattacaattattgtattttttgcttttaaaagatccatttggttcttctttatatcttctatttctttactgagactttatttttttgctgaggctcttggtttcaaatgttttcataattgctcaatgaagcatttttatgatggctactttaaaatctttgtcagataattctaacatcgctgtcatcttgctgtcaacatctattgatactttttttattatactttaagttttagggtacatgtgcaccatgtgcaggtttgtcacatatgtatacatgtgccatgctggtgtgctgcacccattaactcgtcatttaacattaggtatatctcctaatgctatccctcccccctccccccaccccacaacaggccccatagtgtgatgttccccttcctgtgtccatgtgttctcattgttcaatttccacctatgagtgagaacatgcggtgtttggttttttgtccttgcgatagtttgctgagaatgatggtttccagcttcatccatgtccctacaaaggacatgaactcatcattttttatgactgcatagtattccatggtgtatatgtgccacattttcttaatccagtctatcattgttggacatttgggttggttccaagtctttgctattgtgaatagtgccgctataaacatacgtgtgcatgtgtctttatagcagcatgacttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaataatcaccattctaactggtgtgagatggtatctcattgtggttttgatttgcatttctctgatggccagtgatgatgagcattttttcatgtgtcttttggctgcataaatgtcttcttttgagaagtgtctgttgatatccttcacccactttttgatggggttgtttgtttgttttttcttggaaattagtttgagttcattgtagattctgaatattagccctttgttagataagtagattgcaaaatttttctcccattctgtaggttgcctgttcactcttttggtagtttcttttgttgtgcagaagctctttagtttaattagatcccatttgtcaattttggcttttggtgttttagacatgaagtcctcgcccatgcctatgtcctgaatggtattgcctaggttttcttctagggttttttatggttttaggtctaacatttaagtctttaatccatcttgaattaattttagtataaggtgtaaggaagggatccagttttttttttttttttttttgagacagagtcttgctctgttgcccaggctggagtgaagtggcatgatctcggctcactgcaacctctgcctccccggttcaagcgattcttctgcctcagcctcttgagtagctgggactataggcacacgccaccattcctggctaatatttgtatatttttagtagagacggggtttcaccatgttggcaaggctggtctcgaactcctgacctcaagtgatccacctgccttgacctcccaaaatgctgggataacaggtgtgagccaccacacccagccctattgatacttttttaatgcagctgaatcttcctggttcttggtatggcaaatgatttttttgatggcaacctggacattttaggcattatatcgtaagattctggatctcattgaaactttcttttttctttctttctttctttctttctttctttctttctttctttctttctctttctttctctctctctctctctctctctcttttcttttcttttctttcttctatttaaaatcttgccctatgaatgaaactttctgtcttagctggcttcatctgatactgctgtgtcaggggagggagggcactgcctcattactgccaggtgggtctagacagccaggtttcctaattgacctctcttgatacctaagagggtggtttttccttactggtgggtgagggtggaagtcctggctcctcactagacctccagtgatatctccctgcctgagagggctaagagtgccttgttactgctttacacatagccttcactgacatcattagggggatggtctcacagccactggatagtggtgaaagtcctggctctccactgggcctcttctgaccccatcccagcgcagaaaggagtgtgtttcattacagcattgtgaaggtggaagtctaggattcccactaagcctttggtgacgtggatgagggtgcagccatatttttttctgtagtgtttagctggagtagagtaattattgtctaaaaattttctgtcctaatattctgccctttttctgatcctctggctagagagagcagacttttcttcttctgtgtttttggtttgtgctcactgtcatttctaggttgccaacttcttcagctttataccttgaatatattaggcaaaaagaacacccaggaaaatctccactgtgctattccttgggtcctgaggtccctagcccatctgcttcttcctgccacctttcagaaccattttatgtttttatatacaatatccatgattgttagccatattttgtaggagaaataaggaaaaaaatgcatctacctcatctttccagaggaagtttgacttattttggccttgctgactttttcgtaagttattatagtttgattatatcttgaaaccagaaactattccttgtcctaactcaggagacattttggagtggctttatattctattttgctgctttgtcaatagagttatttaaagttatcattatgtaggcaacagttccttagtttgtaaggcaaaatgctgaatctaagaaacatgtaccacatatgtgtctgttatatctgtaagaatttacttatttaaaatcctgtttgcgttaagggtaataaaagtgaagtgatatatagatgacagatttcatgagagaaaaattttgaagtcagaatggggatgagtatcatactgaattcagtaatgtattatatataatgcttaagtaatgattaacgtatacattattgcagtaccggttaactagtgatcacataattctcatcgaaattgtttagagacataaaatattggcacagggtattgttttacattctttgaaacagtaaatgtagattggattgaggaaaaggctatctgctttaacaataaatttcctaggtacttcagtagcttactgtgaatttactttgccctgtctgttgtattactcttaaaggagttagagaatatggcttcaaaataatatcagtggcattgctttcccctgctcttgcaggtgaaatccactgataaaggggaagaagatccattgatggtcataaataaaatttatcctaaaagtgtaaaatattcagagctgaatacagctctctatatatcagccctctgagtttatagatgaggaaactgaagcccagtaatgttaagagacctgggaaaagtaacaagctacttagaaggaactgggacttgaattcagattctctgatcctggggccactatattttccattagctggtacagtgagggaagaatcagacctagaagctgccctcaaagagtctactggagcagatgggaagggcaaaagtaattgtaatacttggtagaaagtgacctttcccataaaagagatttggataaagttttttgaaatgtaattctttaagcatttaaactgtactttaattttgtactatgcatacataaaaggaaagaagtcagaaatcttatttccagactcttttagataaagaggtccccaaatttattaatttttattttgaaaaagtatactcgggataaaaatgtggatgattatgtctggtttagagtgtttcataatttaattaacctaagataaatttatataagtaaatagataaatgaataaatgtactcacagaagatatatatatgtgtatatatatatatattttaaagagtagattcagtggatagaagtttcaaagagttagatgtcacctcggtataaggagatttttctgataaagctattgaagtacggaatgggccatctcaaattatagggagttcacattactagaggtggttaagggaaggctagttaacttcttaacagggatgagagtttagagggaaattaagcattgtgtaagtggcaggacccatttgatctgtaaagttccctttgaactttgagattttatgatttgaattatttcaaattttgcctaaactttggaggcttgggcatagtttaaatattgtatttttctcattttcaataagagaaatcctttattttccaatttttagagtatttaaatgtcatgtctagcagtaaaaaataatagtttttttttgtagcgtaacatccttatttgttaaggttatgttttatgatttcaccaaatttgtatttcatcataggtacatataggactaacacattttaatacatgcctcatagactggaagaatttcaatctacatatttcatatgctttctatttttttaaattataaaggcatctaacacacatggcaaaacatttacagaaacccaaagtatccatgaaaaataagtcttctctctctggaggcagccattgttatcattttgtttatttactttgcttacagatgttttctatgcaaatacaagcatgtgtgtatatcctcttttaaacacaaatggaagtacgtgatacacattgatctatggctacttaacaaaactttatattataaatatttctatatcaggacataaatacctaccttattcttttatttctcatataattaaaaaaattgagatataattcacataccatacaattcacctttttaaagtattcaaatcagtgtttttttttagtatgttcacaaagttgtgctgccattacagtgatctgattctagaacattttcatcagtgaatgcctatatactgttggtgggaatgtaaattagtacaacctctaagaaaaacagtctagagatttctcaaagaactaaaagtaggtctaccattcagtctatcagtcccactattgggtatctacccaaaggggaaaaaaaaagccattatataaaaaagacatccgggcatggtggctcacgcctgtaatcccagcactttgggaggccaaggcaggcagataattgatggcaggagttcaaggccagcctgaccaacgtggtgaaatcccatctctactaaaaatacaaatttaaccggctgtggtggcgcactcctgtagtcccagctacttgggaggctgaggcaggagaattgcttgaacccgggaagcagaggttgcagtgagccgagattgtgccattgtactccagcctgggcagcaaagcaaaactccgtctcaaaaaaaaaatccatcttcatgcatatgtttattgcagcacaattcacaactgcaaagatagggaatcaaactaagtgaccatcagctgatgagtggatgaagaatatatgatacacacacacacacacacacacacacacacacacacacacacacaccatggaatattactctgccataaaaaagactgaaataatgtcttttgcagcaattggatggaactggaggccattatcctgagtgaagtaactcaggaatggaaaagcaaatataatatgttctcactgttaagtgggagctaagctaggggtattcaaaagcatacagagtgatatcatggacactggaatctcagaaggagggagattgggaggagaatgagggatgaaaaactgtctgtggggtaccatgtacactatttgggtgacaggtacactaaaagcctagacgtcaccactatacacttcatccatgtaaccaaaagccacttgtaccccccaaactattgaaatatatatatatatctatctccttttactcatcccatttgttctataataaagtctatctcccctctccccagttcctggcaattatgattctgctttctgtttctatggatttgcttattctagacatgttatataaatggaataatacaataaatggcctattgtgtctggcttctttcccttagcataacgttttcaatgttcgtcttagttatagcatgtattagtactttcttctttctatggatgaataattctacaaggtatgaatatactactacttatgtttattcatttatcggttgatggacatttgggttattttcactttttacttattaataaagctgctgttagcatttgtgtataattttgtgtgtgttatgttacctcattattattattattattattattttttagacagagtcttgctctgttgcccagtctggagtgcagtgtcatgatctcagctcactgcaacctctgcttcccaggtacaagtgattctttgcctcagcctcccgagtagctgggaccgcaccacatgccaccacgcctggctaatttttctatttttgtagaatggggtttctccatattggccaggctggtctcaaactcctggtctcaagtgatccatccgcctcggccttccaaagtgctgggattacaggtgtgagccaccatgcctggcctattaccttatttttaataactccatagtactgtgtcatttggatgttttataatttatctaaatagtctcctacatagagacattatggttaggtatggactttgtgattgatattgaaaacagccttgcacatttctgtgtacaattgtgagataaaagttgagagttggaatttctgcagcaaaaggcatgtgcatttataaatgtatcctcattgcccctcagagaagtttcatcaatttattcctctaagtacctgtttcctcacaacctttcttaaaatcttttgaatctttgtagcattgtgatgttcatttttatttctaatatattcatgctatctctctttttctggatcagtcttttaagaagtttgtcactattattcagctaataaaatcctcagcaacccaactttcttttttgagacagggtctcactctgtcatccaggctggagtgcaaaggtgcaatcatagcactcctgggctcaagggatcctcctgcctcagcttcccaagagcaggtaggactacaggtgcatgtgaccacttccagctaagtttttaaacattttttttttttttgtagagacagagtttcattatgttgctcaggctgatctcaaactcctggcctcaaacaatccgcctaccttggcctcccaaagtgttgggattataggcatgagccactacaacaacccacattttgattttcttgatcatttattgttttagttttctatttcatttatttttgttttttattatttctccatttgtactttctttgatttttataacattgtttttctagcttattaaactagatgcatagtgcatctatttttagccttttaaaacagttttattttgttttaaattgatacatgataattgttcgtatttatggggtacaatgtgatgttttgatacatatatacattatgtaatgatcaaatcagggtaattaggatatcagtcatctcaaatacatgtcatttcttcacggtgagaacatttgaaatcctctcttctattttaaaatacattattgttaactgtagtcaccccgccatgcaatagaacaccagaacttattcctcctatctaactgtaactttttgttgagcaacctctcttcattacctgccccccactctcgcccagcctctgataaccactattctactctctacttctatgagataaacttaaaaaattcctcattatgagtggaatcatatggtatttgtcctttcgttcttgtcttatttcacttagcataatgtcctctaagttcatcaattttgtcacaaatgacaggttgcattccttgttatggctgaatagtgttccattgtgtatgtatacaacattaaaaattaatttatccattgatggacacttaggttgattccatattttggttattgttaatagtgctgcagtaaacacgagggcataggtatatgatgatagatacatatatatacttggaattgtgattgctagatcatatggtagttttatttttagttttttgaggaacctccatacagttgtctatattggctacccaaggtgatccacagagtcaatgcaatcctaccaaaataccaatgatagtttttataaaaacaagagaaaaacaatcttacaatttgtatggaacaacaaatgacctagaatagccaaagctatccttagcaaaaagaacaaaactggaggaatcacattgcctgagtaaggaaaacagcacggtactggcataaaaacagacacatagaccactagaacagaatatagaacctagaaacaaatacacatatatacagccaactgattttaacagaggtgttaggaacattcagtgagggaaaggaaagtctcttcaataagtggtgctgggggaaataggatatccatatgcagaaaaatgaaaagtagacccttatctctcaccatatacaaaaaaatcaaatcaaaatggattacagaattaaatctaagacctgaaactactacaagaaaacataggggaagtgctttatgaaattctttggggaaagaaatttttggctaagcttcaaaagcatagacaacataagcaaaaatagacagatgggattacatcaaactagaaagcttctacacagctaggaaacaatcaagagtgaagtggcaacctacagaatgtgagagaatattttcaaactgtgcatctgacaaggagataatatccagaatatgtaaggaactcaactcaatagcaaaaaagaaaataatatgattaaaaaattggcaaaagagcggaagagctgtttctcaaaataagatataaaaatggctgacagatatattaaaaaaatgctcaacatcactagtcatcagagaaatgcaaatcagaaccacagtgcaatatcatctcacccctgttagaattgctattatcaaaaagacatgaaataaatgctggggatgatgtggagaaaagggaacttacatattgttggtggagttgtgaattagtacagccactgtggaaaatagtgtgaaggttcctaaaaaaatctaaatagatctcccatgtgatacagcaatctcactgctgactgtatattcaaaaggagggaaatcagtatattgaagaaatatctgcactcccatgtttattacaacactattcacaatagccaggatatgaaatcaacctaactgtatgtcaaaggatgactggataaagaaaagctgatatatgtatacacacacacacacacacacacacacacacacacacaatggaatactattcagccttaaaaagaattaaatcctgtcatttgtagtatcatggataaaactgggggtcattatgttaagtgaaataagccaggcatggaaagacaaatattgcatattctcactcatatacaaaagttgacttcatggaggtagagagaagaatgatggttactagaggttgggaagggtagcaggaggaatgaagagaggttggttaatgtgtaccaacatacagttaaataggaggaataagttctagtgtttaatagcacaatagagtgactgtagttaacaataatttattgaatatttcaaaatagctagaagacttgaaatgttcccagcacaaagaaatgataaatgtttgaggtgatagataactcagttacccagatttgaacactgcacattatatgcttgtatcaaaaatattatgtgcaccccaaaaatatgtccaattattatgtatcagttaaaaaaaaccaaaaatcaacatcactgtaacaaatggtatttgtattcttatttttttatagatattgacaagttgttccaaaacccatgctcccatgatgagtgagtttaactatctgcccacccccttgacatatctgatgtacttttttttggcacaggtgtgcacacaatttgatagaaaaataatttattcttgttagggagtatttaaaaatattttcaacttttattttagatacagggtgtacacatatgcaggtttgttacatgggtatatcgcactcaggtagcatgcacaatacccaataggtagctttttaacccatgccccactctgcccctcacccctctagtagtccacagtgtctattgtttcgatatttatgtccatatgtgctcaatgtttagctcccacttctaagtaacaatatgcagcatttggttttctgttcctgtgttaattcgcttgtgattatggcgtctagctgcatctatgttgctgcaaaggacatgattttttctttttttatggctgcatagtattccttgctgtctgtgtaccacattttctttatccagtccaccattgatgggcacctaggttgattccatgtctttgctattatgaatagtatgatgatgaacatacaagtgcacgtgtatttttggcataatgatctaatttcctttgggtatgtacccagtaatgggattgctgaatcaaatggtaactctgttttaagttctttgagaaatctccaaactgctttccacagtggctgagctaatttacattcccaccaacagtgtataagtgttcccttttctctgcagcctcactgacatctgttgttcttttactttttaataacagccattctcactggtgtaagagggtatctcattgtggtcttgatttgaatttctctgatgattagtgatgagcattttttcatatgcttgttggctgcttgtatatcttttgagaaatgtctgttcatgtcctttgcccgtttttttaatggggttgtttcttgctggttgatttgtttaagttacttatagattctggataatagacgtttgttgaatgcatagtttgcaagtattttctcccattctgtaggttgtctgtttgttgacagtttcttttgctgtgcagaagctctttagtttaattaggtctcgtttgtcaaattttgtttttgttgcaattgcttttggggacttatccaaaaattctttgtccaggctgatgttgaaaagagtattcataggttttcttctacactttttatagtttgagttcttaaatttttaatccattttgagttatttttgtatatggtgaaaggcaagtatccagtttcattcttttgcatatggctagccaagtatcccagcaccatttattgaatagggagtccttatcccgttgcttgtatttgttggccttgtcaaagatctgatggttgtaggtgtgtggctttatttctgagttttctgttctgttccattggtctatgtgtctgtttttgtaccagtactatgctattttggttatgtaaccttatagtataatttgaaatcaggtagtgtgatgcctctggcttttttctttttgccttggctatttgtgctcttttttggttccatatgaattttagaatagttttttctaattctgtgaagaataatgttggtagtttcataagaataacgttgaatctgtaaattgctttgggtagtatggccattttaatgacattgattcttcaaatccatgagaatggaatgtttttccatttatttgtgttgtctttcatttctttcagcagtgttttatagtgctccttgtagagatcttttacctccttggttcttggtgttcctaggtatttcattttctttgtgactattgtaaatacgattgtgttcttgatttgactctcagcctgggtgttattggtgtatacaaaggttaccgattttcatacattggttttgtatcccaaaatcttgctaaaatggtttatcagttctagtagcgttttggtggattttttagggtattttaataatagaattatatcatcagcaaagagggatagtttaacttctttttttcctatttggttacctttttttcattctgtttcatgattgctctggctagacttcctatacatcttttaagccttattgtatgtcctgatatttagctagagatggctgaatcttttcttacgcttctcggatattcacatttctttttctgcgaatttacaatttcaaatcatttgccctatttgtgcttttcttttgaattttatgaattctttttctcctttgaatttttattcttagtcacttttgtatgttactattattttatccttctttgttgattgtcttttatttttagatgatcaattttactgtggtataatttacctgcaatagaatatgagatacccctaggaacctactagaatgtctaaaattaaaaaaagaatacctaactgacaatgcgaaggtgctggcaaggattgtgagcaagtaaaactctcatacattgctgatggaagtacaaaatggtacagctaccctggaaaacaatttggcagtttcttacaaagttaaatatacacttaacatatgatccagcaatctcattcaaaggtatttaccatagacaagtaaaagcttatgttcacagaaaaatatgtatacaaatgtttatggtagctttatttataattgccttaaactgaaaacagcctgagtggttttcagctggtgatagaataaacaaacgtggtgtatgtacaccaaaatatactacttaacaataaaaaggaacaaagtactgatacatacaaaaatttggatgaatctcaaaggcgttaatgctaatcaactaaaagaggtcagactcattaaggctaaatatattatgattccatttatatgacattctgggaaaggcaaaattatagggacagaaaacaagttagtgcttgctggagaatgggggtgaaaagtggatgattccacatcaaggaaatttggacagtgatggaattgttctatgctgtatcttgattatggttgtaattatgactattatatgtttgtcaaaactcagctgtacacctaaaaagtgtgaatttttctatatgtaaattacacctcaataaacctaattaaaaattttaaaattaaacccatgtgatttgcattataaattggaccaccatttgtgattatgaaatatgaacttgccaataaactgctacaggtgacgctaaactataaggagccccttctgctgcgtctactaattaaatactttgaatgaggttcaaaaatggccaatttgaaaataaaagtaacttttaaaacaaaagttgttacacagatattcaattgcagaaagagtaagagctttgctcaaaaacttgaatatgacattcacataatatccactgtttctaggaaaaaaacttataataatgtctgcatctgtacattactttagagtttgtaaggtacttttatatatgccatctcattttgaattattgcaaaacaatgcctcactagcaaagaataaatgttcccatgaagctgcaagcccctatgactatgaatacaattgtgaagtagggattgtcagaccccaaggttcattttctccctgagtgacacttaatccagaggtaaaaatcagtctcagatagtagaacaggccaagttatgtggtaaggctgtggtgtccccaaacagaagcaactttgatggaagaaaacagagaatacatgtaaacatgtatttgtgcacatttgtattacatggctgctgagagaaaacagcaggctgtttcctttctagggcctgtttatttctgagcatatctccttggtgagtgctccccacaaaatactggtgcataatacgtaacatctttccttaatcataatgcaccccctacgtccctggtcccaggccttttctcaccatgttccctcgtttttgaatatacttttatactcccacaccctccacaaggcagtaatttaaacctcatccatccttaaggaccagccccaaacgtcctcattcacccaagcagaagtaattactttttgtagattcccactgcatactgcttaactttctcttatagaattgatcacatttggcattgcctcatatagatgtttgattgcttccagttgtaaactcattaagtacctagcctagttcattggagacccaccacaccagctagcagtgtgccttgctatactgtaaggtcttagcactttcactgaagttcaggcataatcaagtgtgccacatgattccagaaagcaccaagccaagaggaaacacagaggtggatgtggaaagcaaaatacaataataaagcaaaagtatgtttctccctgtgttagtcggggttgttcagagagaaacggaaccattaggagattatctatcaaggggtgggggttgagagaaggggagagagggagagagagagagagaagaagaagagaagaggagaagagaagaaaggagagaggtgagagaaagaaagaaaagaaaagaaagagaaaaaagattttaaggaactgtggaagcctacaggctggagacccagggaagagttaatattgaagccccagccaaaggcagtcttcttgtttgggggtgggggacagaaaaggagcagtcatttttctattaaggccttcaaatgattggatgagactcatcaacattaggaaggataacctactttatgcaaagtaacctgctttactcagaaacgtctagaataatggttcaccaaataaccatgttgacacataaattaaccatgagacctttttttctctacaagatgctccacaagtctcttcttcccagtccttctcccaatgcaacgactgcagtgggagccacctccttaaaaaggaagcagttttatctaaggcatgctaaacaaattcctggaaaggtctaactaaatgataatgcttcagaaactatagtgatcacataaccaaaaaaattccaagttattttaaagttgcagataaatcccaattgtgtataataatttatcttgtgattggtgagttttgttacattgcagtcacatttaaaaaaaatctctcagaagaattaatttcaaaataaacctcaatcctggaacacattacaacattctcttcttatgctcctctttctaaataaggtaccagtgacctcaactgaaactgcagtttaactttattaaggaagaagaaatagaagggacaaaaactgttgtaaaataaattataaatattaataatcactaatgctgaaatttctagtgctcaaataaacataaaattagaaactggtctgttctgcctatggagtagcgattctttattcctttactttcttaataaacttgcttttacttaaaaaaaaactgtcttaactattttaatgaagtatttgaaaacagtttttttcccacaaatatcttatgacacagaaatagaacctagcagactattacactagtgagcaaataatgaacttttggtaaagcatacccaaccttcagttagaatatctcctgataataagaaagatctcattgaaatttattaattcttttgtgtctagtagataacttggatggcacacagtgctttgatttttacctgcccagaatttaactcctcatcctatcctacatgattttctttttcctctcccccttcctcttttattccatgtcactgggaatggcaggtcttgcaccaagtaatggcaggtcttgcaccaagcaagccagaaacctgagctttagtctttattcctccccacttttcactcctgcatccattctagtagtgaaaccattcaatagctttcaattaatccttcctctctcttttttcttagttcagattctttagtttgaattactctatcagttttctaacttatccactgacttcaggacttgccttccttcagtttgttcaactgcattttgagaaatactgctaatgctattctgaagtcactcttgcttgaaagtatttcagtggctccccagtatcatcagtataaaaaaatctttttttgagttacacataaacccttcagtatggacctgatcacttgctaattctcatcgtcttccacacacagcaaacaaactgacttttctgctgtggtttatgttttatctcccttatgtggctccctctgcctggaatgcccactccgttccccactttgcctagttaacccatatatgttgtctaacaaagactaaaatcaacctttgtcacctctcagaagctttacagacacaagaatattaactgtagtgtattgaacttgggaaaagagcaatgatctgagatactgagtcaaaaagcctcacagataatctaaacaatttccaatccaaaggggctgaaccagtagtttacaatgtattatttcccccatactattcatatgtgtagtgcattctatcagtaactctcaatataagtagtgaatctccagaagggaagggaacacttcgggagggataattcaatgtgcacatgttgggacagaggaaaagaaagaaaagaaagagaagcagcctcacaaacctaagaaaatcttatcaaatttttatagtgaaacagtttgggggtgggtggcattgaatcaaaaatgactttactggaggtccagttttcaaatgtagataataattatgggcacagagattttatatagagtttacaacttgacaataagctcttacaaaatcgccagtggaaaatgtttgccatggtcataaattcagtgacctgcttgaaagatgtgtggtatttaccctatcttgctccagccagctcatacagaaagcagcagcataatccaaaggagtggggacatccatggaaaatttcctggcctggcagtttgcatgataagtgaagaaaacacgatttactaagaaaaatgcaggtggaacccccacagcaggatgaggccaacaaatttattacactaggtgaaatacacatgaatgtctgctgccaggtcagactcataaatatgcattaaaagagattctgaacccttatgagaaccagttttttctcaacctacaagggctgacagatttatggttgagggttttacttcacaaacaaacccttaggtagaacctacatttctgctaaggtcatagtgttctttcacaccaaggagactcctaagaagaaacaaacagttttttaacagtttatacaggtagaacattccagtaatcagcagatagcaaaatctgtgactataatgagcaactaaaatggaaaaaagcagaaaaaataggacaagggagtcagaaaggacagacattttttctaatctctactttgctacaaattagttagctatgaggaccccagtttcctcatttataaagtatgttaagggtaggaagataataaaatcttttaaggtctgtcccagcattgaaacagtaggatttgatctagagtgacctccctgacagatacgagggtgaaatagaggcaggctcacatgacagttactggcaaggaagagaaatgggtagtcatgactggtggaagtgagtaaaagttacaaaagtaagctggacatacagtctgggtagccaactttatattgttagaaagtttaaccattcttttccaaacatcccttcccacaactttcaaaattattccttaactcttctatgactttctattgttatattctacatttgtatcacaataatgttaacatcaacccctagtacaggtagggctgaaatttcagtcaatctactcttatatccacagccaagtatatgtagagaggatgatattgggggatgatatggtttggctgtgtccccacccaaatctcatcttaaattccacgtgttgtgggagggacccagtgggaggtaattgaatcatgggggcaggtctttcctatgctgttcttgtgatagtgaataagtctcacaagatctgatgttatataaaggggagtttccctgcacaagctctctttttgcctgctgccatccatgtatgatgtgacttcctcctccttgccctccaccatgattgtgaggcttccccagtcatgtggaactgtaagtccattaaacctccttattttgtaaattgcccagtctctggtatgtctttatcagcagcatgaaaacagactaatataggggagaagggagaaatagagggaatgaggacttctttcttcatttgtggggtttttttttttttgagagagtgtctcactctgtaacccaggtgatagtgcagtggcacagtcttggttcgctgaagccttgacctccagggctcaagcaattctcccacctcagcctcctgagtagctggcaatagaggcactcaccaccacacctggctaatttttaaatgtttggagacatgggggtctcactgtgtttcccaggctggtctcaaactcctgggctcaagtgtcttcccacctcggcctcccaaagtgctgggattacaggtatgtgtcactatgcccagcctctttctccatttgacatcatgatataggcttcaattcatcaggaagagaaaacaattctaaacttttgtggatctattgcatagcttcagaatacataaagcaaaactgaacaataagaaaatgacaaatctgttcatgtccttcgcccactttttgatggggttgtttgtttttttcttgtaaatttgtttgagttcattgtagattctggatattagccctttgtcagatgagtaggttgtgaaaatttcctcccattttgtaggttgcctgttcactctgatggtagtttcttttgctgtgcagaagctctttagttgaattagatcccatttgtcaattttggcttttgttgccattgcttttggtgttgtagacatgaagtccttgcccatgcctatgtcctgaatggtaatgcctaggttttcttctagggtttttatggttttaggtctaacatttaagtttttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcacatagttgtagatatgcggcgttatttctgagggctctgttgtgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttgattccatatgaactttaaagtagttttttccaattctgtgaagaaagtcattggtagcttgatggggatggcattaaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctttgtttgtctgttgttggtgtataagaatgcttgtgatttttgtacattgattttgtatcctgagactttgctgaagttgcttatcagcttaaggagatcttgggctgagacaatggggttttctagacacttctcaaaagaagacatttatgcagccaaaaaacacatgaaaaaaatgctcaccatcactggccatcagagaaatgcaaatcaaaaccacagtgagataccatctcacaccagttagaatggcaatcattaaaaagtcaggaaacaacagatgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgccgctataaagacacatgcacacgtatgtttattgcggcattattcacaatagcaaagacttggaaccaacccaaatgtctaacaatgatagactgggttaagagaatgtggcacatatacaccatggaatactatgcagccataaaaaatgatgagttcatgtcctttgtagggacatggatgaagttggaaatcatcattctcagtaaactatcgcaagaagaaaaaaccaaacaccacatattctcactcataggtgggaactgaacagtgagaacacatggacacaggaaggggaacatcacactctggggactgttgtggggtgggggaaggggggagggatagcattgggggatatacctaatgctagatgacgagctagtgggtgcagtgcaccagcatgtcacatgtacacatatgtaactaacctgcacattgtgcacatgtaccctaaaacttaaagtataataataaataaataaataaataaaaatatttaaaaattaaaaaaaagaaaatgacaaatctaccaattggagtggaaaattgtaaaccacctctctcagtaactgatagaacaagcagacaaaaaaaaatctattatggttatacataatttgaatacaattatcaagcttaatttattgagtatacatagaatatttcagcaagtggagaaaatgtcttatcacaagtatggacagaacatttattaaaattgaccatatactaggccatcaaacaagtctcaacaactagtgaaaggactgaaaattagagtatattctctggttactgtgcaattatgctaaaaatatgaaacaactaaaaatagccatgtatggatattgaaaaacatttttaaacaacacatggggtgaaagaaatcctaatagaaatgtaaactacttaaaactgagcaataacaaacactgcatagcaaaacgtgtgaggtgcagcgtaagcaaaacttacaggaaaatttgtagccttaaatgcttacacagccttcatcacttaacgacaggtatacattctgagaaatgcatccttaggcaattttgtcattgtgtgaatatcatggagtgtacttacacaaacgtatgtggtatagcctactacacacctaggctatatggtatagcctgttgctcacaggctacaaacctgtaatgcatgtgactgtactgaatactataggtagttgaaacataatgatctgtatttgtgtatctaaatatatctaagcatataaaaggtatggtaaaatatggtataaaagataaaaaatggtacacctgcatagggcatttatcatgaatggagcttgcaggactgaaagttgttatgggtgtcagtcagtgagaagagaatgtgaatgcctaggatattattgtacactactatagactttataaacactatacatttaggctttactaaatttataaaaaatattttttctttggtaataaattagccttaacttactgtaactttttactttgtacactttttaattttttaaaactttttgcctcttttgtaataacacttagcttgaaacaaaaacatattgcacagctatacaaaaattctttttttatatccgtacatatatacatataatttctttatataagcatttttcttttttcatgaactggaagaattaatattgttttttatttgtataaatgtaaggggtacaagttcaattttggtacatgggtatattgtataatggtgaagtcttggcttttaccatatatatgcctttttctatttttaaaattgttttttttttttttttttttacattttaaacttttttttgttaaaaacgaagacacaagcatatacatcagcctgggcctacacagggttaggataatcaatttcactgccttccacttacacatcttatctcactggaaggtcttcagggcaataacgtgcatggagctgtcatttcctatggtaacaatgctttttttctggaatacctcctgaagggatgtgcagctgctcagctcagcaaaggcaccaactcccaagggggcaattttcagtttcagttcaggtgagggtgtgtgtgtgtgtgtgtgtgtgtgtgtgtgtgtgtgtgactcttctggatggccctgttttcaccaggatgcagggctccaccaaagcgctgtttgctcagcagcagagtgcagattcagctcaggtccctaggggcagggtgcaggcatggctgggagaagatggagctgttctgccaaagtatgggttccccaggagggactgcgcagcctcaactctgcctgaggggatgggggaaggagtgggtggagcagttccaccatttcttggccccacagggaagggacagttgttcacagctggacttgaggatatagggccactaagcaggggtggtttgagggcagtttagtctcagggaagaagatgtgctgtgactactcgtactcatcctggggcaagacatactctagcattagctctcagtgcagtagccctgtgggccacttggggtggggcacagtgttggcttcttatctgtggggggagcacagctttgtggtctctaggcagctccctcagctgagcttaatgctagtgaggactgcaggggaccccagtagtgaggattgtaggtatccaaagggttgatgggggctgctgggatcctcttgcctacctttgcaccatagagagaagttccttctggttcccaggttatctcacatgggggatggggtgatggagtcctagtatttccttccgttctttatgtgactctcctgagtttctgtgctcaccaaggtttgtgttactcctttgacgcaccctggtgttctccattagttattttcattaaaatatagctgtttatttgttgttttgcttgtctttatggaagggaggagggctaggggcttctagtcggccatcttcctctctacccattgtgcttttctagtgatactgttctgaaggctggatccaacagaaattgtgtgtgtgcagagatgtgtaaataagaatgcgatattatagtcatgtgtcacataacctttcggccagtgattaactgcctacgaaattgtggtcccatatgattataacggagctgaaaaattcctattgcctagtgaagtcagatccctcctaatgttgtagtgcaaagcattcttcacgtgtttgtggtgatgctggtgtaaacgaccccactgtgctgcttctagtggtataaaggtatagcaatactgttatatatatagtacataatacttgataataaatgactgtgttactggtttatatatttactatactttctattgttattttagagtatattccttctatgtatacaaaaacctaactgtaaacagcttcaggcaggtccttcggaaggtattccagaagaaggcattatcatcataggagatgacagctccatgcacgttattgcccctgaagaccttccagtgggatgcgatgtggaggtggaagacagtggtatttatgatcctgaccctgtgtaggcctatgtgcttgtgtcttagttaaaaaaaagtttaaaaagtaaaataaaagtaaaaattgaataaggattatagaataaggatataaagaaatacaatattttttacagctgtataatgtgttttaagctaagttattacaaaagaggcaaaaagttaaaaaaaatttaaaagcatataaaaaaagttacagtaagctaaggttattattgaagaaagagaaatttttttataaatttagtttacctaagtgtacagtgttgataaagtctacaacagtatacagtaatgtcctaggccttcacattcacttaccactcacttactgactcactcagagcaaccaacttccagtcctgcaggttccattcatgctaagtgccctatacaggtgtaccattttttatcttttatactgtatttttactgcaccttttctaagtttagatatgcttagatacacaaatactgactattatgttacagttgcctacagtattcagtacagtcacatgcattagaggtttgtagcctgtgaacaataggctataccgtataacctgggtatataataggctatatcatctaggtttgtgtaagtgtattctatgatgtttgcataatgatgaaatcacctaatgacacatttctgagtacctatccccattgttaagtgatgcatgactgtacttacaatgagaaactattggaaactctctatgtatataccaatgggaagaataaagaattgtctcattgtgttcatgggcacgtaccttaatgactaatgattttgagcatctttccatatatttatttgttattccatatatctttgagtatgtgttcagatttttgcccattaaggaaaaaaactagattttctttcattgtagagttgtaatttttttattgattctggatgtaaatctttcatcagatgtgtgggttgcaatttttcttcctggtttgtggtttgtcctttcattttcttggtagtctttctcagaacaaaatattgtaatttgataaagatcattttgtcaggtttctctttcgtagatcatgtttttcatagctacaagatctttgcctaacctaaaatcctgaagattttcttctatcttttcttccagaagttgtatatttttgggttttatatttagatctgtgatccactttgagttaacttaaagcaaataagatttatttgctaggaatacttttatttgtttaactcataaaataaatatgttatgaaaatgtgttactaggagttattgcctccagttggtattttggaagcatgggattgttagtgacatttaagctcttttgaccctggccagaagttagaactatagttgatttcataatttagtgacttaaaagtgtgtagtatctggagcaaatcgtttcatgaaagaatacttaccaatatttatttttactattttacccctgtagttctgtttcattaaaaataaacacttgtcctgacccactaaacagatttcatgtctcatgactggttccagataatttaaaaagcatactggcttaactatcttcctgaattggaactcacaatcttcaccacctccactactaaataaatattacctgtcattacccttttctgtctgctttgtaacaattctacttggtttttctctaagcacagtttaatttttgttatgactttacaaatttttagataatatactatcagctatgttgtcagaaaaaaaacagtaaatggagtaatagaaggaacttattgtgatactgtagaattttagtatctattaaaatagcgatgtccagccctggaggagctataactcttccgtatttgtgtttcattacctattcctgtcttagttgagtttcttttacttctatgtagcagaaacacactggagcttgctctagcctaatggagcctagggaggccaagggcaggaagctagaagggctcagtaactttggaagctattcttgcttcttgtatcatttgtgttccaggctacgttggctctgtttctttttatgtgagtcctttacacctctgtctttctgaagactggctttctctgatttctctgtgcatatgactgccctgagaccctgggattacttctggccagactagaattgctctgctccaattcccaggagagatagtatatataattagtttaggacaagttccacttctggtctaatcagcatggcccaaaggtagttagattggaaagaacaacccatgtttgccttgtgggtagatggtatgcagttctcagagactgagaagggtgctgggtctactgcaagttcacaaaatgctggttggtatacatttaccttttaaaatgaattttaattaatttggttttcagaatgtagaagtttataaaaagttcattgtatattaaaaaagactgagttaaggattacaaaactagaaaagtcacactgacatcaaaggatgactattcttttattactttcatgttaaaaataattaagcttatataacaaatttagtcaaatatattgaccacagagtactctttattttcaaaggtggtagtcatccacatagtgaacgtcttgtcgatccagcagttgaaggtgttataggctaaagaaaattaatatttaaaatattagacatgcattacaaatttacctctgaagagttttcatttagatatattaaaattccaagttgtagggaagggaagatatgagacccaacatttattgtgtttctgcctagtcagtcagttaacatattttatttcattcagaccttatagccaccctttgagaagtaggcgttgttatcctagaagcagtgaagaaattaaaacacacagaaaacagctagcaaatatgtagtgaggctagcatttaagctcaagtctgtgtgactctacagtttcttctctcttcactctactgtttgggggtatgaaagtatatttattaaacttttctaaaagaggctataagtaggactatacagaagctattcagttcattttcttgtctgtgtgcttaagacagtctcagtgtcaaacatatgataatcatttctccatatctggagcaaaaagagagtcatgtcagttacctaatgttagtcacttaagcacatggattttttagaggtcattacagtgataaatcaatattttaaaatagcagtggcttcttcagtttggagagaaatgttttttaaccttatattctaaaccttaatgcatgctaaattgggaattggagggaaaaagggaaagctgacctttcttttttagtctgaacaaacaagaagaggaaagcaaagactggctaaatagtataaggcagtattttaagctttccatgtttattcacttgaaacctgttatttttcaaaaacacatttttaagtgaaaaatcagaaaatatatatgctttagaaattattgttaaagacaaattttgtaacataaatgctttatgtaatagttacataaaacaagtttaagttgtctggtattgatgatatagaggaaaaactatccttcaaatatttgtgaattttacctgtgagttaatgatggtttaccttctaatttatcaacctaaatggccttgtccaatacaattaaaatgaacaattatttggtttattgtaacttcagacttagtcggaaaaaaatatataacagctgctagggtgtaattgctaaaataactataataatttttgtctctgcatggtgaagaatatgcattaagactttagcaaaagataagactgtgctctctttgtaagtagtctgatcaaatgtggctcatgacttaaaattaatttgatataaagtaaatctagcttaattctttattaagaattcacaatgacctttttgaaatagaggaatttgagatgaggatgagctagatgctccagagttcacattgctgctaccctttagggcataaaaggagcaaccaaaatcatgctattttagttctttaatagtttggctattcctttacaagctatcttttctagggacaaactaatatagcatgacatactttaagcatcaaacataaaagagttttgaccaaactgctctcagcatttctgttctgaaagtacctaattaaaagtaaccctgagttactggcccagatattggcccagtgtaggggaaatgaagcccacttagagttaatgggttgaaccaattgtcctctgtagttcatttcagtacctctaatgtttttctcattggtaagctttgagacaggatgggagcttattagtgacacagttttcttcttctgaagctaaactcttggtattgtgatcttttgaccttttattcgctctaacttcttgattccctttttccactcctctaaagtacagcacatatacaggttcattgatgtacaaccaaattttactgtagtggtgagcatggtttatggatttaattaattgacctattagtgaaatccagcttattggcagtctttcacgattgaaattctaactagtctctctgcatatctatttagatcatcccttaaccccaatgctaggctgctgctaggttagatctgaaagcactaccggcagtcagttttgcatattcagttaattatttggtttcttataaaccacttctctatttttttcttttacttattctttgcttccaatttcttggctacagtttcttagttctgtttgctgtttagtcagaggaccagtagaaaagagcattttccttttccttttcaccagattcagggacagtttctgtgttctcctggttcaggtctctgtaagtcaccatatgtggctttcaaccctgtcagacgttgaccttacccttttaaacattttgtagcagtttgtttaattagtgggaaatagaattcatagatagtgtgacctacttatatacatataacaaaatcaataccatgattataatataaagaataaataaatataatttatagtgaaactgtacgtatttcaggatatgactgtgagggcccaactgtactagaagatgtagtgaagtagtgaatgcttgtacctacttcttttttttttaaaacaaaaagttttttaatgtctgtagcctaatcttggaaatgaagcttgtacctacttctaaagaattaagttcaggtttatgagaagtaacaaggtaattctgtatagaaaactacagaaaatgaaaaattagtggtacatgtggaccataacataaaaatgttagaataaataaccacagatgagacttgtttgtatataataagagaaagaaggaaatacttgaagccgagaaaacatgtcatgacaaattacagactctcaaaatgaagaaaatgaggaagtacgatattctcacaaaggacttgggccatatttataagggtactgagaaagtaatttcctatattgtgatagagaacaagaccctgatgaggcatcacagaaagcatatttcctattttgaaatactaccactttaagacatggtttagattcctggtgcctcaaaagaccttgatgaccaaattcttctctaggtgatgagaaatagagaggatggattagaaagagaaacaataaaacagtaaggtatggagaagatggggcagtagatgtctctataccaaaaagatagaaaaataacaggcaatcaccaaatgaatactttcaatatgggtttttacaggatatgtttcttagtgttacagaacattttttttaacacatagaatttcgtaatttgaaacattaatttaagtaatttttattcttttaaaaaatttgctcttcaaaattcaacttcagtaatttttattgagatccctatggttcatatgtctctacgaatttaataatgctttgtttgtaatctttaagaatggactcaaatatcctctgccattttttgcagaggttccattgcttttgcagtaactgcactattatactaaactcttttcaacaaatatataattagaaatgctctagtatgtagtgcatagagtggatatataatttagttttgagacaacatctttatttgattcaagcttctgcctccgtaaagactttgtcctaaattattgggcttttttcttaacttcttgtcaaatctacctgtattagtatacacagttcgtatactacctgtgtattagtatacacagttcctggtgtttattgtgttaagtttcacctggcagagtatttccctcttctgggaaatgaggccattctttactgtttgggactgctccatgtattccataacacttacctctgcccaccaaatgctcgtggtttctctcaataattttgagtggtaaaagtaccccaacacatttccaaaatgctcctcaggggcattggactcattggctattcctagctaaatgtatatgcttgcatttcttaaaaaacaacctccacaaattttatttatgatttaaaaacacttaaggttaatccccattttctcttggaagaggagtcttttttcagtgtgactgttgtggattgaattgtgccctcctgaaacctagatgttgaagtcccaaccccaccagtatctcagaatgtggtgaagtgtggagatagggtatttcatggtagactctaattcaatgtaactggtgtccttttaagaagaggttaggacataggcaggttcagagggaagaccatgtgaagatggccatctggaagccaaggagagagacctcagaagaacccaactgtgctgacatgttgaatctgttgtttaagctgcccagtttgtggtactttattatggcaaccccagcaaactaatacaatgactgattgatacttcttaatatgtgttatttccatgttagtataccaagatagcagtataatttagtggttgcagttcagattttcaaggttagaattctgactcagccacttagcaatggtgaccttgagcatattaataaactctgagaagcctctgttttttttaatctgtaaaatgagggtaataatacgttcttctctgggttgttgtgaggatttggtaaagtaactaatgtaaagtgtctggtacgtggaagaattctataaataatacttcttttttcatctgcttccatttttaggtatactttgcattttcaaaaatgatgtaatggcatacttgttagatggacatttattgtggggatttcaggctgcctgattcgtggatgagggagaggtttgcgggtcatagggctttttcaatacctttatactcaataatatgcatttaacactttacaaagtcatagtacctcacatccaggtctacatgatgcacaaggattaccctcattgtgcctcaggagatattattgtaacctttgttttgcttacataacttcctttaagacacagtatacctgtcccctgggaatatgctgagataagtattcttcctctgtattgcatagtgccttagcacacataccttcattcatagcatttatatgctctgttatgtctgttttctccatgagactgaactctttgaatgtaggtactgttcctcgttcatatttatattcctaatgttctgcacagtgcctgattctttgtagatgtgctataaattacatattaccaacatttatgagtaatgctaagtgctagatgctgtctctgtctctgttttacagacggtagttaagtgctcacggtaacacagttcagtggtagagctagaattgaacaccatgatagcttatttgcagggcccatgctcttaaccattataatataatgtctcttccctgagaatggaagggtcatcatctggtatattgtaggtcagtgtagcccagagagggagtttggaacatttaattggtaggaccaagaacctgaagcacgccttacctgaaagcaagttgggggtgtgtgtgcatgtcctgatgcttggaaaagaagttatattttaatgcacatagtctgctatattatttgtactactggtattgaaggtttagataaaatttgtatctctgaaatgcactttcttcattaaaaatgaatttctatagtgatatagagtgaaatttcctagtaagcccccaaatcgcttaaaatggatgtcatcattgactgtgctcccttatacgttgatagcagggttaagatgattgatatagctttagggaatttgctatatttgtagtggaaacagcgtgagaagaaaagtgaagatgctgcttgtaacagttaaaacttcagatttcttaaatgcttaggagatgaactgttccagaattttgttttattgtatttttatttacaactgattttatctccttaatatcaatgtatttttcattttcaatactttggttaaattttttcctgctgactcatggctgtcattacagctgttacagtaaagtgttttagagatgctgtaggatctgttgagacttgtagaactatttgcttctacaatatatgatcccggattgttgtactcttcttatgttccttgaacagcttttgcattttcttctatgtcatgccttagtgtgccttccttcagctccttatctccttcttctgattttttgcatgctcaaaaccagttggccaaacagatttagaattgtacatgaaggactaaggtgtgcgtcagttactaacatgaatgtgcatttgtgcttgagctttgtgatatctattctgtctctgaggcctcttttttacttgtttctttactgtgttttgaatagatgaagttactgcaaaattggttcattctagacatactataaaatgatgtcaattttcagtctgtctattaaaagggatagtttggcttaatagtcagaagttcaggtacttttccagtagattgttttagtgacattttgcaattgattattattggaaagtaaaattctttctgccttaatgaaagaaattgtgctttaatttatcctgtttaaaaggaaaagtcaacaaatattttgggtgataaattcatgaccagcattcatttgggcacgttgcataactgagctatagttattgacccagaagaagtaatacctcatcaggatagcaaaggattataattgttttgaaagatcaagacgctagccatggatttaagagtggagaactatgaaagcacttggtgtttaggaactctgagaggaactgtagaatgaaataaagtagagcataataggaaggtggaagctgataaagacagagcactaaattagtgtggcatactttaattaattagtgtgtgtaagagaaataaaaatgagggggggagtaggggaagggatttctggagatactactctgtagtttcatatttagaagacaaatcaaagctgttaatagactgttgactttgagctgcaattattgatatcagtatgagaaacagtgggctgacatcagaatttaaagggctaaggtggtaacactatgtaatggagaggctttaaaatcagacagtcctgggttagattcctggcatcatcacttctggctattttgacattggataacttcatgttttctaaaaagcctagaaaacgtgtaccagtgcctgtctttctctttgtattcatcattttggtagattactggaagatgactgtttgggcctaaaggaagctgtccagttttaaattgttgttgttgctgtatatccttacatataatttattgtcaggtatatgatttgcaaatattttctcctattctgtaggatttttcacttttttttttttgaaatggactctcgctctgttgcccagactggagtgcagtggcacaatcttggctcactgcaagctctgcctcccaggttcacaccattctcctgcctcagcctcccgagtggctgggactacaggtgtccgccaccacacccgactaattttttttcttgtatttttagtagaaatgggggtttcactgtgttagccaggatggtctcgatcttctgacctcgtgatccacccaccttggcctcccaaagtgctgggagtacaagcatgagccacggccccggccgatttttcacatttttgataatgtccagtgatgcacaagttttacattttgattaagtccaaattatctattgttgctcatgcttttggtgtcatgtctaaaaatcctttgccaaatgtgaggtcataaaaatttgtttttatctaagagttttagctcttaacaggtttttgatccattttagttaatatttgtatatggtatacacaaatgtatatgtatatggtgtatacctcattcttttgcatgtgactatccagttgtgccagcaccatatgttgaagagactttcctctcctcaatgaacagtcttggaacacttatggaaaatagttaaccatagacacgtggctttatttctggactctcaattctattccattgatctatccttgtgccaacaccacactgtttgattaccactgctttatagtaagttttgaaattgggaagtgtgagtcttccagctttgttctgctgtgattacctttaaagattaatctttgctgaaaaaaagtcccaaggaacagggacaaagtacagtgtggttttgacaggggaataaatactctgggaggctgtagctgagatagatagatttaagtgctcggaggctgataataaagaaatgaataaaaaagtaaaatatattgaacacctattatatgtcagctgttcatatatcctcacaacaaacttgaggaagtgggtattggctccccatttttacctagtaacattctgagaattaatgagatgaagtaatttgcttgtgcagctagaaagtgacagctgaacctatgtcattaagcttctaaaggcctattaccatgctgccttgataatgaaactacctgaataaatgtatcaaccagggtctaatcaagagaaagaaatcacatgagttatttgaacaaagagaatttaatataaataattattatgtaagtatattatctactgtaaattaattgaaagggtaaaaaggtatttttttacccaggacagataaggctttcctgtccgatacaatagccactagctacatgtggcttttgagtacttaattatgacttttacaattagctagtcagtttctacaaataagtcagttgagagtctgatgaggattgtgttaaatctgcaggtcactttggggagtattaccatcttaacaatattaaggcttccaatccatgaacatggtatgttttcccatttatttagatcttattctgtttttcagcaatgttttatagttgccagaatataaattttgtactttttctgttaaatttatttccaagtattttatgtttacattgatggaattgttttaaatttcgttttcagattgtttattgcacatgtatagaaataaaatctatttttgtatattgatcttgtatcctgcaactttgctggactcatttttttacttctaatagtcttccatcaattctgtaggattttctacgtacaagctcatgtcatctgctctgaaaaaataaagtaaaaatagttttacttcctcctttccaatatgggtgcctttttttcttttaaaaattatttccctgagttttccaagatgaatttcatttccttttcttggttaatttccctggatagagcttctagcacaatgttgaatagaggtagtgagagcagacatccttgttttgttcctaattttagggggcaagcatctaatgttttatcatcaagtatagtgttgtagacttttaaaaatattacattaaattattattcatctttctttcttagagctgagggtcttgctgtgttggccaggctggtctcaaactcctgggctcaagtaatcctcctgcctcagcctcctgagttgctgggatttcagatatgagccactatgcctagcatattcatctttattactgaattttttttgcaaccccttaaatttctgtggttgaggtgagaccctcacttactttacatcagttttggccctgtggttatagaagatttgggggaaattgtaaaaagtcctaaagattctgaattcagattgttttgcaagtgtctttatattctatatctgttttaaagaaaccaaatctgtaactgacagttcatgcattcatcatggtagtgaggttaattttaagatgccatgccaagatttaattaacaggcatttgtgcaaatcaacagccttagttctatatcaaatgataaagtaaaccatatcctactttaacttttttgatctattgttgaactgtgggtctgaatgtgttccataagatggtttctactgtggctatgaagattgtagaaaagatagagctacctacacttctctttatgtcttctgtcattttcttaaatttgctaaaaatatttgttatagatccagaaaaactgttacctttattcagacctgcatgctgtactcccttgaatcccttgcacagtaaaagtagagtgacctaatttagtaacatggtgatttctgctggaaagatttgtatctgaaatactgctttctaaggagttctgactggtgatttgccagttttttttttttttaccatatttgaaaatcacttactaaaaagagttaaaactctagtacattgactatatgaattttatcagaacaggttttaattgttttacatttaattgacttgtggcttttgatcgaataggatgttaaacagtatttcatctatttagagggaaatactttgtctttttaatgtaatattgaggaatatgataaactcctaaggaggcagtttataatttaatacagtactcacaatatttctaagactgattgtgatgtataaatcagagtggaccttaaagagggttcttaattcatattagcctatgtcattttagcaaaagattaatacttattttttaagaaatgtgataataaacttgtcattgataaagaaatacttttatgtcttcttgttgttatttagatgttgcttagtgtttgagcacggactttagatttcagctatagattcacttaaaaaccagaattcttcagcttaaagacctcttgcacaaagaaagcaaaatgatgtttttttttcttttactatactagaagaatatcatgttataaaaatgctgcttgcatctagatttcaagagttacttggaacttaataatattttattatattagagatataggcatttttgttttaagatagtttgtgaatctcattttgcttggataaacagctttctgataaggtgatcactgtaatataaaagcacttaagaattttaccctttggaacatggagggcaaattgaattatagcttgttagcatggagatgaggaaaaaaagaaacaacctgcacctgcttgcttaaacgcatcccaaattgaaagctttaatacatgaagccacttagttttccctataaaatgctcagcagttttttatcttcactcaatttatctatagatttccacttaaaatcttttgtaagcgtttttcttctttctccttcattgtctttttcttgtttgtaatttattgtgggagaaataggattttccatggtaactaggaccctgagaggtgttttatattctgtggtttcagattttctcttggtttctctctctctctctctctctctctctctctctctctctctctctcctctctctctctctctctctctctcctctcctctctctctctctctctctcacacacacacacacacacacacacacacacacaaattgagattggacatcttttcttatgcttattctttttattgccattcttctgtgaaaggcctgttgaaatatttgctcacaggattgctcacctttgtttcattatgttttcttttttttattattatactttaagttttagggtacacgtgcacaacgtgcaggtttattacatatgtatgcatgtgccatgttggtgtgctgcacccattaactcttcatttaacattaggtatatctcctaatgctatccctcccacctcgccccaccccacaacaggccccagtgtgtgatgttccccttcctgtgtccatgtgttctcattgttcaattcccacctatgagtgagaacattcggtgtttggttttttgtccttgcaatagtttgctgagaatgatggtttccagtttcatccatgttcctacaaaggacatgaactcatcattttttatggctgcatagtattccgtggtgtatatgtgccacattttcttaatccagtctatcattgttggacatttgggttggttccaagtctttgctattgtgaatagtgctgcaataaatatacgtgtgcatgcgtctttatagcagcatgttttataatcctttgggtatatacccagtaatgggatggctgggtcaaatggtatttctgttatgtttttagaatattttatgtataatgaatattaaacatttgcctatgttgcacatctcctggcttccaatctcacacccccatgcctcttcttaattatgtttatggtgttttgtaccatatacaattgcaactttttgtaaccagcaaacttaaacattattttctttatgggctctaagttttgtgtcaacccttagaaagattttgtgactcattaaaaattgttttaaaaaattctcctttatctgtcttctagttttttttttttcttgagatggcgtcttgctctgtcggcctgactggcgtgcagtggtacgatcttggctcactgcaacctccacctcttgggttcaagcaattcttctgcctcagcctcctgagtagctgcgattacaggtgcgcccagctaattttttgtattttgttttttttttagtagagacggggtttcaccatgttggccaggctggtctcaaactcctgacctcatgatctgcccacctcggcctcccaaagtgctgggattacaggcgtgagccactgtgcccggcctctactacttttttttttttttttgagacggagtcttgctctgtcgcccaggctggagtgcagtggcgcatctccgctcactgcaagctctgcctcccagattcatgccattctcctgcctcagcctcccgcctagctgggactataggcgcctgccaccacgcctggctaattttttgtatttttttttttttttagtagagacggggtttcactgtgttagccaggatggtctcgatctcctgaccttcgtgatccgcccgcctcagcctcccaaagtgctgggattacaggcgtgagccaccgcacccggccctctacttcttttacgattttttcatattgcaatatttaatctatctgaaacatatggtatagataggattttaatctcctctccccagcatagccagtttcccctaaagtgttttttgagaagttttatcttcctactgatttcaattgccacattcatgatatagttaataaccatatgtattttgatctatttttagattcgactctgttcattcctctgtctgttcccacactagtaccacactgtaatagttactatatatattttttactacattttaatatccactggaaaaagtttccttgcctctgcctccacaaccaccctccccaaacaccagccatgatgtttattgcttatttttcttttttaagcttattggacaatttttatgtgttcagttctcccaatgaactacagattcaacgtacaaaatgtccaccttctccacaaaaaatctgactcttttagggaatttgattgtaattgtattgaatttgtgtattcaatttgagggaagtttgcatctttatgattttgagtttgtctgttcctggatatggtgtgtgtgtgtgtgtatgtgcgcgtgagtgtgtgtgtttccatttattcagggtcatttattcttttatgtgcttccataaaattttatttttctttttatttatttatttattactttttttgagatgaagtctcactctgtcgcccaggctggagtgcagtggtgcaatctcggctcactgcaagctctgcctcccgggttcatgccattctcctgcctcggcctcctgagtagctgggactacaggtgcccgccaccacgcccggccaatttttttgtattttcagtagatacggggtttcaccaggttagccaggatggtcttgatctcctgacctcgtgatctgcccacctcagcctcccaaagtgctgggattacaggtgtgagccaccgtacccggccataaattttatttttcatatgtctttcatacatcttttaaagcacatttgtaagttttttttttttttacaaactttgctgctctcaggtaggtggtattttttccagtacttatagaatatgatattggtggaatataagaaatccttgttttcatggacctgacattcttgtaatgggcctctcattgtgctaatttttcagttgatacttttgcattttccataaaccttatgttacctataaatcattaatttttagacaatcatttatgatcctgcagcagcaacattcctcaggaacttgttagcaatgcagattctctagaccgatcccacaccaactgaaggagaaactctttccagcaatttgtgcttcacatgtctccaaactctgatgtatgctcaagtttggagaccactgatgtaaataataattttatgctgtcttgctcatattttcatttctcacattttttaaattgcaagatgtgtgtgtatcagggctcagtggattacatagaatgagcactgactgaataggctgagacaaatcgttaacatccatgggtaagatgggaggggaatgatgagacatgaattattccttaatttcttaattccttaattaggtgaataaggaaaaagtaaatcagagagagagagagagaaggaaagaaagaaggaaattaagtatacaatttagggtgaggattttagtggttgacagagggaagtctgattcaaagatcactcctatagataagtaagaattgtaacattatgaaattgaaagaaataaagacagctaagcctaagcctggcatttgatacttaatgaatgtttgtaagatgaagttcagtctttgccatatgagggtcaccaccattagaaaatcatatagaattgcattaatacaaggataatactttcaatattggcaaaaaagccaattgcaatgatgagtcagatgataccatgagccaacaatatacctcaaaggcattcctaaagcctattatgaatgacaacatgagaagggactaccaagggatcttgtcaggaaagaaggaggccaggtgtggtggcttatgcccataatcccaacactttgggaggccgagacaggaggactgcttgaggccaagagtttgagacaagcctgagcaatatagtgagactctcctgtctaaaaagaaaaaaagaaagaaagaaaagacgggaggaatgatattaagcagtggaactgcatggtgtatggtgtatacctatagccaacatgaagtacaatgatagtgaccacatggtggtgacatgggcagattgcttcagtgactatagaagggaagctgaaattgttgagaagagtgtgtcagccactctggcacttggccaggaaaagggagaaacctaagaaacatgggaatccagtctttttggtaggagtttagacctaaaagtagctgtgaacatacctctctggaccccctagttgtagcataagatgctggtcaaggggaaaccaggcaggctgatcatgtacttaaaatgagcgttctgaaataggctttagctgcaacctttagtatagtgcaactgttattttgttagggtgcgtgtgtgggagcataccagatagacctatcaatttttagatttactgtagtgaagaatcaccactcaatgcaacagttagtgctcaggtattttaggataagacctctttagtgccacaggtgggagaggagaataagctaaatgattctatgatctaacactctgggacatttaaaaaaatcaacttttgtctaacaaactattttttaaagaacacaattctgttaaacttcagattttgcattttcaagatgattttgaatttttgtaatgctgctatatataatttaatttagaggagtgcaattatgtgcagtttttctagattttgcggttttttgattttgtcgtgtttagcatttttcactaatcctttctgtcagttttcttttcttaccacagtacttatcaaaattttatttgaagacagagtactagagaaactcctaaaatttcttttatatagcatcagtttaattcataagtgagacttaccttatgtagtgtgaaattggctaaggatatctcaaatctgattattttaaagctattagtttttggacagagtaggaaagagtgatacagtgggttttaattaaacgctaggtcataaactggaatctttatttgaaatattatctaagataggtgcttgagaaatattagatttgtgaattacttaaatacttatgaataaaattgcttgaacttatgcaagatatctcaactatcataagcagttttgtcagttttgtttctggtgagctatattgaatattttaagggcaaaactacaattaggtcgttggcaggtatgtgctctgagtaatgattagtttcccttttattcatgagggtgtcatggccaggggaaagtgtgcatttttaattacaatacttgtctcgttatatttttgttctgtctggttttatttctttgaaagctctttaaaaaaaatgttggcctttctatgtcatatcccgtctgcacatctacatagtcccgacttcagggcagaaataatattttctactttttttgtttcttctttattagaaaattccaaacatgcagaaaagtacaatataacagttgcccatgtagccaccatgtagctgtgtaaaacctcaaaattttgccatttttgttttagatcctcaacaaaaaaagatacaggtgaagctcctagagtatccttccacaattgcattttcctactatcctctcctgggggaactactgtccaaaatttggtatttatcatttcccttattatttttgtcctttttctatatctgtgtgtatgtgtgtgtgagtgtgtatgtatatgtgtgtacatatgtgtacttgtttacttcttcagtttacatttttgtctaatgtaatgctattcagatttacctgctctagtatctcctattatgaaaacaaaataaaacaaaacattaactacttgtacattatgtctcatccaactgccacccatttctctactctctattaaaggaacactccttgtaagagttgtgtacttatttcctctctcccttctaattcttaaactcatactaatcagctcatctccattactccacacaacccagtcttacttaacaaggtctccagttgcctctctgtcactacactaagttgtcatttctcacttccttacttaatctctcagcaacatctgacacacttgcttactcttttcttcatataacaccttattttgtcttctgggttaccacaccttcctggtttcccttcgagcccacggcctctccttactcttttttaccagatcctttttgtctttttatttcaaaatcaattgagcaaaaaaaatacaggattaaaagtaaacatctctcccatctcatattccttctcacaaataaaggctataaacaggctttatgtgttgtgcatgtgcatgcacatgtgtgtgaattcataggtgaaaacagtgcctcaattaaaatagcatttatttgtttcctgtttctattatggttggtgcgaaagtaattgcggtttttgtcattaaaagtaattgcagttttaatggcaaaaactgcaatagctttcacaccaacctaatattggttttatatgtgcttcttgcttatattatttccttattttaccattatatgttattgttttcactaatttgtgtaagttaaaattattagccctttgttgcctgtcatgtgtgttatgaattatttttcctagtttatcagttgcctgagggccttggcatatttgaagtacagagttttaatttttttctatgatcagattgaatagtctgttatgatttctgatatttgggtgctgcttgccttcttcactgcatgattataaataatttcacttaggttttcttttggtactctttcagcttcattttgttacctttaaattttgatccttctggaatgtatttcagggcaacaagtgaaatagtggataacctctgctttttaaaaaaaataaacacaaccaaatggctacccagttgtcctgaaatcacttattcaatcatccccccttctcttacttgtttgaaaggccatctttaccccagagtaactccctgctgtatttgcattcctcacaagatcttgaaataatttatttatttttgttttgtttttcaagccactgcagtaaagttctccccactgatattgaaactgctcttggtaaaggtcaccactcatattataattgttaaatcaagtagatgtatcttacttggtcttgaatttgttgaatgctgttgaactactcttcctttttagcttttatctcacaattctcatagtttccctcctaccgttctctctgttttccttactaatttgtcttcttccatttctttgggattccaccttctcatggggaatatattctttttctgctttttatttatttataatttttgtgggcacatagtaggtgtatatatttatgggatacatgagctgtttagatacagacatgtaattggaaataagcacatcatggagaatggggtgtccatcccctcaagcatttatcctttgagttacaagcaatctaattatactctttaagttattttaaaatgtacaactaagttgttattaactatagttgctcctgttgtgctatcaaataatagatcttatttattctatctaactgtagttttgtactcattaaccatccccacttctccctacccagctacccttcccagcctctggtagccatcattctaccatctgtctccatgagttcaatcattttaatttttagctcccacaaataagtgagaacatgtgaagtttatctttctgtgcctggcttatttcacttaacacaatgtcctccagttccatccatgttgttgcaattgacaagatcacattctttttgtagttaaatagtactccattgtgtatatgtactacatcttctttatccattcatctgttgatggacacttaggttgcttccaaatcttggctattgaatagtgctgcaataaacatgggattgcagatacctctttgatacatagattttctttctttggggtttgtaattagcagtgggattgctggatcatatggtagctctatttttagtttgttgaggaattgccaaactgttctccatagtagtggtactaatttacgttccaccaacagtggacaagggtttccttttatctacatccttgccaacattagttattgcctgtcttttggataaaagccattttaactgagatgagatgatatctcagtgtagttttatttttatttttattttttggagacagagtctcactctgctgcccaagctggagtgcagtggctcaatctcagctcactgcaatctctgcctcccgggttcaagcaattctcttgtcagcttcctgagtagctgagattacaggcatgcaccaccacgcccatctactttttttgtgtgtacttttagtagacatggattttcatcatgttggccagctggcctcaaactcctcacctcaagtggtccactagcctcagcctcccaaagtgctgggattacaggcgtgaaccatcatgtctggccctcagtgtagttttgatttgcatttctctaatgatcaatgatatcagccacctttttattggcctgtttgccatatgtatgtcttcttttgagaaatgtctattcagatagtttgcccatttctttttctttctttttttttttttttttgatggagtcttgctctgtcgcctaggctggagtgcagtggcgcgatcttggttcactgcaagctccacctcccaggttcacgccattctcctgcctcagcctccctagtaactgagactacaggcgcctgccaccatgcccggctaatttttttgtatttttagtagagacagggtttcactgtgttagccaggatggtctcgatctcctgaccttgtgatctgcctgccttggcctctcaaagtgctgggattacaggcatgagccaccacacccagcctgttttgcccatttcttaattggattattagaattttttctatagagttgctgagctccttacatattttggttattaatcacttgtcagatggatggtttacatgtgggaaaaaatagatgcaaattatccatctatcgttgtctcttcattttgttgattgttttctttgctgtgtagaaactttttaacttgatgtgatcccatttgtccatttttgctttggttgtctgtgcttatcaggtattgctcaagaaatctttgcctagaccaatattctggagtctttccccaatgttttcttttagaagtttcatagtttgaggtcttagatttatgtctttaatccattttgatttgatgtttctatatggtgagagataggggtctactttcattcttctgcatatggatacccagttttctcagcatgatttattgaagagactgtcctttccctaatgcatattcttggcacctttgtaaaaaatgagttcattgaagatgtatggatttatttctgggttctctattctgttccattggtctatgtgtcttttcttattccagcaccatgctgttttggttactgtagctctagagtataatttgaggtgaggtaatgtgattcttctgattttcctttttttttttttttcctcagagtaactttggcaattctggtcttttgtggttcttattaatttttggattattatttctatttctgtgaagaatgtcattggtattttgataggggttacattgaatctgtaaatagcattgggtagtatggacattttagcaatattgattcctccaatccatgaagatgaaatatctttccattttgttgtgtccacttcaatttttcatcagtgttttatagttttcattgtagaggtctttaacatctttggttaattcttaggtattttcctttatgtgtggctattataaatgggattactttcttggtttctttttcagattgttcacttttgacatatagaaatgctactgattttttatgttgattttgtatcctgcagctttactgaatttatcagttctaatagtttttgggtggagcctttaggtttctccaaatataagatcatgttatctgcagtcaaggatagtttgatttcttcctttccattttgtaagcctttatttctttctcttgtctggttgctctatctaggacttcctgtactatgttgaataacaatggtgaaagtgggcatccatattttgttccagatcttagaagaaaggctttcagttttttcccattcaatatgatactagctgtgggtctgacataaacagcctttattgtggtgaggtgtattccttttatacccaggtttttgagggttttctttttatcatgaagcgatgttgaattttatcaaatactttttcattatcaattgaaatgatcataaggtttttgtccttccttctattgatattatataccacattgattgatttatgtatgttgaaccatccttgcatccctggggcaaaacccatttgatcttgatgaatggtctttttaatgtgttgttgaattcagtttgctaatattttgtggaggatttttgcatcaatgttcatcagatatattggcctatagttttctttctgtgatgtgtctttgtttggttttggtatcagggcaatactggcctggtagaatgagttttgaagtattcattcctcctccattatttggaatagtttgagtaggattggcattatttcttctggaaaggtttggtaaaattcatcagtgaagccatctgatcctgtactttcctgtgctggagacactttattacagttgcaatctcattacttgttattggtctgttcaggttttggattttttcatgggtcagtgtcactaggttgtatatgtctataaatttattaatttattctcgattttccaatttattgtcatgtatttgctcatagtagccagtaatgatcctttgaatttctgcagtatcagttgtaatgtctcctttttcttctttgattttatttatttgggtcttttcttcatttttctgtctggctcagggtttgtcaattttgtttctcttttcaaaaaaccaacttttcattttgttgatcttttgtatttttttttttcatttcaatgtcatttatttctgctctgatctttatgatttcttttcttctactaagtttgggtttggtttgctttttttctatttctctaagatgcactgttaggttgtttattagaattttatatctttttgatgtaggcatttataactataaactctcctttaagtactgctttcactgtatcttataggttttgtatgttttgtttacattatcatttgtttcaagaattttttgaatttccttcttaatttctttttataaaatctgctgtgagagaacagcttctaaatttcttcattgacccactgatcattcaggagtgtatattttaattttcatgtgtttgtacagtttccaaaatttctcttgttattgatttctagttatattctattgtggtcagagaagatgcttgatgtaacttcaatttttttgaatgttttaatacttgttttgtggcccaacatatgacctgtccttgaaagtgatccatatgctgaggagaagaatgtgtattctgtgctggtggatgaaatgttctgtaaatttctattagttccatttgttctatagtgcagattaagtccaatgtttcttagttgatttttcagtctgggtgatgtgtccaatgctgaaaatgggttattaaagtctccagctatgattgtattggcatctattgctctctttaggtctaataatatttactctatatgcctaggtgctccagtgtcgggtgcatatatgtttacaattttatatcctctggctgacttgacccctttatcagtataaaatgccattttgtctctttatagtttttgtcttgaaatatgttttgtgatataaatatagctatcctggctctttttttggtttccatttgcatggaatatctttttccattcccttatttttgaactaagtatttctctacaggttatgtgtactttttgtaggcaacagatctttgggtcttgtttttgaaaaccattcagccaatctgtgtctttcgattgtaggatttagtcacgtagattcaatgttgtaaggacttcagccattttgttatttgttttctggttgttttatggtcttctcttcctcctttccttccctcctgtcttcctttagtgaaaataattttctctggttgtatatgttaattttttatatatctgatatatgttttttgatatgaggttaccatgagactttcaaataatatcttataactcattatttaaactgttgacggcttaatactgaatgtgtaaataatcaaacaaataagcaagagaaaaccagagaaaaccaataaaactctacactttaacttcttcccctagctttttaactttttgttgtctctttcttttctttttgagatagggtctcactctgtcatccaggctgtagtgcagtggtgtgatctcagctcactgtagcctcgagacctcctggccttaagtgatccacccacctcaacctccctagtagctgggactataggcatgcaccaccatgcctggctagtttttgtgttttttgtagagacagggttttgccatgttgcccagactggtcttgaactcctgggtgcaagtgatccacccaccttggtcccccaaagtactggggctacaggcatgagccattgtgcctggcctgatgtttctatttatatcttgttatactgtttatgctgtgaaaagttgtaattatatttcactgtgttataatattctgtggttttcagtgtgcttatcattaccagtaggttttgtaccttctgaagattttgtcttgctcaataatatccttttctttcagattgaggaactccctttagcatttcttctaggacagatctggtgttgatgaaattcctcagcttttgtttgtcaaggaaggtctttatttctccttcatgtttgaaagatatttttgccagatatactactctagtgtaaaagttttttgttttccttcaacactttaaatatgtcatgtcactctctcctggcctataaggtttccactgaaaagcctgctgacagatgtattggagctccattgtatgttatttgtttcttttctcttgctgctttaggatcctttctttgtccttgacctttgggagtttgataattaaatgccttgaggtggtcttctttgagctaaatctacttgatgttctgtaaccttcttatacttgaatattgatatctttctctaggtttgggaagttccctgttattatccctttgaataaactttctatcctcatttctctatctaccacttctttaatgccaataactcctagatttgcccttttgagactattttctagatattgtaagtatactttattcttttttattttttcttttgtctctctattttcaaataacctatattcaagctcattaattctttctcatgttttatcagttctactgttgagagactctgactcattcttcagtatgtcatttgtatttttcagctctcgtctgataggattctgaattctttctccgtgttatctttaatttcattgaggttcatcaaaacagctattttgaattctccatctgaaatgtgacatatccctgtctctctaagactggtctctggtacctcatttagtttgtttggtgaggtcatatttcctgggtggtctcaacgtttgtagattttcgttggtgtctgggcattgaagagttatgtatttattttaatctttgcagtgtggacttgtttttactcatccttcctgggaaggctttccaggtatttaaagggacatgggtgttgtgatctaagtctttggtcactgtggctatattttcattaatgggcatctcaaacctcgtaacgctgtggctcttgcaaactcttggagatactgccttggttgtttttgctaagatccagaagaattctatggattaccaggcagagacccttgttctcttcccctaatttcccccaaacaaatggagtctctctctctctcttttctgagttgtttagagctgagggagaggtgacaccagcacctctgtggcaaccaccactgggactgcactgggtcccacctgatgctagcacagccctgggttttgcccaaggctcatggtaaccacttcctggctactgcttatgttcattcaaggcccaagtgctctacaatcagcatgtggtgaatccagccaggcttgtgtccttcccttcagcatggtgagttctccctggccctgggtgtgtccagagatcctgtctgggagttaaagcctagagtcggaaaccttaggaatctacctggtgctctagtctgctgttactgagctggcactcaagttgcaagacaaagtcctccccacttttccccctcctttcctgaagcagaggagccactccttttggccatccttaccccagggctgtaatgagtactatctagctaccagtgatgttcactcaaggctcaagtgctcctcagtcagcttgtggtgaatgctgcctgtcctgagtctttctcttcagggcagtgggctcccctctggccagggcaggtccagaaataccgtccaggagtcaaggcctagaattggggactgtaggagcctgcttggtcctttaccccactgtggtctctccacatagctaacacatctaggaatgttctgggtcacatgtgaagccagcatggctctgagtctctcccaaaacccacagtgagtattgcctcactaccactgctgatttttcagggcccaagggccctttaatcagcagatgattaatcctgcttaggactgggtccttcccttcaaggcagcaggtttcctttttgctcagggtgtctgtagaaatgtcatctgggaactagggcctggaatgggggcttcagaactgtgcctgctgtcctagcctactgtaggtaagctagtatgcaagttgcaagacaaaatcatctttttcccttctgtcctcaagtggaaggaaggagtctctcctgtagctgtgaacggtgctgcctggggttatgggagggctgatgcaagcactcccttgggtgcaccagcttgtgtctcactgggtcatgtgcaccccacatccactggctttgagcccagcataacaccaggacttgcctaggaattgcagtcctagtggcctggactgccttctcactttatttagaatgccagagcgctttagcccatggtagcagggcttgatggaactcaggttctaatcattgggataagcaatttatctcttcctaggcctggtctaaatgctccctccatggtcgttggctgagtttttccccttgttgctctctactctgacagggtagcactgagttccaatggaaagtccccattactgcaatctctctcctctagtgcacagattctccctctgcacaatgtggccactgccaggggatggaggggtggtgatgtaggcgattaagggctgtatatcctacaatcttcagggcctttttccttaatttgatgttaaaacaaggtattgtgatcattcacctgatttttggttgttatgaaagttcttttttgtgtaaatagttgttcaatttcgtcttcctacaggagagatgatcacttgaggcttctattcagccatcttgctctgattgccttcacttgagtaacatttcccaatctcatcacttcacttgttacttaattggctaaatattcctacattgacacttctagttccaatctaaatctagatgtaatcttttcaattttctgttagacactgtttggtgtgtcctatggtacataaatgtgtgtacatcaaacaattgttctccttttttcaatatttttccttattctctacatgctacctcacttgatatcttcatcctcatcccagttatttaaacagattttgtgattttgtttgtgatctccttatccctgtaatacctattcatgatcttttagtcaatcagtcctagttcactctggctatcctcatagacattgtctgggctcttatctcagttcttgactgtagaagaactttcttaactgatctctagatatctagtctatctctcttccatccccatattggagctgtgctaattttcttttcttttttttaattactattatactttaagtttcagggtacatgtgcacaatgtgcaggttagttacatatgtatacatgtgccatgctggtgcactgcacccactaactcgtcatctagcattaggtgtatctcccaatgctatccctccccccttcccccaccccacaacagtccccagagtgtgatgttccccttcctgtgtccatgtgttctcattgttcaattcccacctatgagtgagaataagcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcgaatggtatttctagttctagatccctgaggaatcgccacactgacttccacaatggttgaactagtttacagtcccaccaacagtgtaaaagtgttcctatttctccacatcctctccagcacctgtggtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttttaggtttcctgttcactctgatggtagtttcttttgctgtgcagaagttctttagttgaattagatcccatttgtcaattttggcttttgttgccattgcttttggtgttttagacatgaagtccttgcccatgcctatgtcctgaatggtaatgcctatgttttcttctagggtttttatggttttgggtctaacatttaagtctttaatccattttgaattgatttttgtataaggtataaggaagggatccagtttcagctttctacatatggctagccagttttcccagcatcatttattaaatagggaatcctttccccatttcttgtttttctccggttagtcaaagatcagatagttgtagatatgcggcgttgtttctgagggctctgttctgttcattgatctatatctctgttttggtaccagcaccatgctgttttggtgactgtagccttgtagtatagtttgaagtcaggtagcatgatgcctccagctttgttcttttggcttgggattgccttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggactcctaggtattttattctctttgaagcagttgtgaatgggagttcactcatgatttggctctctgtttgtctgttgttggtgtataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaattgccctggccagaacttccaatactatgttgaataggagtggtgagagagggcatccctgtcttgtgcctgttttcaaaaggaatgcttccagtttttgcccattcagtatgatattggctgtgggtttgtcatagatagctcttattattttgagatatgtctcatcaatacctaatttattgagagtttttagcatgaagggttgttgaattttgtcaaaggccttttctgcatcttttgagataatcatgtggtttttgtctttggttctgtttatatgctggattacatttattgatttgcgtatattgaaccagccttgcatcccagggatgaagcccctttgatcatggtggataagctttttgatgtgctgctgggtttggtttgccagtattttattgaggatttttgcatcaatgttcatcaaggatattggtctaaaattctctttattggttgtgtctctgcccggctttggtatcataatgatgctggcctcataaaatgagttagggaggattccctctttttctattgattggaatagtttcagaaggaatggtaccagttcctccttgtacctctggtagaatccgactgtgaatccatctggtcctggactctttttggttggtaaaccattgattattgccacaattttagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttaacattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcattatgtacccagtagtcattcagtagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgagttcaattcctggatatccttgttaactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacagtgatgggtcttgactctttatccaatttgccagtctgtgtcttttaattggagcatttagcccatttacctttaaggttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagtgcttccttcaggatctgttttagggcaggcctggtggtgacaaaatctctcagcatttgcttgtctgtaaagtattttatttctccttcacttatgaagcttagtttggccggatatgaaattctgggttgaaaattcttttctttaagaatgtcgaatattggcccccactctcctggcttgtagagtttctgccgagagatctgctgttagtctgatgggcttccctttgagggtaacccgacctttctctctggctgcccttaacattttttccttcatttcaactttggtgaatgtgacaattatgtgtcttagagttgctcttcttgaggagtatctttgtggcgttctctgtatttcctgaatctgaatgttggcctgccttgctagattggggaagttctcctggataatatcctgcagagtgttttccaacttggttccattcccccccctcactttcaggtacaccagtcagacgcagatttggtcttttcacatagtcctacatttcttggaggctttgctcatttctttttattcttttttctctaaacttcccttctcacttcatttcattcatttcatcttccgtcgctgataccctttcttccatttgatcgcatcggctcctgaggcttctgcattcttcacgtagttctcaagccttggttttcagctccatcagctcctttaagcacttctctatattggttattctagttatacattcttctaaattgttttcaaagttttcaacttccttgcctttggtttgaatttcctcccttagctcggagtaatttgaccgtctgaagccttcttctctcagctcgtcaaagtcattctccgtccagctttgttccgttgctggtgaggaactgcgttcctttggaggaggagaggtgctctgctttttagagtttccagtttttctgctctgttttttccccatctttgtggttttatctacttttggtctttgatgatggtgatgtacagatgggcctgtggtgtggatgtcctttctgtttgttagttttccttctaacagacaggaccctcagctgcaggtctgttggagtacctggccctgtgaggtgtcaggctgcccctgctggggggtgcctcccagttaggctgcttgggggtcaggggtcagggacccacttgaagaggcagtctgcccgttctcagatctccagctgcgtgctgggagaaccactgttgtcttcaaagctgtcagacagggacatttaagtctgtagaggttactgctgtctttttgtttgtctgtgccctgcccccagaggtggagcctgcagaggcaggcaggtctccttgagctgtggtgggctccaaccagttcaagcttcctggctgctttgtttacctaagcaagcctgggcaatggtgggcgcccctcccccagcctcgctgccgccttgttgtttgatctcagactgctgtgcaagcaatcaggagactccgtgggcctaggaccctctgagccaggtgctggatataatctcctggtgcgctgttttttaagcccgtcggaaaagcgcagtattcgggtgggagtgatgcgattttctaggtgcggtctgtcacccctttctctgactaggaaagggaacaccctgaccccttgtgcttcctgagtgaggcaatgtcttgccctgcttcggctcgcgcacggtgcacgcagccactggcctgcacccactgactggcactccctagtgagatgaacccggtacctcagatggaaatgcagaaatcacctgtcttctgcgtcactcacgctgggagctgtagaccggagctgttcctattcggccatcttggctccctccgctaattttcaaatatatatttgtctatatatatgatctggctaaaaattttagttatatatattatatataactaaatatatatatataactaaatatatatacaactaaatatatatataactaaatatatatataactaaatatatatataactaatatatatataactaaatatatatataactaatatatatataactaaatatatatgtgtgtgtatatatatatatctaaatatatatatctatatatatatctaaatatatatatctatatatatatctaaatatatatatctatatatattccctggctaaaagttttagttaaagttaaatcccacataaacttgatcacatgtgtttacttctcccttcctaacttcatgaaaaagagagtaaggtaatggaaaaactcaataagacaaagagaacaggagtaggagcattgatagttgtaaggttcaaactaacttttacttattgcaatggaagtttcaacttgaatatctccttctacatgaacttctgagagaaaccaactaattcttcccataaaactcctaatattttaagacttggaggtacctggtctgtggaaggcaggaatgtgtcatgagattggatacatgagttatttgttgaaaatctttatgataagtggctgcagttccatatcctatcacctactccctgctcctcaggagaccaaatagtttattttctggagaatctgaataagaatatcccagactcagaaatccaggcacagtaggagggttggttgaaataagaagactgtgttattctgttttgtgctgctataacagagtacattataatttatatataacagattgatttacaatgagcagaaatttatttctcacagttctggaggctaggacgttcaagataaaagaggctggcatctgacaagggccttcttgctgtgtcatcccatggcagaagttggaagggcaaaaagaggcagagggagagagagaacacacaagaggaagatgaacttgaacttgtccttttataaggaacgcattcccatgataatggcattaatccttcatgagggtggtgcccccatggctaaacacctcctgttagaccccacctcccaacagtgttgcattgaggtcaagtttccaacacattcttttttgggggcacattcaaaccatagcagagattaagagaaaatttgcatacctaatttcaggacctgtatgtttcatcctagatgcaattagtgaaacagggcatgagttatttagttttacattatcagatttctagtagtaatctagatatagatttttcccttttcaacatcttctaaataattgtatagtctaaacataattaaaaaattttaacatctcaaattctctcatcactttaacatgttttagaaaaggtaaatcgaaggtcagttcatgtgagagtgtgtaaaatattaatttcatttaacctactcagtttctttacttgtaataacagaattataagcagaaaaatgattgtacaaataaacataaatgatgtcatttgatttatttgctttttagaattatgaaaacccaataaatagagttttttttcctcttctatttcttttccttaaattcaggggctggaagagggctgacgacaatgaagaatccctcctcctgcttgcttaattattttagatcttcacataacttcttttttctttttcttttcttttattattattattttttgagacagggtctcactctaccacccaggctggagtgcagttctgtgatcttggctcactgcaacctctgcctcttgggctcaagagatctttccacctcagccctctgagtagctgggtctacaggcacataccaccatgcccagctaatttttgtatttttatagagacggggtgttgtcatattgtccaggctggtctcaaactcctggactgaagcaatctgctcgccttggcatcccaaagtgctgggattataggcatcagccactgcacccagccaacataactttatgaataaactaaattgcgtattatgcatttttattttcccaatgtaataaattgattttattaacaagagatatttaagtaaaatttacattttgcttcccaatatatctgaaacgaatagaataaatacataaaatatattctaccttcccagtgttatacatcggcattactaaaatgtagatattttagatatagttgagtttaccaaaactcacctactcttttcctacaaaaataatcaccaaaacaaaaattcagtgcaggccaagaaaatatttctatccgctattttatgtctttcgaatttcaaagtactatacctttctagcttatatttttttgcaaccaattctaaaattgtgttccctgtttatagacttctcagaccccaagttcctgaggtaacatgggaatcagtgctgtctctatgtgtgtgtatctatgtggcatgtatttgcctcaactccccccttctaacttctcttgtctaacccaacttcatacagggtccttaggtcttctgattctcagtttattccaatttcctgtataaatagtccctcttgtctgcaggtggtatgttccaagacccccagtggatgcctgaaaacgtggagagtaccgaaccctatatatactatgtttttttgataactgagaccgctactaagtggctaggagacaagtggcatatatagcatggatacactgcacaaaaggatgatttacatcccaggtgaggtgcagcaggatagtgtgaaattttatcctgccactcagaatggtgtgcaatttaaaaacatgtgaattgtttattttgagaattctccgtttaatattttttgaactgcagaaggccaaaccatggataagggaggactactccacttggttgcttttccatggataatcattagttactgatttcacatgaaatttagtcaatagtatttagtgattcactattaaatttcatagatatttttactttcagttttttaaataagattcaatttcttaattttcttaagatgtaatatgaacattaagtacaggggcatacatttttcctttaattcaaccatgaaaagtataaaaatattataaaaacagaagttgaaaattccagtgttaatcttcatagtaaatattggcttcttttcctcctgaacaggtcattatccaacttttagaggtgatggatcatctgcatagaggggaattggttgctgcaatacttcgtaaccggtatatttatggaaatagtttaacttatataacgtctttcctatttatatacctaacatagcaggcattcaataaatatttgttgaatacttggtataaagtaagtatttactgtatgaatgagttagagaatgactaagtgacaaagaaattgaataaagaggatgttagtgacaatgtttcctgagataatgaaaaaatagagaatatatttagaaaatgtaattggtataaattatgagcacctggaatacaatcagtggagatatttatttgaatttttagttttaaaggcatatctgaataaatacaggtatccatagcttaagaatagaagtgccaacaacacatttttaaaaataggattgtcctgtgattgtatatatttatattatttaaaaatccagttaaaaccttttcagggagttactatgagatatttaaagcttcttctgacaaattaggattttaaatttattatttaaagaaaaatagccttgtttgcaggtgtgacagagtctgtcttattcccagtagcttgattgtacagtttggatgaaacatttggaatagtatgtttgagttgtctgtatcctggctctgatgcttactagtggtatagccttgggcaagtttcgtagtcattctatacctcaatttcctcacctatgaaatggtgttaataatagtacctacattgcagggttgttgtgaagattaaataagtgtgaaaggtggggcatgtatgaaagtgtgtgtgtgtgtgtgtgtgtgtatgtgtggagagagagaaaaaatagagagcgggtgtgagtgagtgagctgggcagatagtaagcagtatatatgagctagtatgagggaacttttaaaagttcatggaaaaaatggaaataaaagataaaaataaaaaacaactgtttcttaatataagctccacccaaatcaagttgcttttttaagtgttgataccagccatttaaagaactgagcgtcctgggaatttaaccatatcaatgatgtttcttttacattattaagtgaagaaaaatgggtgctctttaaagggtttttaagactaggaaacaaaaagaagtcagaaggagccaaattagtactgtaagatgggtgcttaatgatttcccatcaaaactctcacaaaattgcccttgtttgagaaatgagcagaagcattgttatggtgaagaaggactttctgctgaagctgtcctaggcatttttctggtaatattttggtaactttctcaaaacactctcataataaacagatgatatagtcctttggcccttctgaaaatcctcaagcaaaacgtcttgatcatcccaaaataactgttgttgtgacttttgcttgtgaccagtctgcttttgttttgactgggttacttctaccttttcctagccattgctttgattgtgcttgtcttcagaatcatactggtaaggccatgtttcatttcatgttacaattctttgaagaaatacttcaggatcttgatcctacttgtttaaaattttccattgaaagctcttttcttgtctgcagctgatctatgtgtaattgttttggtagccatcaagtggaaagtttgctcaacttgaatttttcagttggagttgtgtaagctgaaccaactgtggtatctatggtgttgggtatcatgtctgctgttattcgctggtcctctttaattagggcatgagcaagattaattttttccttgcaaattcatttggatcatctgctgctgagggcttcatctttaacatcatctcatccctttctaaaatgagttatccatttgtaaactgctgatttctttgggggcattgtccccataaacttttcataaagcatcaacgatttcatcattcttccacccaaactttgtgataaatttgatgtttgttcttgcttcagttttagcagaattcatgttgctttgatagaggctcttttcaaactgatgtcttatactcagtgcttcaaactgggtcctgttcaggcatttataacacattactatgagtttattttcatgcaaaaaaattgaaatccatgcatagtttttttcaaaatacacattttgcatgaactttttgaagatccctcatattattcaaatataaaagtgagattttaattattttgaaaatgtagtatttgtgtttttcaattccgaggtattttaaaatacaggcatgttgtaaaatgaacagaaaacgtaggaaaggttgaggtaggaagggaacatatataaagttactgttacttgacagataccatagaaggaattttccataataatccaattagagaaataacatgatgggtgcctgtttgttggaatgtatacagtagtccccctttatccatgcaggatacatttcaaggctccaaggttgcctgaaactgaggatagtaccgaatccaactgtcatcaatcagaacatatttctgctcatctcttctactcacaaatataaacattttccatcttaactaagcacttttcatacactgtggtcataacttttgcagtttgagtgtgacagcagaactagcacaagctgcttcttccttctccacaatttcaccaacagatttctttcttactgttgatctgagcaacctcagcatgtgttttttaaaaattaattttgttttaagttctgggatacatgtgcaggatgtgcaggtttcttatgtagttaaaacgtgtgttctggtggagggagaacatacttttgtaagtcaagaactttgaccctttcacttaaaggaaaccctttatggcttctctttgatatatccaagtcaccagtatcactattcttgcactatgggccattattaagttaaataagggttccgtgaacacaagcactaaatacctcagcagttgatctactaactgaactggctactaagtgactcatgggtgggtagcatttacggcaaggatgctggacaaagagataattcccgtcgtgggtggggtggagtgaagtaggatagtgtaagatttcatcatcttactcagaatgacacacaattgaaaacttataaattgtttattcctggagttttctatttgatattttctttagaatgtggttgaccatgggtaactgaaaccaggggaaagtgaaaccatgcataagcagggactactgtactatcatctgggctagggtggaatattcagcttaggggctgtaaaacagacttgctcacagatacagaaaataggggaatcatagcagggataatatgtggccatgttgggtgaaaacaggagtagatcaggggatgttgaatttatagctgcatgtatcagtagttccttctttattgttgctgtgtaatatttcattgtttaaatatgcaacaatttattctatctattttcctgttgatagtcatttaagttgcatccacatttggctataatgcataaaactgttattagaattcttgtataaaatttattttggccacatgcactcattttgtttggatttacagtatactagaagtggaactgctgggacatagagtaagctactgttgtttaacatttgtagaaactaccaaacgttttttgaaaatagttgtaccattttatactcccaccaataataagtgagaatctttactaacacttgatattgttagcttctttaattttagccattctgtgggtgtgtagtacttcctcattatggttttcactcttcattttcctcatgtgtaatgatatgaataggttttcttatgtttattagctatttggatatattttagaagcatatgttcaagtgttttggccatttaaaaatgggttattattttattttgattattaggaggttttagttcactctggatatataggtatttgtactgtgaatatttccttccagtccatggcttaccctcgaattctggtatttgtgtcttttgatgagcagtagttctttttaaaatgaagttcagtttatcatttttcttctgttatgcttggtgctttttgtatcttgcccaagaaatctttgctcttccaaatttgaggttttcttccaaaagttttacagttttagccctcacattataaatgcattcttgaccgcaaaccagagaagtgaatgtatggcctagattccacataagatctaagtgattaataagaccactttacagaagaaaagttctttgtacttttaattctaagctaatacctttgtaaatggcaaggtaactgaatgataacttgagctaaatctggcattgcagagagacctagtcttatggaccctagtttataacacaatgacttttgagtcttctcttgtaacctttcttataaataaagcccctttgaaagaaatataattctgattctaagtaatgtgatccagaacatagaaaataatgggaagttgcatagttcaaatgtcaaaacctgagcaaaacgttgcttgcatgcatatacaaattatgggtcagtttcaaattccaaatacagtaaaacataggaaaaggctcacatctggaatcacagcactttgggaggttgaggagggtggattatctgaggttaagcgtccaagaccagcctggccaacatggtgaaatcctgtctctactaaaaatacaaagaaaattagctaggcatggtggtgcacacctgtaattccagctatttgggaggctgaggcatgagaatcgcctgaacctgggaggcggaggttgcagtgagctgagatcgtgccactgccttccagcctgggtgacagagcaagactccgtcaaaaaagaaaaatggaatatatgaagggaataaactctttttgactaagaaagttttatcccagcatgagaatggtttaagatcgtgaaagttattcatagaatgcatagatgtaatgagaaccaaaagttaaaatccaaaggtgtttgaaaacaattacatgctccttttaagaatagaaaagagcccttaaaagacatgtaccctaaaacttaaagtataaaaaaaaaagattagtgacagaaacttgcacttataatatgaaaaaattatctctctgaaacaacaattcagcatcacacttaatggtaatatgtaagagttgttccttaagcagcaataaaataagaatgcccacaatcaacataatattgaatatatatctgtaaattctgtccaatgtcagtaaagaggcataattaatggaaggaagaagagaaaattaaccaattcctagaagataaatagtgctgggaaaactgtatatccacttgcaaaagaatgaaactggatccttatattacattgtacacagaaataaacgcaaaatggattacataccaaagtgtaaggcctgaaatcataaagcttctgaaagtaaacacaagggatcagagctatcaggaagagcttgacaaaaaagaaaagaaaacacaagggaaacactccttgatactggccttggcaatgatttttttggatatcaccccaaaagcttaggcaacagaaacaaaaataaacaagttgggactacataaaaatcttcttcatgggaaggaaaacaataaacaaaacgaaaaggcagcctacatattgggaggaaatatttgcaaaccatatatgtgatgagggttaatatcttaacataacttacataactcagtagaaaagaaacacaccaaataacacaacttaaaaatgagcaaaggacctgaatagatatattttaaaaaataatacataaaaatggccaacaggcatataaaaaggtgctcaacatcacatcatcagggagatgtaaatgaaaaccacgatgagatatcaccttgcacctattaggttggccattatcagaaagacaaatgatagcaagtgttggagaggatgtagagaagagaacccttacacactgttggtgggaatataaaatgatacagccattatggtaaacagtatagaagttcctcaaaaacctgaatacagaactaccatatgacccagtaatcccacttctgggtatatatgcaagagtaatggaattagcacttcctcgagatatctgtgctttcatgttcattgcaacattatacacaatagctaagatatggaaacaactttcaatggatgactggataaagaaattgtgacacacacacacaaatgggatattattcagtcttttaaaaaggagataatgcctagagaaaatttttacaatctacccatctgacaaagggctaatatccagaatctacaaagaacttaaacaaatttgcaagaaaaaatcaaccccatcaaaagtgggtgaaggatatgaacagacacttctcaaaagaagacatttatgcagccaacagacacatgaaaaaatgctcatcatcactggccaccagataaatacaaatcaaaaccacaatgagataccatctcacgccagttagaatggcgatcattaaagtcaggaaacaacaggtgctggagaggatgtggagaaataggaacacttttacactgttggtgggactgtaaactagttcaaccattgtggaagacagtgtggcgattcctcaaggatctagaaccagaaatgccatttgacccagccatcctattactgggtatatacccaaaggattataaatcatgctgctataaagacatgcacacgtatgtttattgcgacactattcacaatagcaaagacttggaaccaacccaaatgcccatcaatgatagactggattaagaaaatgtggcacatatacactatggaatactatgcagccataaaaaatgatgagttcatgtcctttgtagggacatggatgaagctggaaaccatcattctcagcaaactatcacaaggacagaaaaccaaacaccgcatgttctcactcataggtgggaattgaacaatgagaacacttggacacaggaaggggaacatcacacaccagggcctgtcgtggggtaagggtaggggggagggataacattaggagatatacctaatgtaaatgacgagttgatgggtgcagcaaaccaacatggcacatgtatacatatgtaactaacctgcacattgtgcacatgtaccctagaacttaaagtataataataaaaaaaaaggagataatgccatttacaacaacatggatgaacgtggaggacattatgctaaatgaaataaggcagatatcgaacaaaaaatactgtatttttttattattatactttaagttttagggtacatgtgcacaatgtgcaggttagttacatatgtatacatgtgccgtgctggtgcactgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttctgtccttgtgatagtttgctgagaatgatggtttctagcttcatccatgtccctacaaaggacataaactcatcatttttatggctgcatagtattccatggtgtatatgtgccacattttcttaatccagtctatcattgttagacatttgggttagttccaagtctttgctattgtgagtagtgccgcaataaacatacgtgtgcatgtgtctttatagcagcatgatctataatcctttgggtatatacccagtaatgggatggctgggtcaaatggtatttctagttctagatccctgaggaatcgccactctgacttccacaatggttgaactagtttacagtcccaccaacagtgtaaaagtgttcctatttctccacatcctctccagcacctgttgtttcctgactttttaatgatcgccattctaactggtgtgagatggtatcttactgtggttttgatttgcatttctctgatggccaaattgtctcagcccaaaatctccttaagctgatacgcaacttcagcaaagtctcaggatacaaaatcaatgtacaaaaatcacaagtattcttatacaccaacaacagacaaacaaagagccaaatcatgagtgaactccaattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatgaccatactgcccaaggtaatttacagtttcagtgccatccccatcaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgcctcatatctacaactatctgatctttgacaaacctgagaaaaacaagcaatggggaaaggattccctatttaataaatggtgctgggaaaactggctagccatatgtagaaagctgaaactggacctcttccttacaccttatacaaaaatcaattcaagatggattaaagacttaaacgttagacctaaaaccataaaaaccctagaaggaaacctaggcaataccattcagaacataggcatgggcaaggacttcatgtctaaaacaccaaaagcaatggcaacaaaagccaaaattgacaaatgggatctaattcaactaaagagcttctgcacagcaaaagaaactaccaccagagtgaacaggcaacctacaaaatgggagaaaattttttcaacctactcatctgacaaagggctaatatccagaatctacaatgagctcaaacaaatttacaagaaaaaaacaaacaaccccatcaaaaagtgggcgaaggatatgaacagacacttctcaaaagaagacatttatgcagccaaaaaacacatgaaaatactgtatttgtaaatgtcaaatagaaacacaggggcaggagtgggaagaaatgggaagaagaaggtcaaagcatgaaaatttgcagttaggtgaggtgaataagtctagagatgtaatctatggcatgaggacaatagttaataatgatatattctattctgaaaattttccaaggaagtagattttagatgttcttaccacacaaaaaggcaactctggaaggtgatggatatattaatttgtttaactatagtaatcatttcactctgtctatgtgtaccaaaacatcatattgtacactttaaatatatgcaataaaaatagaaagaaataaaaaggttaggcttgtatatctataaaagctaagtcttaaaaacaaccccttagtgctagaactaatgagttataaaaaatagttggatataaataaaaatttttaaaaacagtaccttttgtctgtatcagaaatcgccatttagaagatataatggcaaacaatcaatttataatagccgtaacaaaaatgtctaggatttatattatgaatatttaaaaattctgctcagagacaggaaagaagacattttaaaaatggacagttatacataccatggttcttgataaaagactgaatgctaagaagagatacattatttccaaattgtcctatacattctacataaatttaggaggatatttaaaaatttggcaaagcaaatcttcaataagttaatgaatatctgaaagaaatgtatctccattattagtacattgtctgctatgtagtaattgctcattaatttactaaataaaggactagtaaaaaatctatatttgttctgtttatgatgcaacaaatatttatggtgtaattggtaagaactaaacattgtcacgtgcaaaagcatgatgaaaagtgatgagttcttctactcattgaccttcttctgggggtgtggtgtggtcagataataaatatatatcacgaagaaaattgttatgaaaaattaataaggtaggtggaaatataaagagttaagagtgagcggaggtcagtgtagaagggcattaacttcttattagccttgcatgtgtttagtcttgtaatctaccatccatcatatattttaccctatatgaagttttattctagtgctttatgagctatagggagaagtcagccacatgtggtttgctttgatggaaacagtatacttatctgaacatcctcatgcatgcattatggtaatgtctaggaggacacgttgtggtgagagtcaccagtttgttgttgtggcggtattttctgattgcattcctggagctaatagcatttctgtaatgctctgacagagtttcagtcttccaaatgtagtctttcatagatgaaacacagtataaaatatcgtctggtatttccaacacaggagaaagagtgccaaacactgtacaatcatatttttaccattttaacaaatattattcaccacttactgggtagggtgctagggatatagcagtgaatgttaatacatggttttctgtgtagtgggaaatacacacaaataattgtgtttcttaagtgctgttgaaaggacatatggggtgctactgactgtgtataacacatatatacaccgggtcttgggagggtcaggacaggctttatgagtgaagtcatgtttcttctacttctctccatttccactctactaccaccatcttagttcaagctactctcatcttttgcctgacgtcctgcaataaccaattggttagttcatttttctctaggttctaattagagttctcttttcagaattcaaatctagccatgttgccttttcgctttcaaattattctatagctgtatcttaattttaggataacatccaatgttaatctcacattgcactactatgcatgaaggcatgaaaaagcatgatgcattcacagagctataatcaaaatcagatgattattaattataataataaggagcaaagtaagaaaaggctggagatgagttaggagagggaggtatggatcaagttaagaagcattttatgtttatgctaaagagtttacatacttcacagactgcagagatctactgaagcttacaaacagaagagtgatgtgatctgccttatactgctagaaagatcactttggtggctgtgtggattatttggggaaggaggacgggaaaattaggagaccagtgatcagtctattgtagcagtcaaagaaagaaatgaaaagagtctgaacaaaggtgatggcagtgggaatgaatgaaagggaatgcatttgtgaaatacttagggatgaattttacaatgtttgggaaccaactggtttcttcacactctaggcagaaggttcttttaaaattgttaatctgataatgtcacctagactgtcctttcctgtttatgactattaaaatcctacttgttcctcaagacccatactgaattccataccctacataaagcctcatctgatcaatccaatcacaagatcaggagagcttcttgcctctgaactactttaccactgcaatgaattttatcatgtttggttctgcattgaagtaatttgagcctttatttgcttatgcctaagggagccctttcagagagtgactggctgtatctaatgtatttttatatcctgtattgtacataatgcaagattttgcacatagtaagctttcagtaaatacctgtagaagttgtaccatttattaacaattactggatggtgattttattcagtaaaatggtttagagtagttttcttttgtttcccacagttaactcttacttatagttaagtaatttaatattaagtgacagtctttaagactgtaaagtaggctaactgaatttagtatagattctaggaataagcccagacttttgtactgacgtaatgtataatcatgtcttcatggtgtagaatgtcaagggaatacagggctgggaatcaggtcattccatgtttaaaaatatttagcctttactatttgtcaagtggtgtcctcatctgtcacatgtaagaattggaagatggaaatctttcttttcattttaaaagtctaaaattatatttttaagacgaagcacatagtacatgctaaagaaacacatatgtgattaacttcatataaaacaaatttaacaaggtgatcagccattggagataagtccttttattaatttatcataatttggttttctcactttcaatgaaggtatcttttctgtgttttttgaagattaaaaacttgtgagggtctggttttatcatgggtgaagtaagcgtggcaataattgtaagccaaatctttggctagaagatctagccaataaaaataataagagggtaacacatgaaattctgagaccagttactttttatacattggaattattttggtttaaaaattctgtaggttttggttatccactattattgtcataagatcttatggtagacgcacatgaaatttatcaccatatttgttcctataactgaagagttgcatgttttcatacaaaggatatgggcttgttagtaatgttgcatgttttatatatttgaaggaattttccaggtcatagaaagtatatctgttcttggggagaataattgctactccaatttcagtcatcctacctatcttgagtgttgctgttcatatttacattcttcctgtgcaatctcatctaccgcaattatttcagtccttgcctacatactaaagacctttcatttatagctcgagtctcaattttttctgagtcccagactaaaagttgtttattttctccctccacaattttttgtttgtttgtttggactctacaagtaatacatatttattacagaacacttagaaaaatagaaaattatatatatgcagggtaaataatcacataagatagcctctgttaacacctcgatgtattttcactctagtcttctgatacatttttaaatgtaactaaggttttacttattgaatatgatctagttatagtagtgtggttaagggtgaggctctgaagtctgccaaatataggtgtcattcaaactctgctacttactagctgtgtgaaatttggaaagtgtcttaactcctatgagtccatttcctcatctgtaaaataaagtgatatcactgtgtgggattgttctgtggattaaataaaatgtttgtaatatggttaagttcctgtcatatggtaaatgctcagtaaatggaagcgcttactgttttattatactatatatcatgtctgtacctccctgtttttcttattagattttgaatattttgacatcagtaaagacttgtagttataatagctgcatggcataagccattctgtggtacaaacaatgtcttaatattagatatttaggccaattccattttgggggtattgggggaatcagcccccaatatttcaatgtaggttcttttctattttccctaagtgtcagctggtctcagaaataaagagacagagtacaaagagaagaattttatagctgggccgctggaggcgaagtcacatatcgtcaggttctgtgatatccacttgagctgcaaaaccagcaagtttttgttagggattctaaaaggggagggggtgtatgaaaagggagtaagtcaaaaagatcacatgcttcaaagggcaataaaagatcacaaggcaaaggcaaaattagaatactgatgagggtctgtgtgccgctgtgcatgcattgtcttgataaacatcttaacaggaaacagtgttcaagagcagagaactggtctgactagaatttaccaggctggaatttcccaatcctagtaagcctgaaggcactgcaggagaccagggtgtatttcagtccttatctcaaacccataagacagacacttccagagcaaccatctatagacctaccctcaggaatgcatttcttccccagggtcccaattattaatattccttgctgggaaaagaattcagtgatatttctcctactcacacttccatctataggctctctgcaagaagaaaaatatggctctgttctgcccaaccctgtaggcagtcaggcctcatggttatcttcccttgttccctgaaaatcactgttattctgttctttcttagggtgcactgatttaatattgttcaaacacacatattttacaatcaatttgtacaatagtggtcctcaggtgacatacattctccgcttacgaagataacaggattaagagattaaagtaaagacaggcataagaaattataagagtattgattgaggaagtcacaaatgtccatgaaatcttcacaatttatgttcagagattgcagtaaagacaggtgtaagaaattataaaagtattaattttgggaattgataaatgtccatgaaatcttcacaatttatgttctgcctcggctccagccggtctctccgttcggggtctctgacttcctgcaacatgggggtattagttgtagtagtgccttccatatctgttataatttatcttttttccttctatttattgatttttgctctatactgtgtcaaatcctctctttactccctttaatgtacattttgtttgtcacattggtttagtttcctttagtttcctcgaccaacgtaatttatatctttcctcatcttatcttacttggctttctcttcctggctcattgaagtcatgtttccttattcaataaatagtgtttttcaatatatttccattgctgctttccatgctagttgtttttgtttttgtctgttcattctcaaaggaagaaagattccctgaaaggcctttgtactgttgtttaaaatgttttttgttcatggtctttatgtggctgactcttgttgtctagatctttacttaaatatcctctcctctgagaggtttcctttgaccatccaatctaaagtggccacctgtatactgtctattgtcacaccatcccaatttaattctctccataagactcatcattccaactattagatattttccttctttatttattttctatcccctttcactggaatagaagctccaagaggccaggcatcttgttcaacttgtttactgctttaatcgcagcacctacaaccatttcttacagacaagttactcaataaatatttgctgaatgaatgaataaaggaattaaccatttcccctctgtctgtgctcttgtgcactaatcccaccgttttctctgatttttatccatgagtcaatactaatagaaataaacgattgaataaataagtagggtagaagagacaagtcttccttacagaagaattccatattttatttgtgaatgtttgtttgtatatataccttctttagaggctggaactttattctccttccactggtgttaatttaatgattcacttacaaagaaaagaatgtggaatggaaaaaaaaatggtaactttatagtgaagaaatctgacaaatactaccagcagtagacagaatacccccgccccctgcccccgcccccgcccaggatggccacattttaatccccagaacctgtgactatgacactgttcatggcaaagtggacttgcagatgtgattaagttaaggtctatgagatgaggagattatcctggaccgttcaggcaggcccattgcaatcacaaggatccttataaaagggacacaggtgcgagtcaggaaaaggagatgtgatgatgggtccagaggttggagtgatgctctttgaagatataggaaggtgccacaagccaagaatgcaggtagcctctagaatctggggaaaaaaaataacaacaacaagaaaaccatctctcccctgaagctttgccaatagttaatttttgatttctgacctccagagctgtaagatcatcaactagggttgtttaaagccaccatttgtgatcatttgtcacagtggaaataagttagtatgccttattttcagagtctggcacaaaggcttcctaatatataccaggagctgtaatttctgacttgatataagcacaaagaggaattgatggtagtggtggtcagaaaggggcacacagtaaaaggtactagaactctggctgctttaaaaagcaacaacattgccaggtctcagtttcagtgctggcactggttttcctgactctgtctacaagatatttaacagtaagttgggcaaggtaggatcagaagtaactagctatttgttatttaaaattgaatattcaaatatttatctatatttttcttatccaattgtataatttatgctcattgagaagtatttggaaaaattataggaaagtataatcccactgcactgaaagcgctgttaatattttggatctcataaatacaaatgtttattcaacacaaagattccccagtattgtaaacatgacatatccaatgtccaatcccatgtaatcttagccctgagtacctgccttgtcatctatattcttggtattgtttgatgacaccaccattcactcaggtgtctgactcagaaactcgggcatcatcctggaccctttctcatccttcacactcagttagtctctaagtccacttctccttcccaattatttctccaattcactccccctgctgttttatccttattatcacttccttagatttggcccacataatttgtcagctagatcattaaaatatccttctaatctgttttttttttttgcttctagtcttagccctccccttctcccctgacagtttctctctctctttgcagccataatgatctttctgaaatgtaaatatggtcatattgttttcttgtttagatttcttcagtggctgccagtgtggcaaggtctcttatatggctcctgtctacctcaccaggcttttctcctgcacagagcatgcattgcagccttccccaacactggaagatgacccgttccctcatattgccacccttctttctggaatgctttctctcatatgttgggcctaacccattcctgtttatcattcaggacctctctgtgaaactttcactgaaatatatgccatgcctcttccaagcagaattaggtgtccttttcttatttatttatttatttatttatttattttgagacagtgtctcactctgtcacccaggctggagtacagtggtgcaatcatggctcactgcagccttgacttcccaggctcaggtgattctcccacctcagcctcctgagtagctgggacgacaggcgtgtgccaccatgcctggctaatttttgtattttttttagaaatggggttttgccgtgttgcccaggctggtcttcaactcctgggctcaagtgattcacccacctcagcctcccaaagtactgggattacaggcgtgagccaccacatgtggccaagtatccctttctaatggctcccctagcattgactctttttttttttaaattatattttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctaattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattaccattctaactggtgtgagatggtatctcatagtggttttgatttgcatttctctgatggccagtgatgatgagcattttttcattgttttttggctgcataaatgtcttcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagtttatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattcaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaatagcattgactcttatattttggtgttgttaggagagattgaagtcccagtactcatagtagttgtattggcaagagtcattataatagctaacacttaaatagcgttactttgtactaggtacaaaacctttatgcatattaatttatgttattctcataataactttatgaagtagatactcatcattattattcccattttacaaacaaggactttgaggcacagagagattaagtaaattgtctaaggccacacagtaaataagcatggatccagggttcaaatgcaggaagtctagctccagagtctttgcatttagccatatgccagtctttttccttccctggaatgcaaactccctgaggacaagggttttgcctgtcctgtatcacctctcctgtgtctcattacctaaaactaattcatggcagtaataaatacttctcatgatgatctttttagagagtgcaggaagtgaatgtagaggaatgtgtcctcctgtctcttcctagcagaattaggtgtccctttcttacagctcccatagtattagatcttatttctgtggtgtctgtagtagatattaaagttccaatactagtagtacattggttgtattggcaagagtcattgtaatagccacctatggcgtttaccctaaggccaagctagttctgcttattttgggtgtgcatacatttacgctgataggttaagtactattaatgagttggaagcctggaagttgataaaggtaattttttcttttaacagatgttcacttccctcctttttcagtcttttattttttccccttttcatcttcccagcaaacacagttacaaggtgagcgttagaaagattatgtaaaattttcaaaggctcctgaacaacagttgtgtaatgttctattttgggttacatgtgaccaggaatatggacccatgaaataattcagagccttaatgtggatgcttctaaaaatatatagccaaaggacaaagttttcctttgtctttctggttatcagtgctgtgtgatattttgaccccttccctccattcgacacttggttttctttgtaccattgctttgtttcagattaaaatgaaaagaaaaagattaataccttttttccctggaagatctaccttttcattggattatagtttccatgcctgtctttgggacttattaatagctatggcaatttaaaggctttgtgatccacagataggcatactatgattctcttctaagagtccttaatccaccattgagagaagggcaatgtgtcctcctcccttcctgaggccctctgtatccatggtgtgttatgaaatgcatgatcctgaaggtaaagatgttttcctatatcagcacagcacgacatagctgatatagatatgagctatagatagctagaataaaatcctctagtgacctttgcagtctgttttaggggaaacaaacaacagaagcagcagagtgaatccaaattaaatttaatgttgtttttgacaggaagagctgtgcctggatgtagacagtgtcatttctttttccctggcacattattgaaaatactaatatataactttgtccaaatttggctgagatcagccattgtccagggctggcaggtctctctctctttttttttttttttttttttttgacagggtctccttctgttgcccaggctggagtgcagtggctcaagtgattctcccacctcagcctcctgaatagctgggactacgggtgcacaccaccacgcctggctaattttttctattttgtagagatggggtctcgctatgttcaccaggctggcttagaactcctggcccacaagcgatcctcccacttgggcctcccaaagtgctgggcttataggcatgagccacctcacctggctgactcctacttttgacttctcaaacttgggaggctactcaaatcagtgggaggtcacttagaacacacttttctctctagattccctgaagcagtgctaagtctaataaggcctctagggagcgataattatttgatctctggcccccaatgcctgccccttaatgttacatttatcctttactcatgtgatatgaaggggaaagtatattaatactagctttcaagtatactactatactccttcccatttccctttaagggtagtttatttacctgattgacctttctgttgtaaaggcagaatgtgatactgagtgtggagtttgaaaaccactgttttctggtcttgactctgccaacttaacagtggtaccagtttctttcttcttcctttttttttgtttttagaacagaaatactttctcctgtcttgaaaattaatgagataatatgcttgaatcactgtgttctccctgaaaggtggaccctgaataaattcaagctgatttttttgaaaggagctgaaggcagagttaagtctatttgtttttctaagaatagctgtggctccacaaataacatactacactttttttagagaggaaaagattgtagagatagtgttaaccctctcaaatgtaaaatgacagggaatctgatattcaaaggtgagatcatttgtccaagttcatgtagcaaggtaaagggccaagacatgagtacccagaggtttggtttttctttttttttttggcacaattaagagttatttttgcctcagaaatctgcatttcacatatttaatgcaaaataaaacccttctttggtaaaatacattctgttagactttcactattgtacagtccatgtgatgaacttagtatttatagttaaattagtatagcctttaccaccatttttgtatgtaaaatactttccctcttatctaaatagttccagtagtttcttttctgtgggttggatagaaagtaagtattgatctaataatcactgggtggtagggagatggataaaaatagaatggaaactcaacccagtctgttctaaactttgctatgtgtgcaattctgatgtattatatggccttaaacatatatttaatgacacatctacatccaggcacagcccttgctgttaacaacattgttaattcagttacacttcactctcctgcctcagttgttgttttccctagaaaagactgctaaaatcattacacaatttctttccagctatttttaggcccatgtcttagttttctattgctgctgtaacaaattaccataactccagtgccttaaaagaacactgatttgttaccttacagttctgccggtcattggcctaaaattaaaggactgtgttcctttctggaggctgtaggggaaaatccgtttccttgcctttcccagcgtccagaggccacctatgtgcctttgcttgtgtctctcttcctccatcttcgaagccagcagtgctgggtcaaatctttctcacatctcctcacttgaacctctgctgctttcctcttccaatgttgaggagcacaactgaataatccaggataatctccccatctcacagtctttaacttaatcacacctgcatcatctcttgctatgttaggcaacatatgcataggtcccaggaattaagatgtggacatctttggggacccattattctgcctaccacaccctatatctatgtcaactataccatactgtgagttttcttttggagggtattaagataatggctgttttcaagttaaaaaattattttcaaaaatatttatcacaaatctttgtcccagtgccctccatgcaagatagtttccagccattatgaataattgtttaatattttatatatacagtcatctgttgttatctgtggggcattggttccaggaccccctgagactgcaaaaattcacagatgctcaagtccctgataacattaatacattgtaatcaaagcccattcaaattttttccagttatcccaaaagtgttattgacagcagaaagctcaacttcagaattatgcattgcaattaattgtaatgtctttttagtgtttttctatctggaacactttctcagtcttctcttgactttcatgaccttgacacttttgaagattacaggccagttaatttgcagaatgtccctcagttttcattagtcttaattgttcctcatgatattattgaggttttgcttcttcagcaggaattgcacagacatgatcttctcattgcatcctatcaggtggcacctgatattgatttgtcccatacaacttgataacttgattaaggtggtatctgtcaggcctctccactgcaaggttactttttcttttatttctaattaatagtatttctgatgaggttgagaatactttgagactatacaaatatcttatcccttatcagactttcaatatttcatttattgcatcaatatggaatcatagtttcctattttattgttataatccttgatttattttgatgccaaatggtctcatatttgtatgatccccttcaagctggtttatgtatctttttcacaagtctcaatcatccttccttatgtttggagtttatcttgtactttctgagtgcttcattacattccagttcatcttgtactttctctgcattagctctggaatcaggcatcatggttccttttagtggataatcatatctcgaaccaaaatctgtttgctaggagtgctcattgctattccagtattgctgttccaaggcccttttgatggagagagctaggaaatatttgtatacatgtatatacacacataaatacatatacacatttatacatatatgtttatatctttatccattgaaaccatgagttctcaccaataccttcaattttaatccaataccatagagttcattctagttttctcccttttcatgatttcacttctcaattggtaacattaagaaacatgtctcttattatttgaccagttccttcacatgtagccaatgccctgttgacacacccttgcctccccgactctgacttccagaaatcctggctgtagctgccacctccctgcatgaataccctcattttgtttgcatttcaccgtaccacatcagtccaccattgatgtagtcttcctgcaatgacaccttcctcatcttctcaagccccacaaagagtctctatggtgccctcttcatagggcatgcctactttgcttggtcccactaatggattgaactgttcaggaaggggaagggaaggaacattttctgtactttgacgagttgttgccacctttttccttacaaccatggtaaggattactacccttgtactggatatttactttctattgttgtagttcctataaattctgctttcctgtagtcaacatccacattttaaaattataatttatgagatttttgcttgtcaatttgagtccttttcttcagattaatattaatttgtttactggtttattattattactggtttgatttttgcctaataaggtgttaaaaatgaggcaactggaaataagatgattttcacgtaattatggtataatttatagaaacactactgctttctcataatactttttgttatttttatgttcttcatttaattttttttcttttcactaactaaacaaacagcagtgataaatataaactatcagcaaagctggcttagaagaaagagtttaaaaaaaatgagacaggatctctatgttgtccaggctggttttgaactcctgacttcaagtgctcctcccaccttggccctccaaagtgttgggattacaggcttgagccactacgcctggccagagtgaagcctttcatttttgaatagaggtattttaaaaacctattgcacagtaacctattcctggttatttagggttaggaacatgagttcaaaaagtctgacctccttagcatggcatagaaagctcttcacattaggttctcagatttcctttctagcctcagtttctgctgcttctcattttggtactctgtgctattactgtaccacattattttcccttcgccaagtgtgccacattcttttgtatttctgtggtagtgtgcgattacccagaaggtagatcaagcacatgcttggaacaccaaacagacataggtaccaaacaatgaggaagaaaaagagtatttgatgtttcatgtcatcatcaaggaaattagatctttgttggacttccttacacttaattcataatttagaattatttatattttgaaatacatgtgagggagcaccatagccttttctgtaattaaggcccctgtacgttattttaggcccttctctgtgcctttgcttttgctggatcttagcactgtgaaccctgcctctgagagaattgcatgatattccatcccacagcattttatttatttatttatttatttatttatttatttatttatttatttattttcgagacagagtttcactcttgttgcccaggctggagtgcaatggtgcgatctcagctcaccgtaacctccccctcccaggttcaagcaattctcctgcttcagcctcccaagtagctggaattacaggcatgcagcaccacgcccggctaattttgtatttttagtagagactgggtttctccatgttgaggctggtctcgaactcctgacctcaggtgatccgcccacctcggcctcccaaagtgctgggattacaggtgtgagccaccgcgcctggcctccatcccatagcattttattgcacatctatcataacacttagcactttgtataacaatttttaaatcatctctcctgaccaaaccatgaagtccgtgaggaaaatgacatcttcccatctagccatctatttcgtgcatctaacccggtgatttaggcaaagtagagactcattaagtgttgttaaactgaataattattgtcttgtttatagatgcaggtggtagcttttatagcagagattgaattatgtctctttaactgttaccgcacttgattcattagtatctgttcggatagaatttgacatgtccaggcagtccagtttgttaatataacaaactgttcagagaattggcagtgttcagaaataagaaatctgaaaaatctgtaagattcatatgcaacacgatgatttactggaggctttttttttttttttttttgacggggtcttgctctcacccaggttggagtgcagtggcacgatcttggcttgcacaatcactgcaacctctgcctcccaggctcaagtgatcctcccacttcagcctcctgagtagctgagaccacaggcatgtgccaccatgcccagctaatttttcgtatttttggtagagacacggtttcatcatgttgctgaggctggtctcgaactccagagctccagcaatccacctgcctcagcctcccaaaatgctgggattacaggtgtgagccaccatacctgaccctactggtggctttttcttccatcttgtccagtgttctgacaatcaggatttagccttgtatactcatgttcattcaattgcattagttctttaaaaatcgtagaatcttttcagttagatttggattagagttgtaggtactttctgatttgttcactttaagcagttcaaggagaaaacaatgaaaaattttgttgttggatggatatcacattggctcttttgctgcttaaatatcatctatccatggcctgcaggagccatagaatatcttaactcgttggggtcctattacgatagtcctgccccagactacgaaaagtttccaaaggtcatcttttgagtttgaagccatctgagtagaaagttttctaatggcagtggttcccagatgccagttagttcatggaagctggtttgttatggatattgtcacaggtctgcagtgatgtatgagaaacaacagtgtagtgattatctaccagaaagctaactttattgattacaaaggaccatcctttattctgagattgttctttacactttttgcttgttcaaatgctcttttgtccttaatttaatgaaattaaatttacgatgttaatcaaggactgtatctgtatctttatatgaaacccttgagacaagatatgtttcagaacttacattctttttggattttagaaaggtagcagtctgtatatcctatattacataacagccccagcagggtttgaggtgacaccccataatcagttacagtaatgttactgcagtgaaatataagaatatttatactaagtgagagaaaaagcctgtgaatagcctcatgtcagttcaggtcaagcttgactgccagatgagttcatatcagttcagattttgctgccaaatgagttacaggcaagaaaaaattgatttccaagtgtttgaattttgaaattgtggataaggggttgccttttaaaatgtccttactttgtaaaataaagttgagtatcctatgtaggaccccaaaatgtttttgaaatttcattggtccacaaaatccaaaacttgggaaacagctcttgaaagctattgaagtgagtataacattactgttacactcatccctagccaataataattttcctctctattttgtttgcaaggaaatacattgctgttggttataatctttggatgttgtaaaaatctccaaatatacttttaatcaaagtagattgaaattaagtttatcttgtagcaattttaggacgctggggcaggagagaaggttgcagcctgaatccatccacaattcccagtgatggattaggattctgtgatagggatgggttctagcttgacaagtcctcccggctgcatttgtttggccaaatagattagtgaggagattggtctgttttgggtaagggcaatagtaaatacctatgtgcacttaggttaactgattaatctttggcatttgtagcttaggtttctatccatcagatggggttaacagttcccatctcacaagtatgaaatgagttaggagctatggaagtactttgacaatgaagatcacattagcatataaaataataatcttaaagaagaagttatgtagtatgaactaatagaatcaaaacaacacagctgcacaattcttgtcctagtaaatttgtctagaaagtagacttggtaaaacaattatttgacctaactgggctataatttggctcttgcttaaaaacagtatttctccgttctatgtgccagttatttatttattggccctcagcttcagattcaccatgtgttgcctgctctgtgaaaatggacctgaaccttttgttttctatttatttatttatttatttatttttaatagattttttaaattatactttaagttttagggtacatgtgcacaatgtgcaggtttgttgcatatgtatacatgtgccatgttggtgtgctgcacccattaactcgtcatttacattaggtatatatcctaatgctatccctcccccatctccccaccccccagcaggccctggtgtgtgatgttccccttcctgtgtccatgtgttctcattgttcaattcccacctatgagtgagaacatgcggtatttggttttatgtccttgtgatagtttgctgagaatgatggtttctagcttcatccatgtccctacaaaggacatgaactcatccttttttatggctgcatagtattccatggtgtatatgtaccacattttcttaatccagtctctcattgttggacatttgggttggttccaagtctttgctattgtgagtagtgccgcaataagcatacgtgtgcatgcgtctttatagcagcatgatttataatcctttgggtatatacccaataatgggatggctgggtcaaatggtatttctagttctagatccctgaggaaccttttgtttttatcttttttttgttttgaaccttttgaatggttgcttccattaccacctgacactgaagttttgtcagtagagggtgctggaaaggcacatcaggaaggaagtactttgacaatggtgaccactttaacatatcaaatcataattttgaggaataattatatggtacaaacttgtatagtatttatatgttcatatagttgtttatataaaatttatatatttatatagttgttatatataatatgtataatttacatagcatttatatggttttgcttcatggttccctgtgtgcttgctcagcaggctgttttttgagcatcttcaccagtgctcagcttctttacccagtggtcagtagcttctcatggtgcccccagagacagttttatagcagagtatttctggtaggacactttccagaaggtgtattttgagcatgtcacaaagggtgggtttctgacagattccagctaatgagcaccacagcagcttctctacccttcattgtgctgtggctgtgccctctccaataatgtctggatctcagccttgagcagaagtcactttctttggtgctctttctcagccctaggggtagttgctcctgatatctgtgattctttgattcttgtgtttttttttagaatctctttacttattactagccaatttctcattactccaatttcctgttattccaaccctctgtcatagttaataatttcttatgtacaactctccctgttcaaattactatgcggtttctctctcctgagtagacccagacagttgcaaccaattaaagatctctctgagccaccatgtatcactggcaagccaattcttcagagatgatatcgttgtatctgtagttgaaaaaattcaaatatcttttagggaaatgtctcaaaatccaatgaagtttagctgttcttcccatggggtttctgtgtacctatgtatttgtctctctttctctatcttcatgtcccaccaccttaactgtgagttctcactcttctctccttctccatctatttgccttcatacacttagtttccaaccccagcattgcttttggcttccctgcgtctcaatttctgtcttggtgaggcagcgatataaaagatcataaattaatgaaatcaaggacatgaaagtgctttgtaattagtagagtaccatacaaagtggtgatattacttgtgtttattaaatagttttctcttctatgttttcaaatgttcaattatgttttattttaagagctttgtgggtgccttcaggggtacttacaaactagtaaaatagatacatcaatacatagaattattagacaagactgaatgtgctgggtgctaaaataggggaacaaatgaggaaacaggagccctgaaaattagaatttaattgtggtctgaggattcatggattatttccaaggagaatcatctgaccttgaaggaccttacctgcaatttattaaatgtttgtggcacaaatgagccttgcaatacgtactttacatatattctcatattgaatctttacattcatccttatattcttaaattattttatgtcttagactgatttcaaaatattttgcttgaagacagatttttgttcatttgttttatttttaattgaaacttacctccagttatgtgtgaaaactcagtggcagtaaaatctacaagatagaacattatgttgcttttcaggtattttctattttcatattcattcatggatacctacattttaaaagatggttgaacacttttcacctgagaactagagtaaatatatgataatctctatatttaaaaagggaaacgttttgtttaaaaattgatgactcagtctctttttttttttccataagagagtgtgtcagtaggcttctaggagatggcatactttatgaaaaaatgtagcatactatttaaattagaggtggttacgctttgaatgcaaagtatcctgtcaaatcacaggatgagtgcatctcccagtggaagatgttgcaaagtgcaagtgagtatgagtcttcccgaaagcatttgtctttatagcttggattctatgagatgcccaccaaagacacttaattttttatcttagaaagtcaagatggatgagtcttcagatttattaggaacccttctttagttttgaatattttgtgatgaatccatactttatctttttgcagatgagatggaaatgtcctgtttctttggcaaataatatgtgagcatagcacatgtagctttttttttttttttaaataggctatgatttgatcagtgttttctgaagtattatgtgcgtgctactggtggtatatgtacccgtagaaatagacagactaacacaatttgaatatatttgttacttattttaacgctgattaggaaaaaaagcctggtatatcacacttgtcatttcttagatactactgaagttaagactatgcaggtaaaaacacctcacccagaccaagtgaattactggtgcagtgttcaggcatgcccaagaatgtattgctgcattcttttcatagatacagcaacactctaccagaaaatagtagtatttaaatatacaaagtatttataacatacataattgcaaattggaatcggttctatgctctttttttgttttgttgttgaggtcagtatggatcaatggataaaaattgaatttttaaaatgtaaaggtgcagactgtgagggaaatcttattaggggatgattttgatgaagttagtcatgtagctttagacaaacttgaagaccaaatttagcaaactgtctgaatcatctgctactgttacagaaggaccaactgcaaagaaaacaactatcacacaaatttgatgaaagtatttgaaatttgtattttcataagtatgatgagaatgaacctctttccttgtatgtcagatgtgtagagacacacattctggtgtgaaacctttcaatcctgtgcttttttgaaacacaaagtgtgctatacaaagtccacctgagaggttccttaaaaagttgaacatagagttatcatatgttcacccagaaattcagaaactcctaggtgcatatccccccaaattaaaaactagtactcaaacaaatgtacacccatgtgcagggagggactattcacaatacccaaaggtggaaagagctcaaatgcccattaactgatggatgggtaaataaattgtggtatgtacatataatggaatactcagccatatagtatattagaagtatcagtacttctaatatactagtaaatggtggatgagcctccaaaatattatgttagtgaaaggagccaagcacaaatgattagatactatatgattcaatttatgtgaaatactaaaatagataaatccatagtgacagaatgcagatgcaaggggctaggggcagggaggagagaatggggagcaactgcttaatgggtatgggttttattttggagttgattaaaatgtttcacaacaagatagaagggggtggttgcgcaacattctgaatgcactgaatgccactgaattgtttacttgataggtgcagcaaaccaccatggcacatgtatacttatgtaacaaacctgcacattctgcacatgtatcctggaacttaaagtaaaataaaaaattaaaaaaaaatcactacttttatcttatgtggatttcacctcagtatggaaaaaataagacttacccagtagtgtggtatgtgtgacattttatggggaataggatgatgttaggttgtgcataagcatttcttattacaggagttaagtatgtatttttacaattgtcttctttttatgagaaattattagtttcctatttgcagtaataagttttcctttaaagataaatgtaagttttaaagaaaaaataagatggtactgatatgacacatgaaggcagttcacaaatgaatgaaaaatggcagcttcaaagagacattttgttttatgttcaagccaactaactttaatttttattatgttattattataattattattgttttagagacagagtctcgctctattgcccaggctggagtgcagtggcaccatcatagctcattgcagccttgaactctatgactcaagtgatcctcccacctcagcgtccctcacaggcatgtaccactactccttgctatttttattttttattttttatacagatgaagtctcactatgttgtccaggctagtcttgaactcttcccacttcagcttcccaaagtgttgggattacaggcgtgagccactgtgcctggccaatttttagtgagaacatattagacactagttgctgtttatgaaagttgaacgagatgtgacttttgccttaggaaaaacttccaacctaaaggtgataagccaaatctataaataattcaaggaagaagctgaatgtgcccagtgagactggaacagaggacaaacagactgaggccaagaccaggtacctgtttggtttgattaccagtaccatttcagaaaatgctagaataggcttctgggtgtagtggctcatgcctgtaatcccagcactttgggaaaccgaggatggaggattgcttgagacctggagttcaagaccagcctgggcaacatagcgagaccccatctctaaaaaaataaaaaaattagtgggcattgtggcaagcacctgtagtctcagctactcagaagactaaggtgggaggatcacttgagcccaggagttcgaggctgcagtcacctataatcacactactgcactccagcctgggtgacagaacaagaccctgtcactaaaaatgggaaggaaggaagggaagaaggaaagaaggaagagggggagggaggaagatgctaggatatataggaagaaattaaactaaactctatgtacaagtgcaaacaaaaccccaacttaatattggcattcgtggttgatggaaagatgggagttggtgggaaaccattttagagcaaaatttgcttttgaaattagaaacagggagaaaaattacttaataaatgcagcaggccgggcgtggtggctcacgcctgtaatcccagcactttgggaggccgaggtgggtggatcatctgaggtcgggagttcgagaccagcctgaccaacatggagaaaccccgtctctactacaaatacaaaattagccgggcgtggtggcacatgcctgtaatcccagctactcaggaggctgaggcaggagaattgcttgaacccaggaggcagaggttgcagtgagccgagatcatgccattgtactccagcctgggcaacaagagcgaaactccaactaaaaaaaaaaaaaaaaagcaacagataatgtaatcaagtttcatatactgtggtcctttttgcctctacctttttctctctcagtaacttggaagtcctctgggcttcctctctccctaaaaatctcacatttaaaggtagcatagtagagggcttgagaatatatgctctggagctagactgcttgggttcaaattccagttccaatatttacagatcgtgtaaccttagtcatgtcacttgatttttctatgtatttgttttatcttctgtaaaatggggatgttaatagtaactgcattataaggctttggtaaggattaaataagttaaatgattaaatgtggtaagcatttataacactgcttggcacatggtaagtgatcaaacaaatgttagccattatcatcatctccagtcagtaaatcctgtcaattttgtctcctaaaagtctttttgaatgtcacccactaccactgccttagtttaagatcttatgttgtcacaattgcaattgtgccttaactagtcttgcacccgcaccctctctcctaaccatcccctctgtctcacttgactgcctgacatactcttgcttattctgaaatactcagctcagatgtcacctctgtgaaactttccctgatcctctgtgctagtccacttagggctctccatgtgcacttatatcctttggaacatatctcatttatagcatagcttatatagtactgtgactgtaactgatgttccgtgggttgtgtccaccttgaaggtgagaaactgggtttacttagttttgaacttccaccctaaacacagcccctggtacaaagtagatgcttattaaatgcttgggtggattattgaatgggctctgcctgtagaaagctagtttacagtcttcatttgggaagctaagttgaacacacctaagaataaataactatgaacattgtatagtaactgctgaaagagtttagaaagaaaaggggagtgctgggggtaatcaaattatacttcaaaaaggtagagcttgatttagaacttaagaatgggcagaacttgtgtgaacagagaggcagccacaatctactatgcaaaagggatgttttatgagttgaatgggtggtgacagaaaaaaaggaaaaaaaaaaagcccagccttagcaaaacagagaagagaccagtctaattagggtgtgtgtatgtgtgttgatggggggaaggtatatgttgaaaactacaagtagatcataacctataaacagggtgtgttctaaagatttatttacaaaccatttgtttggacatgacacataatatacatggtttctagccagctcaaaatattgtatttaacctacttagtagtgaactatcccagggacagtgctccagagcctgggagcagagagtcaggaaaggtgcgatggattctgggctagaagacagagtgatagagaaattgagatttgttgttctcctatgaccctttctgcacctttttttttttttttacatctcagtttctctaagagaaagtttctctatccctcaaggcaccccatgctgctaacttccttgaaacagaaccccatccaaagttgctagggctctaaaaggctctctctcacctccagcctgcctcattccctcagggcaacagctctttgctatttgaagaaacttgactcaactcattcatgccaatgtgtgaataactgatagccacctcatcctggcagctgtacttactttaattttaacagccttcttgttagctcaaatgaacctgtaattgctggaatttctggcactggtacagagcaaacaatgtgggaggggggtgagggttacagagagagagagagagagagagagagagagagagagagagagagagagtttcactgtaggagaagatattttgagataaggaaagctttggccaagagctttgcctaattttcctttcttctccacctccctcccccaaattgttcttgtgtattcctcttcacaggtttactataggctgcaagttgtttattattattactttttaagaataacttctgtagcagttctgggtatggtggtactgtgttttttagttgtgtgcaaatctgggattacctgtaatgggaaatagggttgaatagataaggtggggctgggggttgaggggaccttgaaagtggagtctacaaatacatccatagaaataaggagtcatggaaagtttttgaataaaagcttaagatgatgaaaccaataaaggtggcaaaatgaattctaaattttgaattagaaatgatggagtattatgtttactcttggcttgggattggtttatacagaatcatatttctggttaccatttttcatggttctgggcattcacctttaattgttagtatctctctccttggctgtctgttctctgtggctcctgagccaatcttccttcaggattaatatgctcctagaagcttttatgacttttgtattaccaactagcacataagggcttatacattctgtttctgtgtcccaaaattcaagtctaatgttagcaaaacacaactctcatttataagacttttttttttttactttttaatgaaaatttccagcctttccaaacataccccaaaaacacactggagatagtggttaatgatctgcatcagttagccctcagagctgcaggaacctccacacccactccctaacctatgcatgttaaaccatgttgtagataagctcttccctttggggaaccccattgtcttttattctttatattgttcattatgtaaatattcttgatatttctcctccaccagtctgcacaaaggagaagccagaaaatggggtgagaaagggatttgagacatttccttaagcctaaattataattctctcattggaacaggattcatagatctttaatcaaatatgtttatttttctctgttttgaacgttaaaagggcttgttcgcattgggccctcttgtgtgtcatttgtatattttgctcttgactgctcagcataccatttacattaccaggtattggtgatgtgcagtgacttgcttggttgaatttgctatttcatttttttgctccatgtagtggagcagtgattgttaaaattggattttgtggtttactctttcgtcatgacttgtagcaacagtaatttaataggatttaacagtccaaagaatatactttttgtccttttcatttaccagtccacaaaatgactgcttttaggagatattgtttcatttttcaatattccctggcctaggtggtaacaaactaataaaatgcattcatttgctttaccaatcctatcttgacttagaaagttgattactgacatttcccttccttatggtagttaagtgttttccttactcagttcagttcagcagtcacctattgatccattcacacccccatcctcattcttctatcataaagttattatatacctactatgctgggccccctgccaggcacacatagggtctgtcatgcaaacatcaaaaggagccatttaggtatgctatgtgcaattgtaacattttattttttcttatgattcaaatcttagttttgggaggaaaaggccctttaatgatttcttatttaattatcatcagaaaagtgtagttaggcatggaggagggaagaacctacctctgctggcttgatttcaccaaaatcgcctcctataattgggttactatgtgacaggcactgagttaggtataatacaaacataaggaaggcccaacctcagttctcaggaatttatagtctagggagacatagaagcagttttaacccaaagagagaggagctataatattcaaagtatcacaggaggatagcaaacccattacctgtatcttctaagggatgtgagggaaagtttcactgagggaggtttgcttgaacacttaagcatgactagaagtttgcttggtagagtagaagggcagggaattccaagtggaatcagatgtgaagtcactgaggcatgaaggagtatgacatatttgaaatgtatgccaagaaattgctaattactagatgaaagagaactctgtggaattggcattgggaagatatttctggtacaggtataggttgatcatttatgtaacttttgtcatatagctattctgtagcttccattaactattccttacttctcctctcctccagccatttatgtgaagactttttttttttttggaggggaggtgtttaggagtcatatttgtagtttttccttaaaatgaatattaatataaatattaatacaatacagaggtgactaataaacaccaaattaggtatcaggagacctggcttattgttttccacttctctcagcggctatgtcacttgagccaaggcatttaacagctctgtttcttcatgagtaaaatgggaatattaatgcctgcattgcctacctcaggatcaggttgaaaatgaaaatgaaactgttaaaaataaagaggtataataaactcttttacttggaattctgctggctgaggttaaactgacatttaaagcaagtaaaatactttgtggagtatctggatagaaaaattaggttggaaaataattcttacttcctcattaaccctctatgtctgccctttagtctttgaaatgtcatttagcttatttctatgtttccaaactaacatgataaaaattttaaacttcctaatgttctggcatgtatatcttggccctttcaaattctcagtgtaactattaaatagcaattgatttaagagttaggtgagtaaaatataagttggtatatttcgtagtcaatcttgaataattcatacctattaagtagtttgaattactaatgagatactgtctatcatttcttgttccatatggtggtaggacacaagttttgttccattttagaaatgtataagagggtcctgattcattcaattaggattgggaggttatgagactttggccttctgccttctttgccatttttcctaattcagtgacaatgcaggcagcagttattagtagcagcaaatgacatttccattcattttatttcctttgacccccatcttccccattagattgagtggtaatctactgaaatctgataaatcacttgaaacatgaacttctagactataggagcatgagcaattgcttccaatataaatactcctggctaacccttctttagatcagtggttctcaaaatctatcactatggatatttcagcaggacagaaaattctgtaaaccacttaagtcatcctgctctgaaccatcttacatacatcagaagaaagggaaagagtactgctatggatgagataacacaatggtattttacatggaatgtaactgaattatttatactagactagtattgatcctgtcatcataatcactattatatgacacttgtggaattccaagaggtagttacccctcctccctttctgcctttgcaacttagagatgaactagttatgtgaatttggataaaacacctattctaatcaaaatataatataaaatggttgttgagatttttctaccaggccctaaggaaataatctgtcaatttgtctgtttttcacaaaactaaatgaggaaatggtctggcttattttctctttgttttaaaatctatggtgccattgatacccagtttaaaaacattcttctgaaggtgctgttgattaaatcattttaatgtcccccaagtactgcctgtttttgaagattatttggaaaatgtggcacattcaccaactcacattctcctcttattctgtacttgctttttttccttataagttagtggaaaggcaactggtcagttttttcactcaataaaaaagaaggaaggtgtagacagcttttatctgggaatgctttaagtcattgagagaatatttttaagtgttaactactttttgaaattattggcagaatcttttaatccattttaacataaaacagttgactaagatggaaagatttttattgtttacataaaagaaatcaccatggtttttgcatcattgcataaatctaagagattgtgcatacataaaaaggatgagacaaagctgaatgttaagtgccaaaatcaacgaaagcttgcgtacttactgggtatttgacactgagcataatggaatgtggttccacagagagagaatactaaatatttagacccaaggacatgtttctctgatagcttcttatcctaatctcctagctaacattattaaccctttttgaaacacctctttcttacacttagatttcctcctattaaagctcacccttggagattctaaaccttctatacccaagcacctacactcacccactcatctctttctgagatcttcatgaattccttttgtttattatatggatctttgggtgaattatcttggtttactatgagtagtaaagcacaatcacaatttctctccacttacagctctatttttccaaaggtcacagctccatcattcagctcttctgtcggtatccctttctcatcgattccctggaatttttgaaccagggctgtgaggtatacagccagcaatgttgcatagtactttagagttgctgcccaacacaggtccatctctcttcacaattcatgtttgttccttttcaggctcagagtggtgaaggaagttactaagattagcgtgcactatgaagtctgggaggtgggctttcagggacctgcttacttactctgaggctctgacctttgccttagtgtgattttctcaccatcctcttttattttgtgggcaaaggatcaaaaagatttcttcaacattgagtgctaaacattagcaagaatgcgtggtttctggtccctgtaatgaaagaatatttttaaaaccatagactcaaattaccatgtaagatatcacagaagcaaatggaatttgagctggatctggaagaatgggttgagttcaggaaagtggagtttggaagagatttcatgcaagagggacctctggagcaaaggcgagaaagaacaaagaaagcttttgacatagagaactggaagttggtgttatgatttactacagtaaactggaagagtaggttggccggtatgtactgagttcttagtgctaggcttagttacttgattaattatttgattgatctactcattcaacagattgtttctcatagcccacaggataaaatccaaacctgttttctggcgtgcatggtcttctgtgatgtggtttctgcataccttaaaatctactccactcaacactatgtacccacttttcagtaatattgaactcttttcagtcatatcgaagaatttgctgatccctgcaacatgttgtattccttcacatgtttctttctttgcacaggctatttcttctagagttcacttgatgtatgcttcattcttcagcctcagttgcaacggaatttttgttattcctctgctgctgtagaatgctaggcttatattactaaagcttctacaccatattttgtattgtcagaatacatgcctgcttccctcactcagcttatgagcttcctgagggccagggattgtgtctggttcacctttacatccacaccacccaacatagtacctaacatgtagccaattcaataaatacatacttactgtaaaattattcattgatcatttactttacatcatgtgtagttttatttttaaaaagcgatctagatggaatgggattgacaaattgaagacgggcaatgcagggagatgagttatatgtatttttgaagtagctcatttgtttaaaaaaaacagtaggggctagattcctgggagattgataaagaaaaaaagataggacttaatgactggcaactatgggcaagagagagggaagaattaaagataataaaaaataaagataatacaacaaatagcaggatagtgacccttaaaaaaataaggttactttcaggtaagcatgtttttttttctaagttggatttcctggtgttagtatttgtctcactccacctttgctccaaagatgaacactttgttcctgttcagtttaccagaactaagttcaagatatatgtgcttctcattttcatatctggccagcagtttagatatgaaatataaatagttcaactacactgactacaatttcctatcaagggaaggtatgcagtacataggtttttttttttttttttaaatatataaagcctgtttctgcttttgggagctacaactgaagtgttgtaccaggcagatgcactggggtgcgctactatgtagcagagcctagctgtgcatcacagctcttaactttaaaactccagagaatttgatgagagagggatccacaagaacatgacaaatgatgagagttcaaaccttaagagaaaaatgggcttattggtaagagacctttcttttcctttatttactgctgttacttactcattaaaatagcaagcctgttatttccatatgtggctgtgaagcgatatacaaaaatcaattttagatgtattgtagaattcaggagacatattggtaaccatgcaaaaatcataggaagcatgtacaaagcttgattttgaataagatttctaagggaattttattttacttcagactgtgttatagatttatttatatagcttaaatgtaatgcaggtaagaaatatctatatatacatatatttaaaaagttaaaataaagaatagtgacttatgtagaaatacataatttcactcagttgccagaaggtggcataccagatttttttaaatgcacaaagaaaaggaataatattaatagggatataaaataagctgtatttaaagacattttgatgcattttaaagcaaagaaataatataattgttattttttggtagggcttaattgtaaaacatgacagatatgaatttgacctattatagctttttatcattcaacaataatgtttatgtgtatagcattttaaaagtatactttcaaatagtactgtcattaaggagatgctgttttgaatttatcattccaaaaaagaaaaaatattttccacctacttttttcataggaagttattagatttagtatcacattttggataaggtctttgtcaaggtctttctaaagatattattaaactatgactttgatatagttatggatttaataatgcagtagtgcttgtgagatgacccagaaaaaaccaagacagtttattttgaaaaaaagtgagataaggctaatgcttactttctatatgctgataacaacataaatgaaataaatggaaataaatgaaattttatattagagctcatcaaacatttgccagcatactttaattttttaagagagttgactgtcaacagcctatactgtagtgcttctgtagtggtctctatttttaaaactggattcctgaggcagtaccagaagtatgtctatccaatgttgctttttgtattagcccaaaagagctagatgtatgacagaacttaacaaaaaccaaatcttctggttaggagacagtatatctatttatgtgtttttattaattacaagcagtatgaaaataaaaagaattggtagtaaatgaacctagaagaacattagccatctgttctctgaaagcttgtaatatgtgtcatttgctttcaggtttttatggcaaagaagtatatcagcaaagaattgacctttaggcttaaaaagctacaaaatggcaaattattccaaggggcgagtatatatttactggaaaagtgtctccttgtgtccaaatttggctagtttagtcttttagatcaactgccaatcattgttatgcttaatgcccatctttattccagactttctgagacattaagaaagcttctaaaaacaaataggatcttatggctttctagttaagggtttttaaaagttaatttacatagtttaaaattgttatgtgtggttttaactgttcaggatttataaatatggtttattaatttacagctaaaatgctgtcagggtatgctttgaaaaatttgaactaaatataataaaactacaattaaccaggtttctttttgcactccactttcaggagacggaggcaattgtcattaaaacaagccgatttcaaggatatattcaaaaaatcaacttcagggtatgtccaggggtctacatttttcctcacctttttttttttttcagtgcgaattggttttcatgaaagaccctgagaatactagaagacagttatcaagtatagttacagtaatggctagggcactgtgtttattaggaaaaaagtatgtaaatcatgctgttaaaaatgccacgcatcattgtattgtgccttatattttccaacatgctttcacaaacataaattactttggttttcacgacaacactgtgagacgggcaaggaaagcagcattttccctattttacagatgggggaagataacactggaggtcagaaagctaaccagggacacagctgcagttggaccacagatgcctagctctgtctcttctgccttcttcctcatggaaaaagtttgaaacaagtttttaactttttaatctgtattacacaatcaagataatttgttttctaattgttgtacctcacagtttcccacttcgcatctgtctgtctgcctctgtgcctgtctgccagctggagaccttactttcagactctcccagacctagaaggatctggagtgtgggagggcaagataatggatgtacagtttgctatgacaactggtgttgagcagccagtgttcatatgctaaggcaggccagggactgagaaagaagacaatcttactatagctaagagatattcagcaggaattagcaaccttgactttaaagcagtgtttctctaatagtttagtagacctggtgtgataatcagctgtagtacttgttgagaatgcagagtactgggccccaccttcagatatctacattttaaataatcacctcatgtgattcttatgcacactaatgtttgagcacatctgccttaaaggtaaagaacttttcttttggtatatgtattgcagcatagagaaaagaaccacttttctctcagcaacttctgtgttccatgtcaaaccatattaaccagggcagtggggagcaaggggcaagcaagagtgatgaatgacagatattatttgcacacattgctggatgtacatctgaagcatgtcacaatagctactgttcattgtggtgactttgacgtattttataaaggtttgtgtctattttagacatgaggggcagaaagatttctgccaaaaggtgaaaaataagtgagttttgatattttaataacatctcccagttgtttttattgtaaagtaatttaaaaaactgtatagaaaactaggctattcagggttctggtagttaagggtttactgtaacaatgtatttacactaatttgtgtttcctatgtgtatatctagtctgcctgattagattataatggtcttgtggccagggaacatgtgttcttttgtgtatttgtaacatctagcaaagtcataagttattgatacttattgatgactgaaataactcactgagcatgtatctcctttctaggggttttgggctaggcagagtaagttgattgatttcatttgtgaagttaaaggagacaatcttacactgtcagtaatggttaatatactaagaagttttcagttgaaataactgtattttagttgacagatgtgaaagtgtggtcctaattaataaatgtgctttttccctgtttagagtatccattcaagctcgatcttgcctcttcaccctttttggaatacatgttatgttgttctgtgctttacaaatctgaatctgaaaaattgatatttctagaaacccctaaacataaatatttttgtttaatttctgaacagtatcatagaaatttaaacaaatgcctagaccctgtagtggaagattcataaaaatgctcaagtgtctctgacttaaatcaagctgaataaggaaataaggaatgaatgaataaatgtatgctagctaaagggaaaatgtagcttcagaattctatgagaagtaactgattatttaaaacatatatttgattttgaagacatgaagtggttctgaacttattagttgaagtagacagacatagaaaggaagtcaagaaacccagatttagattacctctagcttaaatctagattcaacctagaagatgaattctgtttttattcaaaatggaattactttggttagtagtagaccatgagataaaggaaaagaaatgatttccctttcattggatagccattgcatccaaataataaagctaaacctaatgccaaaacaagctgtgattattttacaacacatgaacacttgatgtggcatgtgctaatgatgttgtacatcataggattttaattgaatttctgtttgcaggcacagcaattttaaattacatacttttcagctagagtctacaatttagacctatgaccatacacttggcatctttcagtataactgtctctgtactctttagctgtttgtagaatttaaaatcgctaaagagaagaattctaaattggaaaacgaaaaggatctggaaatagtcatgaaaatagaagtattgaccaggttgctaagtctcttggatagtggcatagtgggcaaataacattaccataaggacatctttaagaaaactgttgggtttcatattatggcaatgggtcacaaggttcaagtttgaaattgagccttttttgaagtgtaagattttctcattcattatttggtcaaaaccttttatttttagatgacagtagtttctgtgggcatatgtatatgaaattcagttttaatgattaaacctaggaaatggtaaaagttaaagcaattgaatataaatggctctttctcatagaaaatttaaatagtgttaaatagtcttaattagtcattaggattagctttctgtgaaagtgctgctggttagcaaaatgttattttgattactctataagtatttttaaccaatatttataaataggaagaggaagagattggataaccaggtgatcttctaacctcatttttggttataacatttatgatgcacatgtgaatgttgtaataactttttggatgtaaatatacatttttcaaggtagtagtactatttcattaatttaaaattgggatgttgaagaaaatatactcttctaaagatctttcagaaattcagacttttagaaaagtataggtatttctgaaataatatagaatatggcaaatgttgaatttctgtaactggcatgtcttttgagatttggtatgtgatatgcttattactgaaaaaattttcaaccatcataaataaacattattagaagttgtttattcttaccaaaatagtgcaggatttacaaatataaagatttcagtattccttacattgtcttcatgccactttggcagtcttgcttctatatttgatgctaccaaaattaaaaaaaataagtgaaactatttggaaagcttcatatgaatgtattttcattcaatagagccatattcttaactgttcagttgcactgtacattttaagtggctttttattttgataagttcacagattcaatcagaaaagctaacaatagcttgactattttatttactcaaagtagtttaaggagatacttaggaagttgctgagagatgactaaacaggtgagtgatcactatttcaggtgatagagatttttttattggaatatttattttatttaagaaagtatatatatattctggatgatttccttcaatatatgcttatttttaataagatagtatgtttctacatattttttcattttaaggagattatagcctaaaattatcaaattaacagataaatatccctcttgacctctgcttttggtaatagcaggtttaacaacagtgttttaaaaatctttcaggatatattctggcttcaatatataattctgattttcactcctctgtttataaatttccctttcaatttactcaacaaatacttattgagtgctttccaacgggccaggaatggtgctagattaggaagatacaaagatttagggattccttcttgaaggacacataggaatttgggaaagacatcttgggcagatgaagtaaaatagctatagcacagggtgtggtaatagcatggcctctttttggagcattggatatgttacccctactgatgatgataaatcgtctctctgtattgctcttaccaaacaatttaaaaatggtaatctaaaatcacatatgtaaatagtacatagtatatatacttaaaaactattgatttgccaggtgcagtggctcacgcctgtaatcccagcaatttgggaggtcgaggcaggctgatcacctgaggccaggagttcaagaccagcctggccaacgtggtaaaaacccatctctattaaaaatacaaaaaattagccgggcgtggtggcgcatgcctgtaatcccagctctttgggaggctgaggcaggagaattgcttgaacctgggaggcggaagttgccgtgagccaagatcgtggcactgcactccagcctgggctacagaatgagactctgtctcaaaaataaaaaaaataaaataaaataaaaaccattgatttccactaccacaaccccaagcatacacaaacatcctggtttggagtttaaagcatttttttttttaaacagatgggaatactttgaagcatacacgggtagaaaaaaaaaaaaaaagaaaagccataaagagtatagatagtgccagaaaacaaaatgaagaaggaagggcaagaacttctgaatttcccattcagtgttactcctttttacagccttagtgaaggagtaaagttagtcataatctgtggatcatcgggtccccaacaactggatctttgttctctgctcagtctctctgtatttttgcccactcatcccagctcctatcttagccccataacctctttcatctgacacccaactataaaaagtattatgtaaatatcaggaattactaccactctggctttcctttccccttacagccagccattaccttcctcacccctattgtcttctcctttggatccattacctagtgttcctgccttttcaacacactagcatctcttattgctgttttttctctgcccaacatggcacccttcttatcttaaggaaatgttacagataggaagaattactgcccttcacattgcttatgccatcatggtgtgaggaattctctacgcatatacatgagtgtgtgcctgcataacattgtttgtattgtttgatgattttgactaatttatatttcttgatacctttgatataaatccaaggcatagtcatagctacaaaagggaatgtctttgtagattctttgttggcctactaggtttcacacagttctgttaaagaaatttctaatgtaaaactttccaatgtagttgtctttgagaaacatctgggattttccattttttattgtggcaagactacatatctgagtatctagtaagaaattttaaatgtatctgatagtttcctgaaacaaataaaggagacacacatgcacgaatatatagtcatatatgtgtttaagagatacacacaaacacacatgcatgtaagtgtataagtgtacatagccatgaatgtgaacaattttatttcctgtaagaaggaacccttaatgtatcaagaattttgctttgctgtccagaattttgtgtgtgttttaaagggtttaaccgtcctatttggttgctatccaagtacttttactgattggtggaacataaacaaagcacacaatttggcatgatctgcagtcttgtctaagcattgtgaataacatggatattttagattaatctgaagagacatttcagaactgaaaagattacacagtgcctgttcatacaaactctggctagggctattagtctttagctgtacctaccacaggattaaccaaaacttgcatgaaaaagtagataatttcttaggggacatcaggaaaaaaatggagcaagagattagaaacatgatatattagttcatttggtgaggtggtactggtgacaaactatactagtcagttagcaaattaagttttactataaaattatttaggaacatatgcattgagaaaaaaaatcagagtattggcaatatatttacgttttctcttatactgtgactgcttaaattatattttcttcctgaacattcttaaacatcttctggaattaagattttggaaatggttcttcatgcacagcttttcttttatggtgtttttctcccacttctatttttcagtgaacatataattggaggagttgatatctctttgtaatcctgtttctttagaatacattgagacatttatagagtgtggttcacttcaaatagaaacatgcatcttgtggaatggtctcattgggaagaacagtagggattctacaagagtcctatactaggagattgaaatttggtttctagtttctcttttgctgctagcttgtgatacaacattgggcaagttagcttctctgggtttcagtgttttcgtttatacaatgagggtactgagaaaaatgaattcttagagtcctaaaatttcaacaaatcttctccttttacattctaagagttggctctttttgtagccttggccaagacccatcattgtcctttgtttgttacgtctctgaactgtgcatttcacaggtattttttaactgattagttaatgttcataaaatgcgtcgaagagcttttatgtatgttgtctttctctcctgttttatgcaattgtacataatagaagccaagtgttctgtaatcaaaataagtgtttcctacgatgtgaccaagggttttttgacatttgctattctaaatattaaagtagtgggacactgagcctgcataaaattatatttaaaatatatgttgaatcatttttgttcattccataggtgaacatatttttagttctagaatgtaatgggaattataattacactccatagttatgactggattctccaccagggtagtaacatctgatttgtttggatgctgccaacttgtaattaggatgattttacctggctgaagtttatttctaaataatatgtgaggaatagtgttgttaagtgaattaatagtgtaaagtgttgttcatgaactgtatttctgattaaagggattatttttaaggactttggcataatagttgtttgctcatgagaggtaattataagtgacttaataatttattaaaggaaaagtaagaactgaatatatatacatctccaccatcagatataatgcttttagggttttaggtgttttagagtgctgaggatggggtgtagggaggcagccttactttcttttcatgctgaacaaatattaaaattattggggtaccacaaaaacaaatattaaatattaagtctgcaaggaatctagactgaaaaattgacctggaagattcatggtattagatagcttctttggagcccaatgaaattcgacaaaagtatgttgttttttttgaatcagttgattgtttatagaagaataataacttatagaaggatattcttatagaagaataataatctttacaataaaatgatcttcacttgtttgtggtggttccctttttgggaatttggaaaactctaccttaacttgcctgttttccactcatcaatgtttgagaagtcttcatagacagataaactcctggaaacacttcactaccatgttttttacacaggtttttggatcttcattctcagaaggtgaagtagaccaggcacggtggctcacgcctttaatcccagcactttgggaggccaagtcgggtggatcacctgaggtcaagagttcgagaccagcctgaccagtatggtgaaaccttgtctctactgaaaatacaaaaattagccaggcatggtggcaggtgcatgtaatcccagctactcaagaggctgaggcaggagaattgctgcaacctgaaaggcagaggttgcagtgagcctggattgtgccaccgcactccagcctaggtgacagagggagactccatctcaaaaaagcaaacaaacaaaaagattcataagctggaaaatgattgagtctcttttctaaaacatcacctccttactacataatatatagctgctttatgttttatatttttaaatgtttgcaaatgcttcgggttttgaaaatttgtttgaaactcactgtggaataagacatttcaaacttgatgtgttcatacatgtgtgtggctgtgtgtgtgtgtgtgtgtgtgtgtatgtatttctccttctttggatttcaaacaagttgcccctgctgattatacctgaggcctttttgctatataaccattaaggattattgcagaaagccttctaatgtaaaatattgactataatttatgtgtattaatggcaggttaaaaaaaacttttaaatatattttggccactagcgcattgataaatattcctttctctgactcatttgacaatttctgtgagtctgttttgtgtgcaagtactaaaaggagttggatatgtaatttaaccctttaaaatgcttgactgggtttttgggggctgtttcttttgtatgataggttgaataaaaattgtatgtaaggtaatgatggctgacataattttaatatttacaaagttcatatattacttgtcaatctttcaaaataagctttctctttccatatatgtatgtatgtgtatatgtacatactgcatgtacatatatgttttgtgcttcacaggaaaatagtagtttgtctttttgccttgatattggtctgtatcttaaaaggaaggcatttgtgattatgttagttgatttcatgctgtatttcttatatactaaatttggtattttggaatttttgaaaatagttccttactgtagaaacattcatgtgtgtttctaaaatacagatgaaaaagcctcttaggggactaaatctcaatctttaaaaactaggaataatttggaaagaatattcgaacgctaactatttaagttggaagcatgagtttattgtttggatacagacttgaaagtaaatatgagctttgttcctgcagtgattttttaaaaataggtagttgctttcatgtcaatcatgatctgcctttactaagcttgcattgatggaaatggataattctgtttttaggtagaagcagaagggtactatgattgtgaattgcctatatcagaagtaaaattcttcagcctgtaaataaacagttcagcataatactcatttaacctatattcactttttagaattgtgtagaaaatttgtgagtttgttttggtgctttaaacagaagcttaaaagtcactttcagggcatttacaacgctattttctggcagtattttgaaacaatatagatgagccctttatttgccattgctttcatgaaatacctcaagctgcctttgacagcagcttcaatttttgaacctccttgacaatcgctaatccctataggttaccggacccgctgttgagctttggagtggtccctgctggacacctgcttggccagcagtgttggtctttcctctaggcaatttgtgagctgtctgcgggggagggaggggaggagtggggggggtggtgaacaagaggggaaaggggagagaaggggagggcagtattgaattagattgttgatagcgtccctctgaggactgctattaagagcatgctactctgtacttcgctgctgcagaagagagagtgatatttgtgttactacagcatgttgtaaatgtgtgagattttgctcatctcagcttggaaataagaatagggaaaggagagcaacttgaatcagaagctactagaagaacctgcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtaggtatgttgttgtttcattttcatatgaaacccatctatgttttttcttgctactattggtcagaaatcaggttaataggtgcagaatatagtacagtgctgcagtatccctgttaaggtagaacaatggtattgcaagcttaaaaaaaaaaagcctggctgcttttattaaataaagctgcattgtatggtatgcacagtgcagtcctaaaaaaatatactgcagtcaacgcttttctggcactattgttgagttggaatgattgaatcatcatattgctttaggggacagaagaatttaaggaggtaccttacagccctattttacagattggaagcatcggtttaagggcactggcagaatcctttgcttgttctccgcggcagccactgctgtgtcagtacagtgtggaatggaagtcttagttggtagtctgttatggaaacgctctttactgttattgtagtaccgtggtgacaacatgccattgaaatggaaaacgagctctcctgctatctggaaattcccagttcctgtgcttaaaacatccaggtcaactccactttctccagcatacatgtaagtgagagaaaataggatattaaagtgggatttcattcatgaatctaccttgtggcaaaatgggggcgggggagcccccaaacagcaacatccaaaaacctacaggattaaaaacctcaagcttgcttacatttaaagatgttggcatgcccacacttcatcattgttttgtttttctaaagtttatgtttatttaaagtgtttaatggtaatctaattaccagtgtgaaagtacaaaggcatacctaaggaattgcaaaagaattaactttaatatttaacatatgttggatttgtttgaatttttgaatatctaaaacacttaggatgacttcttttgtgtaatggcattaaaaattgatgattgatggtggtgtgttaaatatggtaatgcctctttactattttttcatgaattaaaaacagagttaacattgatcagaaaatgagtcttttaattgagacttttatactttagttgtgtatgaatattaatatgtttgatagtacatctttctcagttttatcattcaagttctgaagtgtaagtttgaatttgtgcaaattatatctctatgagcagttatattatggggattgaaaaagtattctacaaatgtctgttttaaaaatgtattttaagtaaatacgtactgaagtgcactgggaagtctttctagaagttttcaaaatttttgaaaatctttttaaatttgcagtgttgctttaaaggcaaaatccaggagatataataaaatgttcttttaaagtattgttcatgatcctttttggtggaggaaaaccgaatctttttttaaagaaaatattagtacgagaaaagcttttgaaaagaatgttttaaatttgagtgttatttttaaaatatttatcagtaggaaaaatgtggaaaacttctcctgccttagtttaattgtgtatttagagctgtggtgagttgccattttttaacttagtttttgttttatgtgaggtagagatgcacaattatatctatctctttctttgaaaccctttcagatgctgaggaagtgtggttatgctctcagtccaaaagaagcaattccctggaaagtgttgaaaaatgaggccatttcagagttaaatcctgtggtcattttattttcagattttttaatgctcctttccgtttatgctccaggatatttttatctctttgggtgttaaactttatgaagtaaaaaaaaaaataggctagtttgtaaaaataaaccagctatatttgtttttcaaaaactgtttgtcaaaagcacaaattaatggaggtgacaagttaatggaggtgagaagttaatggagctctttcacataattcgagaaaataggatgcttcctgactttatgcatcttaactggcaagaaatgactaaagatttaccaaaagcaactttattataaaaacaaaacaaaacaaaacctcactaaaatcaggttacaattataatggttattaatgtttctaatattcctactatatttgattgtctaaaagatccaaattgcagcccttattgcccctgatttgtcgatttttagagatggtgaaataaatccccatgttttattaaattcatgccagccacaagctcagatacaactcaacacaacattttaaattaatcactttcttccttttaagtgcttacctctttgacctgatgatatgagtgaatcaatttagaagatagaacctacaaaatataatagatcttgcatgttgactgttggttgttggtagtacacataggtagaatggaaaaatatattcaaagagcttatggtaggctgaagtattttgacattgtaacagactattttgacattacaacactctatattattgaattggtcttaacttatttttctttttatgtatattaatacttaatagtaagtaaatatgcacagatagaaatttatgtgaaatgtagcaagactagcttggggagtttaaatcaggtttttaaatatgttgtttagtttttgaccattttagatcacagttcattgcctcacttggccaaaaataaaaacatcatgtttaacatgtttttctcatcagtacttctctatattcctcaacacatttacacacaaaatgatacttaagtatagcataattccacttcaaaaatgataaagactgaattagattactgggtcaagtaacattatatttgttctcacaattgtttggctggcaaacataggtttaaatggttacttgtgtcttttgggtctaaactctttgcactgaaatagaattgttcaattctgactcctcaataaatcgtgatatataggaaatttacctgtaaaataatgtataagtatttaaagtagtattttgaatatagaattcttcataggtgatataagatctttttgtacgtatgcttgtgtagcatcagtattggtttgtaatgttttatcattacttaccgtgctttgtcaaatatacattacgtggttttcattgaagacttgagtactttgtcaaagactgaaatttcaatatgaagtattttaggtagtagtaaaaatgtgttatagtgattgagcatgtgtgggaaaaatctaaacgctccatggtctctttctaaacccagtgtatgtgctgctttgctgtagctcttccattgatgctacagatagggcagtactgctgtgctagtgaaggctacaatagagaacattttacttactgcaaacatcgagcagcaagactattacttttttccttgtgggtttaaagtccatgtttgttttctttctgtttgtttagaacttgaatgacagttgaaatgtcccaacatttttaagttttctttatgatgaagactatagtatttgtggcaatattagtagaaatagcatcttatatagtataaagcacttaaaaaattttgctgtaatgtcatactagaaaagtgggatatcttaaatacgaaagattcaggaaaataatacttcagtctctagattgattgatgatcaaatagtctttattgggtagacatattctttcagctttagattttagcattgcagggtggtgtgccatctatgtggatttctgaagggattgtcttgatagaaatagagtgcttggtgacatgtgtttgctttgcactctgttcaacagtaggttgaagttcaaccttagcctgagggaggatctcctggccagtgtaaactgcattagtaaagactctgcccctgacaggtgcaaaccatataaattactctgtcatttagcctaaattaataaagctgaaagagcaatcacatctaagtgtttttatggtgtttaggtattcattgttttaaaacagcaaatggttccttcaggcaaatattatagggttaatgccttgttagatgctaaggacacactgaaatagaacaaaattagcactagtgatcctttcatcttttcttttccagcagcgagttttgacaataatagtgtggcaaggaggaaggcaattaggtaagaattaaccagtgaaatataacagtgaattctagcaagacagaccctgtgagttgttttccttagaatgttacctttctcaatctaaaagacaatgaatgttagtgaactagacttgttctcctttagtccctgcacttacattcagttagcttcctatttatgattttttgatatgtaaaaaatatttttatagtaaatgccaaaaaacacaacattctatagcaattgcctctgtaatgtcttcaataaaattcagtacctggcatttcctgagaaaatattgtgtatattgtataaatgctccttgtttgtaggtgattcacagcacagacataataaaaatatgaattttctaaatttgacatgtttctatcccctaagattgtcttttttttctaatttagtaaataaaagaaaactttgtggttacagaaatctttcttatctagcaaaatacttattaaattgataatcatttgtgattagagaaatctttcttttctagcaaaatacttattaaattgataatctcaaaatagaaaagaatgtttagttgctttgagaacataaacttttacttgctttgtgtctacttaattttgtttttattacttatgcacaatttaacaaaattatgtggaaaaataacacaactaacacctaagataaattttgtgttagtctgcaacttttgtggcatgttctttgggaatttgcattgtctgagcttgcagaaggactaggttgtcatttattaatggaaaatcatagagatagaagtgaccttaaaagtcatttagaaagtccaaaccccttttaacacaggaactcattccatgacacctctcgaagatggcattgcatgtccttcttgaacactgtcactgacaaagggctcactacctcaccaaggctgcaccctccattcatggacagcttttccttgcattgagcaaaatcagttccttgtatcttttctctcccgttcccaatgcagccttatagagctatatagaaaaaaaaaaattctattacatacacgcttaggcgtcttctcatgtgacatggttttcagacccttcactcttcctggttgtcctcacgtggatggttttttcatgttaatctttatgtaagacactacatttgaatgtgatgctccacatggggcccaaatagaagacaattctcttcctttaagcagaatctctgcttgtcttaaagggcctgagattatattattttttttaattataggattcacactgtcccctagtgaatttacagtttgcaaattgcctttttgaaggccttacaatcagattgcttgctcctcactgtctgtgtttattcttttagcttcttcagatcttttagtctgaggaagcctggcatgtgcaaatgaagttaacattttgttttaaagcctattgtgtattttttaaaaagacctcttgaaatcatttaatataacagaaaaatattgcacacaagacacttgcaagacaaagagctagtgttcctgtcactttcagatatttcaaagacattcactggtcaataatttatctagattcctttttttatacttagtgtatcttccaagtaatcgcttcccccattgcaaagaaaccactttctacagagggaagagaggcagaatttcatatctccataccatcatgggaagtacggagttactgagaatttcatacattctgcttgaaacttagaatatttagttgagacttaagtatggccaaacttggggagacggagcgatgagaaagaagtatgggataggcaagtatttgtgctaataacttgcagttgaagagttaagaattacaaacaacatacatgataaaattttagattgacatggctgccatgatgtattgctttatatcctcaagactttgagaaaggcggtataaacatgagattcttggggaatcagtacataaataagttactgagtaattcattttagaaaatgctcagttctggatattagccctttgtcagatgagtagattgcaaaaattttctcccattctgtaggtagcctgttcactctgatggtagtttcttttgctgtgcagaagctcttgagtttaattagatcccatttgtcaattttgtcttttgttgccattgcttttggtgtttcagacatgaagtctttgcccatgcctatgtcctgaatggtattgcctaggttttcttcaagggattttatggttttaggtctaacatttaagtcttcaatccatcttgaattaatttttgtataaggtgtaaggaagggatccagtttcagctttctccatatggctagccagttttcccagcaccatttattaaatagggaatcctttccccattgcttgtttttctccggtttgtcaaagatcagatagctgtagatatgtggcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggcaatgtgggctcctttttggttccatatgaactttaaagtagttttttcccattctgtgaagaaggtcatcggtagcttgatggggatggcattgaatctataaattatgttgggcagtatggccattttcatgatattgattcttcctacccatgcgcatggaatgttcttccatttgtttgtatcctcttttatttccttgagcagtggtttgtagttctccttgaagaggtccttcacatcccttgtaagttggattcctaggtattttattctctttgaagcaattgtgaatgggagttccctcatgatttggctgtctgttttctgttattggtgtataagaatgcttgtgatttttgcacattgattttgtatcctgagactttgctgaagttaggaggagactttgctgaaggagattttgggctgagacaatggggttttctagatatacaatcatgttgtctgcaaacagggacaatttgacttcctcttttcctaattgaataccctttatttccttctcctacctgattgccctggccagaacttccaacactatgttgaataggagtggtgagagagggcatccctgtcttgtgccagttttcaaagggaatgcttccagtttttgttcattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgttgttagttctgtttatatgctggattatgtttattgatttgcatatgttgaaccagccttgcatcccagggatgaagcccacttgatcatggtggataagctttttgatgtgctgctggattccgtttgccagtattttattgaggatttttgcattgacgttcatcagggatattggtctaaaattctctttttctgttgtgtctctgccggactttggtatcaggatgatgctggcctcatcaaatgagttagggaggattccctctttgtttattgattggaatagtttcagaaagaatggtaccagctcctccttgtacctctggtagaatttcaaacaaatttacaacaaaaaaacaaccccatcaacaagtgggcgaaggatattaacagacacttctcaaaagaagacatttatgcagccaaaagacacatgaaaaaatgctcatcatcactggccatcagagaaatgcaaatcaaaaccacaatgagatactgtctcacaccacttagaatggcgatcattaaaaagtcaggaaacaacaggtgctggagagcatgtggagaaataggaacacttttacactgttggtgggactgtaaactagttcaaccattgtggaagtcagtgtggccattcctcagggatctagaactagaaataccatttgacccacccatcccattactgggtatatacccaaaggattataatttatgctgctataaagacacatgcacatgtatgtttattgcggcattattcacaatagcaaagacttgaaaccaacccaaatgtccatcaatgatagaccggattaagaaaatgtggcacatatacaccatggaatactatgcagccataaaaaatgatgagttcatgtcctttgtagggacatggatgaagctggaaaccatcattctcagcaaactatcacaaggaccaaaaaccaaacactgcatgttctcactcacaggtgggaattgaacaatgagaacacttggacacaggaaggcgaacatcacactctggggactgttatggggtgggggaaggggggatggatagcattaggagatatgcctaatgttaaatgacgagttaatgggtgcagcacaccaacatggcacatgtatacatatgtaacaaagctgcacgttgtgcacatgtaccctaaaactttaataaaaaaaagaaagtgctcagttctttttcaatcaccttgtatattaagtttataacattcagcagttactcaactgtctattatgtgccaggcataactctgctgaggattaggggcatagtccttgtgatcattcaaagtgattattttttatcttccatactatcttcattcataagcaattaaatagcttaatttattctcctgctgtgaaaatttggaaccaagacaaacaggttaaataaattcttgcttactgtactttcaatattgataatggatttaagggcaatggaaacacctcagaagaaaaatttgtctggactaaatgaggagacttgaactggaggtagataacacatgttaaagtgcatattgcacaggatggaaaatgaagcaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaaatgaagcaatttatgtttaaagttcatagtgtctttttaaacaacaagaatggaatactattctttacattggacagggaataatttactgtttgtgtgctttatagcacacaagtttacatatattaccttccaagcagtaataatttgatctcaaactctaagattgaatcttagtttaaaataaaattatattgtgttttcaattatactaaaatatttttcccagcataacttactatgatgaggttatctgttgtttttacccatttcccccccacatttatgtcatgctaaggcaagaacatgcccagtttgttggagaggatttcttataatatagttcaatggagtaatgaagtaacttatcttcaataacaaaaaaataaaaacaagtttcagaactttagattaaattttaatctagcatgtataacagatattctaaacttcatgagacatattccaaatttttaaaatgtcctagtttagcatagttaaatgtaatacaatttattttcctctattatagaagtgctaagcacttaatttcattcctcccaaaaagccctgtaagtgtacatcctctcactattttacgaataaggacacaagttcagagaggttaattgcttaatgttacacatcaaattacaagttgagccaaaattcagatttagggccacgtgatttcaaagcttgtaatttctccaatgccttttcatttttatagacttttgctactttcatgccatctattaattatataataccttactagggttagaagaaaagggaaatatggtagatgggaaaagctttttgaattgggtggtggtataggaagaggttagaaagctttacttgcttactgtcaagtggtgaagttgaaggaaaatattgaggcaattatctttacttgctcatatgatatcgggattaactccattgtctcttgatgtttccatagttccttgaagcactattccatcttcattgattacacacatttcccacccatggtaattagctgccacggacagtgctgtagctggtgtactctttttagcacgttccaagggttctaccccagtcagtatatttagtactttcctgcagacattatcctcccactgcttaattgcatgcaaatactcaatgaaaaaaaaaaacccaaacctctatgtatttcttttctattgctgccatatcaaattactgcaaacgaatggcctaaaatgtcacacatttattatcctacagttttttttttttgagatggggatctcactgtgtcgcccaggctggagtacagtggcatgatcatggctccctgcagcctcgaccaccggactcaagtgatcctcctgcctcagcctcctcagtaactgggactacaggcacgcatcaccacacccagcttattattattattattattatttgtagagatgaggtctcgctgtgttaccaggctggtctcaaactcctgggctcaagctatcctcccgtctcagcctcccaaagtactgggattacaggcatgagccaccatgcttggcatattatcttacagttttttcagatcagaaatttggtactggtctcacggggctaaaataaaaatgtcagcaaggctgaggctctaggggagaatctgtttcctgctcattcctgtcattgacaaaattccgttctttgtggctgtaggaccaaggttcctatcatcttgttggctataagttaaaggacaatttcagcttctagagattgcttgcattccagccccattcctccctcgttaaggccagcgacagcaggttgaatccttttcacattgccttctggctcactcttctgccttcctcttccattttttcaggactcatgtaattagattaggctacctggataaaacaagacacgccccatttcaaagttcgtaacctttatcacattttcaaagtctcctttgccatgtaacaacatatccacagattcctggggttaagatgtggacatctttaggaggtcatttgttgtatctacaatactctagttgaacacaatcatgttgggcttacacatgcgttgtagaaagtgttccaattaacccaagtggttctacaaattttgcattcctgtaactaaaccatatttattaatctctggatcagtagttttgttcttgaaaattataatagtttaaacattacataggcagttctcagcccttgcaacaatgatttcctggaaatcttattaaaaagtggaattatccagtaacagaactataatctggggttgtgttgaaaatatcatgaaaacaagtttctcctattagagcttttattgtgctctacattttataaaataggcacaattgttttgattacatcgattttgcaagcatatacaatcatataaaatacagatatgagtgaaattgaagatgctagttatttaaaaactattttttttgaaaattcagtctattttgagatggttcacatagcccaagtctcttattaaaagttaatagtaatagtgctaccttttgaataaaatcatgaaattagttttcttaataaaatttgatgcaacaagcggaatcattcagaataactccactgttatcagagccatttaaaaagtactaaagtgtgtgcatagtacaagttggctgatgctgattgcattttattgcattgaaaaaaatttcaaaggactctacatttctaccttcccaaaacattttcagtttattcaaaagactgttcaaaatcagattgaacataaaggctaccagaaaataatagttaacaaccagaaggtctttgcatgtctctggaaattcaaataatacaggttgttgagaaccttaaaaatcttcaaaacatagtactgaattagctagcagtggcatatgattatgtggttgttgctaatgcactttagtgtttggtgtttggcaggtgcagggggcaaatattgaaattttgagtgtcaggtaacatctactgagtgaaataagaacagttaaataacaggtgaggactgtctatgctactcagtcattgaccattatgtttgattcttcagcaagttatggcctcagaagtggcatttctaaacttggaggtgcatccaggaaagttctgatctcagatctggttaccaaactttctagacattgtctggctcctattatggcaggtgcaggggcttgatggtattttaatttattatttttactttttttttgtagagacaggatattgctatgtttccaagactggtcgtgaactcctagcctcaagctatccccctgcccccaacctgtgccccgcaaagtgctgggattacagacatgagccaccacacttggccttctgatggtattttaaatttaaaaggtttagattgaaaatattgtgttttagagcactaaaatttagagaaccaaatattatgagaatgatgaattggagtggcaagctcagttgagtgtatgtgggcaattgggcttaatttgtgcttatgcgatccctctgtacctaactgcactcccttcttgcttcccacatttaagtctctcaccgcagctgtttctaaaagttctaaatgaacttgcttaatcatttacaagttgccctgtaacatcttttattttcacttttttttctggtttcaaaaatatagagcttttcactgatcaatgagataagaccttgacatcatataatgtgcataattatcttaatcagggttctttcaatccacaagctgataggaaccttagaaatcactcttttggtcataccatttaccttgaaagagaatgtgatattaatgcttgatcacttttcctccatctgtgtacatttgtatttgatgatttaacccagtcttaatttatatttccttttaaaaataccatttcttcaactgcattaaaattaatattaaagaccagctctacaaaatcttaactaggtttctctttattaaatgtgattatatcagagctcttctcttgtctgacagtgaaacatgttcttaattaatagtctgatctagctttagtttgggtggacctacaaaatatttgaaatacaattttgaaaagtatatggatgacactaaattgtgaatcattgtccaatagataaccccttagcatcaccaaattgaagtgattttctcattcgttacgatcactttcctacagagggtgcgtgcatgcagtcatttctgaatgattcacagctaaacaaagttcgtgaaactggaaacaaaggtttggttttaagtagactggagacttggttcattaatatacttttcatagaaatgttgctgaagcatatagatagatacaattagagtgttttttttaaatgatgtgcagtactatcacatcatcaagagttttgactttcttccatataattaaaattgcagattatgtttttgaatagtgaatattgtgtgattgctgatccagccctgcagatagcctgatctggaacaaataaccctttaaaataatagtaaggaaagttgatattatttatttatttttatttggtgcttatatgctaaatatgaactgatacccttatggattagagaaaaaagttggcaatcgttttgttattgtggtttctatgaattatacaacatgatatttgttagtaaagagtggtaagcatttattataattttatatcatttaattatttggaaagtaattgttttttattatcatctcttagcaagcaagtatcctgactgctctttgttttattatcatctctttgcaagcaagtatcctgactgctctttgttttcctatcatctagtgtggtgcctggcacatagcagatgctcaataaatgtcgattttataaatgaatttagagaatagtttttaggtctgtacctctgtgcagatcacttcacatgaaagtgttaagtttattcatctgatatatgcagtaattgaatatagtagttgtcccttatgcatgatttccaactccttggaatgagttacccatggttaaccatggcatgaaaataggtgagtacagtatgataagatattttgagaaagagagagagaaaaagagcacattcacataacttttattaaagtatattgttataattgttctatttattactagttattgttgatatcttactgtacctaatttataaatcaggtagttatgtatgtataggaataaaacgtagtgtatatggaatttggtatatccatagtttcaaacatccactgggggtcttggaatgtatccaccgaataatgggggctattgtgtatcatggtcttgttagagaataagttatgactgtatttcctatgaaaagaactaatcaaaaatccagattctgttcattgttgctgagaaataccatgatactggcacagactgaaagtaattttactagaagcaatctactagtgaccaaaatactttagtcatggttcatcaaattgtaactgataaggaaaataaggtttttttaaaaatctgttctacgatagaaactactctcaaagttaagagttatttgacttatttttgcatgctgttcatcataatggagaaaactatttgagatatttatgttttgaagctaatatgcttttacttaaatgataatgtgttttgtgtgtatagtttgataaaagaaatcactgactaggagaaaaagaagacctgactagggtttaggagaaataaattaaaaattaacactcaaaaaagtatttacatttatgtcctgaattttttatacttaaagggcttcaatctaaccataaaggtttagctgatattatatttaaattaaatgaattttctttgtgttaaaaatgattaaatacaatggcttttacacattacttgtttagcaagagacaaaaaatgcatagctgtgaatatgtaaaagcaatatattccaaagcaaaacaatttgtagtttgtaagtaaatttggattttcgtttgttctgttgtcattaaacaaacatttattgtgaataatttgctggactgtgcaattagttaaggagggtgaggccaggaagccttgacttcaagagtgtaggatttggcttctgttcggcaagcagtgactcactgaatacctttgagcaagggagtgcttttctgagctataaatacaatcacagtatgtataaagaccattatgtatgtgaaaattataattaaatccaggtaagaggtaatacagacaagaactgtggtagaggcagtgagagtggatgggggttgaaggataggagcattctagagagagattcagttgaacttagcagttgattggacatgggaaatggggaagaagcaagggtcaaaggtggtcaaataattttggtgagagcaattgccttttagaatccaaatattttatctatagttcttttgaatgtataatatcaggatacatcggagatttctgaaatttcttctgactgaccaacattttaggaatggtcattaagaaatatgtatgtagtcaaattcattaccattaagcatatctttgacatatgaaaagattggattttgaagatgtaaaaatgatgattgcttcaacaagtatctcatggagatggagtgagtgagggtagtagcattttccgactagctagggaaacttttaacaccttgactccctgctactctcatctacatggtgactcttctccccttttgtctgcttctcatctacactgagagtcagaaattatagtttggggtgtgaaacactggtttaaaggactgtataaaaggaaggaaaggaatacttctcttttttcatttatctcacacagattaaggtaagtacttcattactacttcataattcatagattgcttctgcaaaacacatgtacacacaatctgaaaacgctccagttatcttcaatttaaaattcccatttaaatgaccaggagatttgaatgcttgatgcctactatgtcatttttatcacaatggtatgttctacccaagaacacatagccttcttttagccagagaacatggtgtttctacaaataaacatcttacccctaaagagacaaattccttgatgatttataatttggaatagcccctccccaaatcatcagtctgccttccagaaaaacattataaattttgtaaataatttttaatattttaggtaatgatgtatagttgtgacacataaatattttgcccaaatgaatccttctttagaattactgcaccatggataaacacttatggtagttttggtagagcaatttttgttattcacattagcagagttgtctgtggctagatactgaaattgctctgtgatatggactggaatattatggtgatcttaattaaactggctttctaggagtgtagtaaaatggtggaccctaaaacattttaggtgaaaaaccaggaaccagttctagagctaaagaccacatatatactcttggagtatggtaactgtgaatatgtagataggtgagtgggctgtaagtaacagtgaagactttttgcatctcctaacaacctgagagcttatggccagcaatggatatgtttctttatgggaagcatagtacaaaagggataaactgaagtcttataataaagttttgtggaaaaaaacccttaatggtgaggcagatatgcagaaaagggacaataactttaatgttaaaaaatgatacttagagtctttgcttccattgagccacgtatctgtgatgagcttgaaagaactatcctaagagtgattctcagactcattaggttgagagcctgtcttctttttttgtattattctcccctgtcttaaaaatactggctgtcatattgaaaacgtatgactgatttgatactaattttttcctacattcattgaaataattagagatgactccaggccattacaaaaatcaagactgagatttggtaaatttattacgggctttgaatacatagagtcattgggactcttagggctgccaactatatttcttaaaacatggaatgcaatggttactactttgtgagtcttactcttaggttttttcatgtttccccttaaaagataaataaacattctcttaagacctggtcatgaattactgactttgtgaagttgaatagaactgggaaattcaggaaaggataggattttcaccaccttttagcagttgattaatgaatctcctgttcccaaatcgatttatctcagttatttctaattggttttgagtttgtggaatctgctttaataataaactctaaaattgggtaactcagatgtttgaatatttaataaaaatcttaggaaggtgaaacacagttctttcttaacgtgctttttgattttaatgcaccttagcaaaagagtcaaattttaaagttgatgagctacagataatgggagtaaaatgacaccttggttaacaagtcctctggaagcaaagctcctagaaaattggcctgagcattgaaggggttggaatacccattccagtttcttcatttttggattaaagaaagagaaggcaagctcactgctgcagatatagagacttctcaaagggcaggctgggtgctagctgtagggcgaagcatccttctagagggcctatgcttcaccagaggattgtaactatttcctctgtgcactgggaaggggactcttgacagtgatgggagcacatgctgtttctcctagcccacttctacatattgccatctccctaccaccattatcacatgtgcattctttcacctatgtggttttataaaagcaaggaagatttgaattcacttgtttgtatagaaggtatggaatcaacatttagaaatgcattcatcttctaattatttttaaattacttcattagaaataaaataattatctcattcagaaaatagaatggattcttacataccttatctacctaccattcatccatccatgtatccctttatccatccatccatccatccatccgtctacctatctaccaatctacccatctgcttatcttgctttcacacaaatataagaaatgtggagaatgagaaataatatataaactaagctttctaaatagaaaacatttttggtcaagatgaattggacatgatgcagtttaactggtatataaattttaaaagatgaagggacactaaagtcttgaaatatggtaagcagagggagcaaatattattttgaagttctttaaggacaagattgagatattcagtggaaatgccttttgatttgggtaattaactttcatcctgttatagttatctaatggaatatcatttgtctagcccaattcccttatctacgtcatagtgttatatctgttattgtgatggttggcattagagttcagaatgtgttcttttaaatgttgatatcagtatgtgaaattctccccaaatttcatctgagttattttctaggatttactacctccctaccccataagtgttgggagaatagcatgaaagatttttagtgttggtattgtttttatggaaatagaatggtaaaagtaagtgatcttcagattgaattaattaaaccagaaaattacttgcctataacagaatgtatctctctgatatcctccttgtgcttataaattaagcattgaaatgctaagtgacttatagcctctactgtctgctatttttaattttttaggcttggtataaatgggaacaatgtaggctctggattcagatgtgggttcaaatcatagttactagactcatggtgaggccttaaactctccgagcttcagttccctgtctttattttattttatttttttattttattttattactattatactttaagttttagggtacatgtgcacaatgtgcaggttagttacatatgtatacatgtgccatgctggtgcactgcacccattaactcgtcatttagcattaggtgtatctcctaatgctatccttcccccttcccccaccccacaacagtccccagagtgtgatgttccccttcttgtgtccatgttttctcattgttcaattcccatctatgagtgagaacatgcggtgtttggtttttttccttgcgatagtttactgagaatgatgatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatactcagtaatgggatggctgggtcaaatggtatttctagttctagatccctgaagaatccccacactgacttccacaatggttgaactagtttacagtcccaccaacagtgtaaaagtgtttctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcaaaaattttctcccattttgtaggttgcctgttcattctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccattgcttgttttcctccagtttgtcaaagatcagatagttgtagatatgcggcattatttctgagggctctgttctgttccattgatctatatctctgttttggtaccagtaccatgctgttttgattactgtagtcttgtagtacagtttgaaatcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttaggtagtatggccatcttcatgatattgtttcttcctacccatgaacatggaatgttcttccatttgtttgtatcctcttttatttccttgagcagtggtttgtagttgtccttgaagaggtccttcatgtcctttgtaagttaaatgagttattacaaggattaaataggatactagaatgtgcctggcacagtgcttagtacacagcaggtgctgggtaaatgatcttattcctatgttaaaacagacagaagctatttattaatactgttctattttaaatgtgacagacatatgcatataagaagcctgtgcaatagctttttatagcctgtgcaatagcttcttatagccttggaaagatagcagctattttataaaatctcatctgtaactaaagagttccattagtgaaatgatttcaggtagacaataatatatttatgtcattaaaaaaactacaaataactaacaaaagctttatctttcttgattcctttcaggcaaacacctcattaagaagatatattctttaaacaacaattaatttatgccttattaatagatgttactttcaagctcactcttgttggtatttgaaaaagaaaaaagagagagaagttgctatgatatttataatttctttgtgtaatgatactataaatgacattttagttgggggacaaatctttcaatatttgaaattttaagtttttaatttttttcaacaaaaatgccaggcttattttatatacattagtttacttcatgagttggaaattttgttcccgattttttcaaaacatgttcctttgtttcataatgaaagttgagtatgtgtacactcaaacgtttgtggtatcattcagcttttgtttgggaagtgtggagaaagagaggagtagaaaagctattaatatctttcgaattcaatgcagtatgaatactttgactctatcttaaaaagccaatggaaaatggcttctaccatcttaagtttttaatttatttctcaagggtggaaggaaataccttgacagatttagccctgaaattcaaatgagtatgagaacaggtggtgaaatttcttctccacctgccatgcaactttatcacaagaaatgtttcatttagcaaatgctgctgctagcagacacttctctgtttcagagcagaaaaacaaatggatggaaagtactttgaggaaagactttttcttgattttctttttaaattgtgagtgtgagcaatatgtattttattttcctgggggttgggtagtggatagtcagtgccttgattaaccaacctgttttgttgtgttgttaaaccattcatagctttcttgtttttgttttcattttgttttgttattgttgttgttcctgtataccaacccactgacaccaactttagttaaggtaatattattaatctggggaacttgaaatatctatattatacttttgacactaatgcaagagactttcttttttttcttttcctttttttgagatggagtttcactctttcacccaggctggagtgaagtggcacagtctcggctcactgcaccctccgccccccaggttcaagtgattcccctgcctcagcctcctaagtagctaggattacaggcacctgccactgcgcgcggctgatttttgtgtttttagtggagacggggttttaccatgttggctgggctggtctcgaactcctgatctcaggtgatccgcctgctttggcctcccaaagtgctgggattacaggcgtgagccaccacgcccagcctgggactttcattcttttgttgcagtgaaattgagtttttagcatatattgttagatttaaccttttttggtaatgaaatgatggcagttaaagcactatgaaacaaatgagggaactaaatagaaaagtgttgttcatatacttttacctttctagcttttctctaattcatttcttcttttttcccttcagaaattacaaacagtacaggaaagtgtagagaacagtcttttattcatagcagtatcaagatgttgctttttatttgatgtgagctagacattaatgtaccagtgcatgaattggcacacataacctctctaccaagaaaagttaagtgcttttattgtgttttcatgatgataatctcaagaagcaccaaaatgttcccttttccttgacaatgaaatttgaccacacctgggtttctgtataacatgaactgctatttgcaatgatagaaaccaagaaattgaagtacacattttataattgatcaagatgatatcttattttttaaacacaatggtactggtttcagtggattgtcgtgggatttatttaggtatggagattgaggagcattggaagattatttgtggcttttgagtcaaatgatgcaattaagagatgctttttccttcctcatatagcattccaacaaacatatttactataatgaattctaagagtatatggttctctatagaacgtctaccaaattaaacctctacagagggattcactgaagaaaacacatttaagtcagatcagcagagcactcttgctttggcccacctaccaggacatagataccaggacacaattcttcattgtcatgttgcttgctattaaaaaaaaaccacatttgtccatttagtgagttttaaatttcctttgaaaaaatccatttggatgaacaattctatgcagacagtagtaggagtttatgacatgtttgcactagcaattttgagagtatatcttgtactctgataattttgcaggtttaaagatagaatctttgtgcatattctggaatactgatgaggttgaacatttttgtatctgctaaccattggcaccttgatctttgtgaattgtgtgctcatatcacttacatgtttccgttcgggtaattttaaatatgtggacatttcgaggcaagattacaatgttggcagccctttgttaacatatgacaatggcttaggctttttttccttttgtctttaaatgcagtgcagagaaatgccacagtctgtgtatgtttggtttgaccacgtttacaatgctttcagtaaaatggtcagacagtgcctccatctctaagctaatactcatcaaaaaagtagttgttttctttgagcaagcacagttgagtgattcacgtacactttgtgaaagattgctcttgtgctttatggttggtcattgtttcaagaataagacgtctgctgtggtgattgggtaggcggggggtggcatgcaagcaatatgcagactataatattgtagggaaaagagaggtttaatttttagaaacaaaattcgttaatatagtctctcccatgaataatcttgtagggctggtgaaatgggactatttagacagaatttgccagattctaacttaacatgtaaaagtggatccaaataacaactgttttatgcagatttaggaaattattattcttacatgagcttatgtaaaacaaaagctttgctgcataattttcttataaacttcaaagccattatctacttttttactcttagacttgagttttcaaattgatgggcctgtggagagcagagatattctgttaggtagccttggaagaattagtgataattaataatcctgctgtgtttcatattgctagcattacctcatggattcaaccctatgactgggaaattatttaaatcatgaaattgcttgagaaaaattttcatgagacagtaaattcctctatattaggatttctcacctttggcacttgacttttttgcctaagaacagctttgacctagagaactgtcctgttttgtaggatgtttagcagcatccccagttgtgacagtgaaaaatgtctgcagacattatgaatcatgggggtggaaggaggggcaaaatgcctcctgctccccctccccacattgagaatgacttgtatgtatattgtatttaactatatgagttgaaaaaacatcagattaaaaactgttattttttttcttggaattactcagataatcattcctttaagcatagattgatataattgtggcttggggtttgcagagaagtgttacctccttgcaatgttgaagaacagtgctcttcacattcaatcaataaacttaataaaggggagatagatgggaatattgaatctgctaagaaggttaacatggcatgtactgttaccaaagcagaaattagtagggagtgttttgaatgttaaaaagtcaaaagatactgataaaacatcatgaaaaagataattttagtccaggcttcttcagcttttgaagtaattaattaaaaaggcaagcatattatgttggcaagaaagggctgcattttcactttttgctttctgtttttaagagcaagagacaaatgacaaagtaaataagttgttacttgtagtttactcaaaaaagcaatttccgggatatgtcattgtggcaatgtgaattcagctttactcctatcccttttacatctgcagtttcataagaatgataattgatggtcatttaagcactgcataataaagaaatgtctttggaatgatctacagaaagaagattctgtattcattcagaggacatatattaagtctttcgtgctaggctctgtgcagggaatacagaaactaataaaacagtctgcttgaatatcctattaatataatctggatgaatagacattttctggttagggataacagtcaccatcaatcaatttctgacttttccaattgattctgtaattttaaacgtctgtccacaaaagttgtttaaaattgtgtgtgtgtgctatatatcataaatataacttaattctctttaaagctatctctgaaactctggtggaaggctatatccagtttcttttatgctttttaaaatcttaagttattctcttctttattaaatatctatcagaattgaattaaacatggttatatattattaattcatttttggttatactatggctctaatatcattaagaagaattgatgtcatccttaaggccagaatttttgctaattattgcaagatttaaaaccacttagttggtgtcataattcaaaaagcagaatctttagtatggtctttttcttgttaaaactgatcaacttggggttttaggtatgacaggaaaaaaaggtgaaacctttctgatattggatagctcagttagacagttagaaaagcaaataattcaaaattgaggaaattacagaaaaaatgaagagttccagcacttgaaaatctgctctccttcttttttcctaatgtctattttagcagtctttttagcagtctgtatcatgaatgcagaaccaaattcatgagccatgggctccccactcttaggcaggtgatccagagattattttagcaatgtatacctatggagaaacacaagatctcttctaaggaatgatgaaaggttattaataatggcacatttttagtataacctgagatttttaaactatcaaatgtattgtcatattctctttgcatctaagtgacctactgactaaggttctcctattcttacttatgccccttgaaaatactattgctgcaatacatgcaaatacagaattgcctgtatttatatttttagtattcatttctttgaaaagatggaaatgtgactagattgtagctattaaacaatcccaaactggtaagtgagagatactgctagaaaaagaaattatatcatgtgaaaaattttgttcagttggggttgattagaactactactaataacagaagataaagtaatgcattaatatataacaattaatcttttacttttattaatgggggtttggagtgggaatcagactagacctagattcaaaccctgggccaaccactttaataagtggtttctgacccttctttagtctgtgtataaaattattggcaagtacctgctatataatgactattcaataaatggtagctatcatttttatcttttcaaaattaggtgttccaaattaattttaactatatgcagcataatttgatggcattgctatctaaatagtaacatatcaacagtaattactgtggcctttaaaaactctgtgactataattttgaaccaccttttaagttgatttctcagttatcatctgtatattctgtacttggaaaccattttacaaatatacatttcttctaagataaagagtggtacaagcgtataatatagtgaaacaatattcaccatattgcatggtcatatgattgcaatagtgactgattatttttctaaataatctcattgtaaattgtacaagttttaatttccccttctttcttatgtaaaaaaactttcagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacaggtaatttaagctgtctctttggtagtgtttacgtagctttaaaaaacccaccatggattttgtgatgcaggatgtcagtagtggaggaggttgtgggtgtgtatgtgtgaataggaaatgtatggtaactattttttgctcagttttgctgtgaacccaaaatggctctaaaaaatgaagtttattaagtaaagaaacaaaagacaaaaactaaccaggagagaaatcttgatggaggaatgcacacattcctgaggttaaaaaatcctcagaatcaattttttgtttggtttgtataaaggacattttgccagtatgccactttcttacagaataccatatctgatttcattccatagcaatcaaagtaagtattacaaggtccctacactgaattttcctagttcctcattcacagcctgttttactatcatctttgtaatggttctaaagattatatttatttggtgtcccaactcgcattggtagtagtaactgtgggagaagaggttaggactgctggatgcaaaccctctgatacatgtaataagtaataactaaaataaaagcaggggacagaaacacagtagaaagccaaaagaacatgaaacacagcaatctggagctatttagcacggggattagaagcttaagtacttctgacctttgtggacattttctgacttctgtgggcattgctgaattagagagcaatatggtactggatgtccattaatgtcttctaaagatagttaaattatattggtcctcttactacccttaataagataaggaaaatttgcctttctaaatgcatatttaaaagaaatctccccagatggatttcatgcatatccctgatcaagaaccattatagtaaagctgtatatagaatataatataatgagggacaaggtttatacttgctgtgcatcctctgtgtttaaatgtaatttcaccggatttcattttccttatctccaaaatgtgactcttgactagcatacctctaaatttcctgctagtttcaatctttgaattcagtaaaatcccatttccccagtatttccgtttctaattggagctggggtctatctaaggttcattgtcctgtgggtcatcaatagatatgtgagtcaggaacgagaatctttccatctcctggcatcttaaagctgtgtagggaaaagggaagatggccgaatagaacagctctggtctgcagctcccggcaagatcaacgcagaaggtgggtgatttctgcatttccaactgagcccccactggtgatacccgggcaaacagggtctggagtggacctctagcacctctagcagatctgcagcagaggggcctgttagaaggaagactaacaaacaagaaaggaatagcatcaagaacaacaaaaatggcatccacacagaaaccgcatctgaaggtcaccaacattaaagaccaaaggtagataaatccacaaagatgaggaaaaactaatacaaaaaggctgaaaattccaaacaccagaacacctcttctcctccaaaggatcacaactcctcgccagcaaaggaacaaaagtggacagagaatgagtttgacaaactgacagaagtaggctttagaaggtaggtaacagcaaactcctccgagctaaaggagcatgttctaacccaatgcaaggaagctaagaaccttgaaaaaaattataggaattgctaactagaataaccagtttagagaagaacataaatgacctgatggagctgaaaaacacagcatgaggacttcatgaagcatacaaaagtatcaatagccaaatcaatcaagcagaagaaaggatatcagagattgaagatcaacttaatgaaataaagcaagaagacaagatcaaagaaaaaagaatgaaaagaaacgaacaaagcctccaagaaatatgggactatatgaaaagaccaaacctaagttagattggtgtacctgaaagtgatggggagaatggaacaaagttggaaaatactcttcagggtattctccaggagaacttccccaacctagcaagagaggccaacattcaaattcaggaaatacagagaatgccacaaagatactcctcaagaagagcaaccccaaaacacataatcgtcagattcagcaaggttgaaatgaaggaaaaaatgttaagggaagctggagagacaggtcgggttacctacaaagggaagcccatcagactaacatcagatctctctgcagaaaccctacaaggcagaagagagtggggaccaatattcaacattcttaagcaaaagaattttcaacccagaatttcatatccagccaaactaagcttcataaacaaaggataaataaaatcctttacagagaagaaaatgctgagagattttgtcactaccaggcctgccttataagagctcctgaaggaagcactaaatatggaaagaaaaaactggtaccaaccactgcaaaaacataccaaattgtaaagatcattgacactatgaagaaactgcatcaataaaggggcaaaataactagctagcatcataatgacaggatcagattcacacataacaatattaaccttaaatgtaaatatgctaaatgccccaattaaaagacacagactggcaaattggatagacaaggcccatcggtgtgctgtattcaggagacccatctcacatgcaaagacacacataggctcaaaataaagggatggaagaatatttaccaagcaaatggaaaacaaaaaacaagcaggggttgcaatcctagtttctgataaaacagactttaaaccaacaaagataaaaaaagacaaagaagggcatttcataatggtaaagggatcaatgcaacaagaagaggtaactatcctaaatatatatgcacccactacaggagcacccacattcattaagcaagttcgtagagatctacaaagagacttagactcccacacaataagagtgggagattttgtcaccccactgacaatattagacagattaatgagacagaaaattaacaaggatattcaggacttgaactcagctctagaccaagcagacctaatagacatctacagaactctccatcccaaatgaacagaatatacattcttctcagcaccacattacacttattgtaaaactgaccacataattggaagtaaaacactcctcagtaagtgtaaaagaacagaaatcatagcagtctctgaaaccacagtgcaatcaaattagaactcaggattaagaaactcactcaaaaccatacaaatatagggaaactgaacaacctgctcctgaatgactactgggtatataacgaaattaaggcagaaataaataagttctttgaaaccaatgagaacaaagacacaacataccagaatctctgggacacagctaaagcagtgtttagagagaaatttatagcactaaatcccaataggagaaagcaggaaagctaaaatagacaccctaacatcacaattaaaagaactagagaagcaagagcaaacaaattcaaaagctagcagacgacaagaaataactaagatcagagtagaactgaaggagatagagacacgaggaacacttcaatatctcagtgaatccaggagctggttttttgaaaagatcaacaaaatagatagaccgctagccagattaatgaagaaaaaatagagaagaatcaaatagacacaataagaaatgataaaggggatgtcaccactgatcccacagaaagaaactaccatcagagaatactacaaacacctctatgcaaataaactagaaaatctagaagaaatgggtaaattcctagacacatacaccctcccaagactaaactaggaagaagtcgaatccctgaatagaccaataacaagttctgaaattgaggcagtaattaatagcctaccaaccaaaaaaggcccaggaccagacggattcacagccaaattctaccagaggtacaaagaagagctgataccattctttctgaaactattccaaacaatagaaaaagatggaatattccctaactctttttatgaggccagcatcatcctgataccaaaacctggcagagacaacaaaaaaagaaaatttcaggccaatatcgctgatcaacatagatgcaaaaatcctcgataaaatgtaatccatcacataaacagaacaaatgacaaaaaccacatgattttctcaatagatgcagaaaaggcctttgacaaaattcaacacaccttcatcctaaaaactctcaataaactaggtattgatgtaaagtatctcaaaataataagtgttatttatgacaaacccacagccaatattataccgaatgggcaaaagctggaagcattctctttgaaaactggcacaagacaaggatgccatctctcaccactcctattcatcatagtattggaagttctggccagggcaatcaggcaagagaaagaaataaagtttattcaaataggaagagaggaagttaaattgtctctgtttgcagatgacatgattgtatatttagaaaatcccatcatctcagcccaaaatctccttaagctgataagcaacttcagcaaagtctcaggatacaaaatcaatgtgcaaaaatcacaagcattcctatacaccaataatagacaaacagagatccaaatcatgagtgaactcccattcacaattgctacaaagagaataaaatacctaggaatccaacttacaagcgatgtgaaggacctcttcaaggagaactacaaaccactgctcaaggaaataagagaggacacaaacaaatggaaaaacattctgtgctcatggataggaagaatcagtatcgtgaaaatggacatactgcccaacgtaatttatagattcaatgctatccccatcaagctaccattgactttcttcccagaattagaaaaaagctactttaaatttcatatggaaccaaaaaagagcccgtgtagccaagacaatcctaagcaaaaagaacaaagctggaggcatcccactacctgacttcaaactatactacaaggctacagtaaccaaaacagcatggtactggtaccaaaacagatatatagacaaatggaacagaacagaggcctcagaagtaatgccacacatctacaaccatctgatctttgcccaacctgacaaaaacaagcaatggggaaaggattccttatttaataaatggtgttgggaaaactggctagccatatgcagaaaactgaaactggaccccttccttacaccttatacaaaaattaacttaagatggattaaagacttaaacgtaagacctaaaaccataaaaaccctggaagaaaacctaggcaataccattcaggacacaggcatcggcaaagagttgatgactaacacaccaaaagcaatggcaacaaaagccagaactgacaaatgggatctaattaaactaaagagcttctgcacaccaaaagaaactatcatcagagtgtacaggaatcctacagaatgggagaaaatttttgcaatctgtccatcatacaaagggctaatatccagaatctacaaagaacttaaacaaatttacaagaaaaaaacaaaccaccccatcaaaaagtgtgtgaaggatatgaacagacacttctcaaaagaacacatttatgtgtccaacaaatatatgaaaaaaaagctcatgattactggtcattagagaaatgcaaatcaaaaccacaaggagataccatctcatgccagttagaatggtgatcattaaaaagccaggaaacaacaaatgctggagaggatgtggagaaataggaacacgtttactctgttggtgggtgtataaattagttcaaccactgtggaagacagtgtggtgattcatcaaggatctagaaccagaaataccatttgacccacaatcccattactgggcatatacccaaaggatttataaatcattctactgttaagacacatgcacaggtatgtttattgcagcactgttcacaatagcaaagacttgtaaccaacccaaatgcccatcaatgatagactggataaacaaaatgtggcacatacacaccatggaatactatgtagccattaaaaggatgagttcatgtcctttgcagggacatgcatgaagctggaaaccatcattgccagcaaagtaacacaagaaaagaaaaccaaacaccagatgttctcactcataagtgggaggtgaacaatgagaacacgtggacacagggaggagaacgtcacacaccagggcctttcagggggtggggggctaggggaggcacagcattaggagaaatacctaatgtagatgatgggttgatgggtgcagcaagccaccatggcacgtgtatacttatgtgacaaacctgcatgttctgcacatgtatcccagaactttaagtataaaaaaaaaataaatccctctaatcctctaatatatgaaaacgagtcttcggctatttttgtttgttatacatatgaggatagatttttaaggtgctcaaaaaaaagctgtgtaaatggtttacttgttgatttttcaagttatgggaagagagaataaggggtcaaacagataggaaaagtatgtgaggaagaagtgtttttggtatactaaagtgctctcgctaaagaaaaataagaaatacctcactactatactcctacctaatgtaatgcccatagtagtcatgagttaaagccaattattgtggtcctgctaatttttaaaatttactagaaaccgaacaatgattgccactgtagtgcagtgagagatatttaaagcaatggttctcaaattttagtgcatgtcagaatcatcaggagggcttgttaaaacactgaacgctaggtcccaaaccagaattttttaataaaaaactctggggataaggcccaggaatttgcatttctaacaagtttctagatgatgctgcagatcaaggaacatagttttaagaccattgttctagaggtgggaccttcttccaccgagtcatggccttttcttttctccctatatattttatggaggttataaattattgttacaatggataaacattagagataacttaaatatctatcagtaggtgaatcgttgcatgaaatatgttgcaccaaaactatgcaatgctgtgcagccaccaaaaagagtaatatctgtacatattgaatggaaagaatataagatactaaaaaaaagtaacagggaaaatgtgatacatccatacaatgtaatatgatccagctattttaaaagatgaagtactaatacatgctatcatatggatgaactttgaaaacattatgctaattgaaagaggctaatcaccaaagtccgtgttttatgtgatttcatgttttatgtgattccatttgtatgaaatgtccagaataaagaaatctatatagacgtaaagtagactattggttgcttacagctagggaaattggggggatatgagagtgaaagctaaaggtacaggatttctttttgcagtgataaaaatattctaaagttgactctggatatcattgcatatatctgtgaatatactaaaaccattgatttgtgcactttaaatgggtaaattgtatggtattcaaattgtatctcaataaagctattaaaaatgtaacaaggcaatatgtattgtataatcctttttatcagtagaaaaattatacaatatgtatacacatgaatgtgaatgcatagcaaatggtatggaaacactagggaagctgaggaataatgtcatcttttgctctgtaaaatcctataatgtttaatttttatttacaatggaaatatttttctgcataacctctgtaataaaaaaatatataacagctgacaaaacaagtgtaactgggtctcagagcccttagctctgccatgccttagctcattggtccaggctgagaaagaacagtgatgtgaaagtaacctgaaattttgtgttacttgaagataatttttcttcaactgattttttatgttgttacaatatttcctgtggtaccatagagataccactctatgttgctattaaaacccttctatgctctatttaaaagtctattaaaaattatgttttcacaaattgagatttttaaggccaagcactaacagggaacatttttgtatcaatcttaggtgtggtgttgtcaagagaacaagctagagaagtgtttaatgtgtaaatgttatcattgttttaaaattagcaataacacatactccggcttcaaaaggcattgaaagtagctgtcaggggaactgatccatggggagaaactgttgtaataagcctcactctgcaggattacccactgccaaattgtagtgagaaggacatgggtttcagccaaaactagaattctaatcgtgccccttattagctagttatgtgactttgggaatgtcatttatactctctggcccagctttttttatttgtaatctgggtaagagatttgaggattaagtgtcacaatttatggaaataaggtgcataataaatattcatttattttccttccacttgaggtaaatggagaaggtctcacagggaatagagctgatcagaagttatgggtataccacagggaactcctgagcccctgcgtcattaatggaccaggctctggctatgggatgtggttcctctcagactagggtctttcctctttctctttaagtctcacctagacagagcagaacagtgagggtaggagtcatggtgtctcccactggataagattgggcagatggatgaggccacttattttctgccaggactattgaagaaaacagaaaatagttaatgaattaaatgattatgtattaatatgtgattatataataaaaaaagaagttatgggtataccgaataaggtgtccatctggttggcttgagcaggcggttggcttgagcaggtctagcaggttactcatctccattaaatggcttcagcaaactaggctgtcaaagaaaattcctagaaagtcatttgatacctaacaggcttggattcctagaatcttgaacaagttccaggataatccatgactgagttggcagggcaaatgacttttactcaagtaagaaagattaactaaggttagcttaagtagtgattggtaaaatcaaggattatttcatttccctcactccttggctactactacatctgtggttatttctcatggaaaccttctattctttcacttctccctattattccaggttgtcagcatctttctcttactgtcctatcatatggtaattcactgaatgataactttcctagcaccttcagtttttaaaataatagctttattgagatatgattcacataccatataattcacccatttattgtgcaaatcaatggcttttagtatattcacaggattgtgcaactgtcaccacaatcaattgtagaacattataatcacctcaaaaagaagcccatatttgttagcagtcactccccagttgcccccaactcttttctcaatatggcaactgattggtttggctctgtgtccctacctaaatctcgtgtcaaattgtaatctccagtgttggaggaggggcttggtgggaggcaattggatcatgagggtggatttcccttttgctgttctcgtgatagtgagtgagttctcaagagatctagttgtttgaaagtgtgtagcacctcccccttcactctcttcctcctgttctcaccatgtcagatacgcctgtttcaccttccgccatggttgtacgttttctgaggcttccacagccatgcttcctgtatagcctgtggaatgatgagccaattaaacttcttttctttgtaaatgaccagttccaggtatttctttatagcagtgtgagaatggattaatacagcaaccatttatcttttctctgtttctgtagatctgtctattctgagcatttcatataaatggaatcatacaatatgtggtcttttgtgactagtttctattacttaccataatgttttcaatgttcatctatattgtggcatataacatgcttccttcctttctgtgttcaaataatattccattgtgtagatattttgtttatgtatccattcattgataagcatttttttcatacattttggcttttatgaataaaagctatgaatattcatgtgtaaatgtccgtgaggacatgttttcatttctttttggtatataccttagagtggaattactggatcctatggtaattctgtctaattttttgaagaactgccagtgttttccaaagtatctgcaccattttatattcacactggcagtgcatgagggttttaatttctccacattcttaacagcatttattaactgtctttttaaaattattatagccatccctgtagatgtgaagtagttttgatttgcatttctctgattgctaatcatgttgaatatcttttttttttatgcttatggccatttgtatgtgattctggaagaaaaaaaatcttattcttgttctgtgccaagtcaccaggaaagaagaaaacaaaccaaaacaaaagaaaaagaaatcctttacccatttttcagttgggttgtttatctttttattactcagtagtaagggttcatacacacatatatattatattacatatatgtgtatatatatattttacatatatatgtattctagatacagatcccttatctgatacatgatttataagcattttctccaagcaccttcagctttatggtcccttcttgttctgctaattgctttgccattctccaattctttatccattcagccatataatctttgcttctgtattatcttggcaaagttagtaggagagagggtcaaggaaaatgcctagaagggtttggatttttcactattccctaaacatatattgtgtgttcatatgccagtgcatttgtacacattacctctccctggaatgcccttacttcacttttcctgtctgataaacctcaatttatttataatgacctttctttctttttaaaaattatttatttttagtttagattcagggggatgtgtgcaaatttgttacatgggtatactgtgtgatgctgaggtttgggcttctaatgattccattgcccaagtagtgaacatagtacccaataggtagtttttcagcccttctcccatttctcccttcctccttttagaatcccagtgtttattatttccatttttgtgtccatgtgtacccaatgtttagctcctacttataagtgagaacatatagatattttagtttctgtttctgccttaatttgcttgggataatggcccccagcagtatccatgttgctgcagaggacatgatttcattgttttttatggctgtatagtattccatggtgtatatgatccatcttaaatggatggtacctcttctgttaaacttttcttgacccaagcagagttagtagcttcttctattcatacattttatctgttataaatatcacctatcagtgagctcctcaaggtctaggatctaagttgttgtttctgtatgcctatgatcagtacatgatgctgcttaataaatgtccaccttttgtattattaacatactagttatcattaaaagagatgctactttgctataaagaagctttttagtttgatgtactctcatttgtctatttgcttttgttgcttctgcttttgaggacctattaaaaaaatccttgcccagcctaatttcatgaacatttatcctgtattttcttctagtagtttcaaagttttggattttacttttaagtatttaacctatttatagttggtttttgtgtgtggtgagagactaatttcattcttccatatgtggatatccagttttcctggcaccatttattgaatagactgtcctttcctcatgtgtgttcttggcacctttattaaaaaaatcacttggctgtaaatacatggatttatttctgggttctctgttctgtcccattggcctgtgggtctgtttttatgccagaatcaggatgttttgtttactatagctttgtaggatattttgaaaccagacagtgtaatgacatcaatttttttatttttgctcatgattgctttggctcttcaggctcttttgcatttccaaatgaagagacaacctacagaatgggagaaagtacttgcaaactatgcatctgataagaagttaatatccaaaatgtataaggaactcaacagcaaaaaaaaaaataaattatccaattaaaaatgagcaaaagacctgaatagacatttcatttctcaaaataagacatacaaatggccaacagatatatggaaaattacacaacaacactaattatcagagaaatacaaatcagaaccacaatgcaaaatcatctcatctcagttagaatggttattataaaaaaggcaaaatataacaaattctggtgatgatgtggagaaaagggaactcttaaatactgttggtggaaatgtaaattagtacagcaatgataaaaaatagtatggaagttcccaaaaaactaataatggaactaccatatgatccagcaatcccattactgggtatatatccaaaggaaatcagcatgttggagagacattggcacattcatgtttattgcagtagtgttcacaatagctaagacgtggaattaaactaaatgcttgtctacaaatgaatggataaagaaaaaaattttatatctacatctatatataaatgtgatacagatagatagatacaatggaataccattaaggaataaagtagaatgaaatcctgtaatttgtggcagtatggatgaacctggaagacattatgttaagtgaaataaatcaggcaatgaaagagaaatactgcatgttctcactcatatttggaatctaaaaacgttaatctcatagaagtagggtaaaatagtggttaccagagactggggagggtaggggagaggagaggactgggaaagattggtcaatgagtacaaagctacagttaggaagaataaattttggttttctgttacacagtagggtgactatagtaaataacaatgtaatatatatttcaagaaagctacaagagaagattttgaatgttattgccacaaagccacaaagaaatgataaatattgcagatgatggatataataattaccctgatttgttcattatactatgtatacatgcattgaaacatcacattgtaccccataaatatgtacaattattatgtgtcaattataattaaaaattaaattttaataagaaataatacatataaagagcttagccctgggatagagaaagtgctcagtgtctttttaatgctattattgatgttgtttgtgaaataaattaatttggatggcagcttataaatcactttcatatatactttcctcattgatacttgaaaaaaatgctatgaggtacaaaaggcaagaattgttatctccattttatagataaggacgctgaagctcagggagattaggaggcttgcccaagttcacatagccagtaagtgataaatactgagacagatttgatgatggtgtagttttgtatttttatttctactagtcttgctctaaattgtcttaccttttaaaatacaatgtctataaatattgtgttcattaactataaatgtaaaaacatgtattagcaaaggctaaaagatagtttggaatgaatgatataataaatattttattcttgatagaaacagcagaattacacagaatgtcttcttgctggcttgcctttcttccgttcacctactgaaaagagaaaaaaaaaatcagggagaaaaatgttaactgccagttgaaaacatccctttcatccttaagacctggaggccataacgagggtatcatgcttcagctggtggcagtgtatattaattacagaatacttaggtatatggaaacaaatcatttcctgattactggcgatactcaaacctataaaggtggaaaatgcctcgttactctggctatgtgggcctctagttgatattttctcattttaagattggtgcctattggactgctctttttgtgttttcctcacttatagctatttactttctctcttcatttttagttctaaagtcaatgtaggatatcattttatagtcttatcctctagctaatagaatgttaaagaaatgggttattgtaagagcctatacagattaacacgtgttgcctttccctgggttaatttctctgaatgtttatcctgaggtaaatgcttgggttgctgataatgtcatgttgatgaagtatatccttttttctcaacattatgatcataaaataaacaactttaaaaatataatgttagtacgttgttaacataagaaacaggcataatgattaagataatttacattttataaaataagagttcaaatagtctagattcttgtggtttttatgaaaatgatacttttaatttcttttcatttcctgaatggcagctagaatatagggaaatgagtccatagtttttcttgggcatagctcttggggcactcaggttggggtacaataagttattcttattcttcgaattgactgtgcatctttaggataaaagttggaagactgtctgccgctttccctttttaggccacttcagtgtgttcttgtcctgctctctcaattgagtatttttggttatttgctagtgtcgaagtgatagagagggctatcacataccaacttgaaagtcaactatgctggaatacataatttgaatttctgattgttgctagtatacagtaatacagtttgttattaattattgatctggcattgtgcaaccttggtaaactgacttatcagttctagcagcttttttggtagattctataggttttcctatataggcaatcattttgcctataaataagcctgcctgcctgcctgcctgccttcctgccttcctgccttcctgcctgcctgcctgcctgcctgcctgccttccttccttccttccttccttccttccttccttccttccttccttcctcccttccttccttccttccttccttcttccttttcatcctttcttgccctccctttcttttctttcccctttcttcctttctttttctttcctcttttcttttttctttccagtctgatgccttttttttccttaccttattgcactggataaaacctctagaaaaatggtgaaagcaatcagtctttcaccattaagtatgatgttatctgtaggtttgaggaagttctctcgtattcttagcttgctaaaaatttattttaattttctaatttttttttgagacaaggtctcattctgtcacccagactggagtgcagttgcatgattttggctcactgcaacctcctcccaggcacaagcaatcctcctacctcaggctccagagtagctgggactatatgtgtgtgccaccacactcgactaatttaatttaagttttttttttttttttttttttttttgtagagacgatgtctcactatattgcccaggctagtctcaaacagctgggctcaagcaatcctcctgcctcaacctcccaaagtgctgggattacaggcatgagccaccacatctggcgagtttacttttttaaaaaaacaggaatggatgttggattttgacaaatgccttttttttctgtagtcattaagaaatgatcttagcatttttctttttcagtctgttagtatggtgatttatattgattaacttttgattgtgaaagcaaccttgcattggagttataaactcttcacttggtcatgatgtatttattattcttatatatcagtaaatttggcttgttaaaattttgttgaaaatttttacatctttgtgcccgatggattttgatcttggctttctgtgattgtcttgtctggttttagtattagaataatgctggccatgtagaataacttgggatatatgctctcctcctaatattctggatttgtttgtggggtattggtgttctttcttccttaaatgtttgatagatttcaccagtgaaaccatttcatcttagagttttccttggggaaacaattttaaattaaaatttaattttatagtagacatgtagctatttagtttatctgtttcttctaaaactttagtagcttgtgtctttcacagaatttgtccatttaaactgagttgtcaaatttattggcatgaagttgttcatatttccttattatccttttaatacttatagaatctctagtttatgccacttctattcatcctggcattggtaatttgtatattctctctttttctcacctaatccgtcttgttagagttttgtcagatttatggatcttctcagaggaacagcttttggtcttattgctttttctgtttttctgttttctatttcattgatttccactatgatctttattattgcaattctcctgcctaatttgggataaatttgctcttctatttctagttttttaagaaggaaacatctttcataggaggtgtttcttcttttttaatatagtcattgactgatataaatttcccctaagtagagcttcatctgcactccacaatttttgatgttatattttcatttagttcaaaatgcttacgagtttttcttttgatttctttatgggttatttagaagtatgttttagtttcaaaacatttggggattttccagagatttttctatttttgatttctaatataattaagctggggccagagaacatattaataatttgtatgacttgaatccttttaaattttttaagactagttttatggcccagaatatgatctatcttgtaaatgtttcacatatacctgaaaataatttgcatcctactgttcttcggtgaagtattctgtaaatgccaattaggtcaagttggttgatagtgttgtttcagtatccttgctaatttctgtatatttactggtttttgtcacctttaaaatcaattattgagagaatggtattgaaatctccaattataattgtaaatttgtttatttctatttgtagttctctcagtttgcttcatgtattttgaaactctgctattaaacacacagacatctaaggaatttatgttctcttggtaaactgacctttattatgaagttacctgattaatttttggtactatgctctgagatctattttgtttggtattgtagtcatgctaggtttattttaattagtgtttgctttgtatatcttttaccatccttttacttttatttttgtaaattaacatacagtaaaagtcaattttttattagtacatacttttatgagtttcaacatatatattgtttcatttaatctccagaattatgacacagaaccattccatgacctcagcatactccctcctgttaccccttggtagttatacccaccaccatccctaaaccctggaagctactgatctgttttctgtcgctttatttttgtctttttggaaatgttacataaatgacattatatgatctgtaagcttttggggctggtttcttttacttagtataatattttaagattcattcattttgttgtctatgtcaatagtttgttcctttttactgttgagcagtattccatggtatggaactttgtgaggtctcttcttcattctcctccacctggaccatcttccgaattctttccagttgctagggctctattttggccctttggcctgaaagctgggaccttattttccctgctctgccacacagttatcatggctgcacccacatcttggcccaaagacaaagagagaggaactgaattgaatattcaccacagaaagacaatcactgcttctctgaccaaggagaaaggttcctcttttacagggttttaggcatctgccacccccactgtcaccattgtcactcctcttgctaccaatgccttgaaattgccttgggatccaggccaggccgggaggggcggggcggggcgaggcgaggcgtcctctccaagctctctgagctttgagaatcttcttctctttaagaaagaagtggccgggcgcggtagctcaggcctgtaatcccagcactttgggaggcagaggcgggcggatcatggtcaggagatcaagaccatcctggctaacatggtgaaaccccgtctttactaaaactacaaattagccgggcgtggcggcatgcgcctatagtcccagctactcgggaggctgaggcaggagaagggcgtgaacctgggaggcggaggttgcagtgagccgagattgcgccactgcactccagcctgggcgacagagcgagactccatctcaaaaaaaaaaaaaaaaaaaaaaaaaaaaaaaaaaaaaagaagtagggggcttctcctggagctttttctgtctgttgacaggtgactgtttccagcttacgtgatgccctaagtccaggtcggggtagactgggaaatataagatagggggtggggtgaggtggggactcaccatcagcttggtgagagtttgcattctgattttctttcttaattcatctgctctcattaatatgtggttttcatttacttttaagctttgtgaaattgcaccaggccagcatttattctagagcaaactttcccccagtactgaggcagaatccttttgacgatggtgacagtgggggtggcagatgcttaaaaccccagccttgtaaggtttccactcatggtttgaatagaaacgacttccagccctttgtgaaccttggagagtattccttgtgctcttttttggcggttctttctgcagacaaagatgtttatcattactcgctggaatccttgagggtgactgtttttcgagctctggaatcctctctgtgtgctgatctctcttcttatattctgtcctatctgccttgatgtccccagactctcagctctaggagaatactaggttttgcctgggttcccactccctgcacctctgtctgaaatccataggcagtaaatttagacagtcatagggctcacccaatttgtttcttatctttcacagatccctttccttcaatgtttttaaactttttttccatatatttttgtttgattttaaagagtttcaggacgtaatgtaaatcgaatctctcttactggaaacataaatttataggatataattgaataagtaatggtgaaatccaaactaaaaatgcctaattattttagagatgattgtgtgagagatagctttacaaaggaggtggaatttgggcaggtgtggtgactcacacctgtaatcccagcattttgggaggctgagacaggtggcggttggggggcatccttgaggccagcctgggtaacatgatgaaaccccttctctacaaaacaacaacaacaaaggaggtctaatttaagctagtctttgaaggaggaaggatattccaggtgaaaaaaaatttttatcaccaatgtgatcgtttggagaacaacctgataagacgggtcagagtatatagggaactaataaaaaataaggttgggatcagatcaaagaagtctctgcaaaccagaagttgtgctatattgcagtgatggaaagtctttacgtttttaaagtctaagcagtgttatataataatgagcacagagtttaaaattaatataaacatttatgtccagcctatatatttgttttaacttaagtgcatctgttcctttttctgtcctttgaataaaatgaagagcagcctcataaaaacatggctggtattgtttttatctaatacattacatttacataacactggagtaaggccatttcttaactttctttagttccttaatctttgttcatagaacatattttccattataattttaactactcttttcaggatgtgtttcgttttttctctacttaaaatgacaatgatcaaaactagatataatatgctagtaagtttgttctaatgtagaatttagttgaattatttgtttatcaaattccttttaaatacctgacagtatcaatgtagctttttttcacaatagcattatatttcacttgaaagctattgacatccaagtaatttttatacaaattattcatagcttgtctggtttccatgttataatcctgtaatatcaagtcatattctattctgttttaatatgatcattttaaaatttatcaaactcattagatgtttcagactttctttgtttcctggtattagatatgtacctctctctatttaatagaggttgaagttttgatacattgggtaagtttaatacagtgaagagaaaaaacatgtttaaaaacattaaacattaaacattaaaacattaaacattaaaaatagcattaaaatgctattttccagcatcaaaatagcattaaatgacgctatttttccaggatatggagaagaaaataaaggaagatatggggagatttatagaagaagaaagggaaatattaaagaaattgaggacagacaaacccctcttaaatcaaacccaaggcacagagacagaaaagtagagaactaagataagtgttgagatagagagactggaaagatgatgagtttaaatcaacagaagcagttttaaggacattctgaaaaactaattagaaactgaacaatttgcctaaagcagagctgcataggtatatggtatactagcatatggaaacagacaaaaatgttcatgtaaatctttcaagaagagtgagtacaagtttggtgaaagaaaatgattttacagtaaaaggacttatttcgagtgtgcaggaatctttgaaaggcttcttaaataggggaaaagatttatgagtgaaagcaaaaagtagatatatagaaggcagatgagaattttggaagataatgaacctctctctttttcttttaatgtatgcatacttcactagaagattagagaataaaaggtgtttagagaaatgactgccttcttgtacacaacaatgtgtatagtcagaaggagcttctctttagacagaactgggatatctggaaaataatatacaaacaagatgtttagaatttgtttgaaaacaatctgaattgacagatatcatttggataaagatagacataacgtagaataaaattcactaatatggaattggatagtggggtcattcatttatgcatataaaaataaaggttatgaaatgtttagaaagggacactgtatgttgtgaaaataaatgtaaaaccttacaaaagcagataacttgccaaaggtagatacattaagcgtggaataaaagacactccgaatttgttaaaaatgctctaggtgccttaacttcttttcttttgggacaccagattatactgagaaaggttaaaggattttttaaaaatgatagtgtaaagggacacaaaatgataaaatctgtgaaaagaataaaagctcccggtgtcttagctgagcaaagctgtccagatcttgagcattgattacatacctccacaagcagtttgaatggaatatggacaaaacaagaaattacacagctgacgatacatgatgcacaagctactcctcttttcagagggaaaaaaaagtaatatgtagtaggaatggaacatactgacattattcaattccaattgtaaaatatttgcaggaatattttaaaggcaggaggctagcaaataagccaagaaggttttgtttgtttgtttgtttttgttctttagtggaagaaaataatggatcagatacaatcattgcttttgaataaataatccagaatttctttataaagatattgtctacgtatgctttagagaagaagaataaaaaactatttgataaataaacataaagggggcatacagtacctagactcatctcattagtatcttgacatctcttttttatgccaatgcccaaggtatgttacttttcccaagaaaaatcaaatcctttaacttgccattagctattcaaaactttaaaaataaatatccttcgaaccaacaactccagtcctgagaatatctcccacagatatacttagacagctaagtgtatgtacaaggaagttaattgcggcattgcttataactgcagaatttgagggaaaacctgagtgttcaactaagcgggaatggataaataacttatgacatgcccctactgtagattactgtgcatgcactaaaagaatgaaataaatcctgtgcactgagatagaagactatctgtgttatctgctcaagtgaattttaaaatgcacaacagtatgtatagtaacccactttaaagaggcctttatatattttaatacaagcataatgtagattatgatatatagagaatgaggtcttgaagtatgcttactaaactgttaacagtggttacttctagtaagtgaaagaggtagcctttaagtttttaacttatatccttctgtattttgacttcaaaaaacatacaagcacatatttaattttttaaacctgaaatttatatgagggataaaacaaacacaagtttgggagccaacgttttctccccaactcctggttcactaccttttctcttaccttaacctttaccactaccacaaactaccacaaacgaacacaaacgaacactttaagcacaactcattttattattgggagaggtttcacaaataagttcctggtttccagttaacttgttgcaaagtttacatcctacccaatgtgactacatggctttaaagttaccagtggtagcttctgagtaaaattttgtttgtttgttcatgcgttaatggaacatatattaagtaccaacagtatgccaaacactggggaattcaaagatgctagtctctcaactgtttcagctgatgcttgactatcctctcccacaccctagtgtcctcattcactgcttcccaatactctacatttgaaaggtgattcccacaaatttattgcaatttagaccccatatatcaatgccgagatcgcgccactgcactccagcctgggcgacagagcgagactctgtctcaaaaaaacaaaacaaaaaaagagctgaagtgactcttctcatgccttcagcatgagaatattcccttaaaattggcatctctttttataagatgagctattattattttacttctacttttctaaataacagagacagcagacgaattagtaatggaaaataaaaatagtggcataggatatataatgtttgggtttacaaagaaaaaggggcatttgtgaaagatttgatatttgttaacataaacatgtcaatcattgttggaaaaagaaaaatatgatatataatcttgttttaaagtgtatgtataatgtataaatatttttggaataaaaatattcatctctttccctagagggagagtggctggatcagatcatctctttgaagttccagttctgtaattcaagcattttctttaaaaagctttaaaattaaaatgagaagcttaactagggtttatactacacatatgtgtaggatcaatatttttaaaactgcattcttaatatgttatgccttttgctctttaaatctgtgaaacaaaacatagttttatttgaagtcattaaaatatgaaggggacagagtaatcaatgctgttggttcttactgtattatattattagaaagcaatttgtgtattttgtgtatctgtcttcctggttttttataatgaaacatttctatctttgaaactacagactcaatcttgccaaaatgttcattttttgtatcattgttaaattgcatattgttcccttttggtgtactttagtagcctgttacaatctttttaaattcgttattcttaatcgacaaataaacattatatataatttgtcatgtaaaacatgatattttaatcacatcatggtaaatggggtatccatcccctaaagcatacatctctgtacccacaaaaattaaaaataaaagataaaaattgaaaaacatgatgttttgaaatatgtgtatgttgtagattcaacctgttataatcttaaaagtgattgtcattcttccaacttatatcaatagaacaactgtctatttgtcgttagttgagaccatcagggtgtagtgaaaaagctaatcaacaaggattcttctcaccagagctctgtcactcctctgaattgtggctgctagcctgttaattctccactaaacctttaggcatttggagacaattaagtctcatgttggggtttcctgggcttttttttgttttttttcaaacaaagataattaagtctcaaacttgaaacttgaaagatatttggccaggcagcagcaatgtactgagtataggcttctcaaagagatgaagtaatacaattagtagaaagaactatcgtgtacttaatacagttgctctctacttttctttctcaacctcccccaaaacaaaacaaaaccaagatgcttcagtcaagcactataaaaggactattaaattatcgcgaaaaggaatgttaagacagtctaatactctcattctgcagatgggaaagtagaagtgcacattgtaattatttttcaaaataaggtaaaagctgataattgtgtaaataagcaaaagtatatactttttccttaatcgtttttaacctaaattagtcttaattttgtgttattcctacagtgaaagaaaacatgcattgtcacatatcaggaaagttgtgcagttattttttcttctcccgaatattctgttggctttatgttccacatatgttgcaccacattaatattcaaacaattttagcacacgaagatttgtaacctcattttaccttgattagtgactcaactcatgttcttgttgtagggctttgaccagcttcgacttgaaggattgctttgtgatgtgaccctgatgccaggtgacacagatgatgctttccctgtgcatagagtcatgatggcatctgctagtgattacttcaaggctatgttcacaggtagtttgccttttaaaactctgaaaccacattaaaacaatatgaaaaatccgtgtttaaatcttttttatttctaacatgaaatttggttcttttggaaacagcttcaaaagaagtacacaacagtatgtatggttttcggtggtgctgttttaacatggaaaattgatgcacttttttcatactgtccatctttatctcacagcttttctttttcaagcttatatctagtgggccatcagagactctgtgtcctcctagtacaatctctactctatgtcaaaaaataggaagtgagaacattttggaagcacttgcatcatatatgacctccattagtatagagattatcttttttaagtactttcttttaacagtaaaatgtgcagcagactgactctaatatgactgcttatataagataagactttcctttgattttattgcatctaattagcagcagaagtgagtttgaccataattatccaccttcatttaattgaatgtctttttatttaaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtaagatattttgaaatctgatttttcctgtggtagactctgatgtagcctgtttaggactcatgaaatctgctgtgcaggaatgtgaaacttgccattagacagatgtgtcttgttgtatgtggtctgtaagcaaggtgagattgaaacaggtgcatttttatgaaatagaatcatttaataaaagcctctgtgttggccgggcatcgtggctcacgcctgtaatcccagcactttgggaggccgaggcgggcagatcgtctaaggttgggagttcaagaccagcctgaccaacatggagaaagcccgtctctactaaaaatacaaaaattagctgtgcatggtggtgcatgcctgtaattccagctacttgggaggctgaggcaggagaatcgcttgaacctgggaggtggaggttgtggcgaactgagatcacgccattgcactccagcctgggcaacaagagtgagactccatctcaggaagaaaaaaaaagcctctgtgtaatcaaatgacatgagatactaataatgtttgatgaagatatatactttaactgtttgataatggtatgtaccataatctggttttattcaccttaatgactatacaagcaggcttcttaaatgtaattgaatggaaaagtaatctgagcttctagaactctttaaaatttcttcttttaataagggagctagatcttaagaagaactaatacctatgggcaaacctgtaagaatgtaagtcttgattccatagaaacatatcacctactgaatagtgtttagccattttttaatagataagataggacacatacaactaccaatcgatggagtacttaatgatagtcacccagttcctgaagagagtgttttattttagttgagacctttaaattttacttctggggagataaatggctacattggacagaaatattgccaagacttccagaggtcttggagcttgtttttctgattaagaattctggcaatattaatttttggtatattttctaactcattatgttgatggatatgttttctataattttttaactcatatgaatcttaatataggtaaataattgctgttagatctttacaacttacattttttgaacatggaaccttctttaaaacactaagtttcaagagagccatgtccttaattattttattattaaggtacttaactatcttaaaagtcagccaataactaatttaactggcctattgaaagtgtgttttttgtatgtttgattttagaaaactcagactgctgtctcacaattacttataaaatttgaactaattgctacttttaagggtttttatggcagcatggtgctatattgttgacttgtattgtcttctttattgcgaaagtagcccaagtgaagttggttaattcccatgctattgcttgcctccattactgaatttaggtgctaaattttatttaaatttgatcatgcaaggcccattccctcaagagctattaggatctcacctctggttgtgtcactggcatgatataacaacttcatttcaaggaaaaatgaatcatattgaatgtgattttcaaaatgcctcaagtccagaatttaatttagtagtaacacttaaagcttgtacttatagactcttaacattgctttacactgatcttagcaacacatggtcatcctgagccaaattaaggaaagtgccatgatttctttggaactaatcattaacaagagacattgttggcctatcctctaatgcagaagtttagtacttagaacttcaggtattgattgtgatcaattcctttacctgaaagaaaatgaccaaactggataatacacaatacaaaaaagttatagtaatattactgtcacaataatagaaaagaattttgttctagataactgtatttaaagcaattttatttaaagatgagaccatagtcactttgtattgctaatttccagtaattagactgttggttccttaacctgtgttgaaacatttattataattgtttaacaatttagaaatgtcttcatttttataaacacttaatattgccttaaatatcatgttcattttttttttttgcatcctttgcagacatcctaaaacctatttctaatggagaagaggcttctctgtagcaaagattacttgtgatagagtttactcctacctctcagttttagaattttcttgcctatgaacttttaggaattacctcttttctttgcattattctaccttacttgtccttcatccttttttgcagaggatatgtctgtatggttttagagtagaaatctcttccctctcagaatccattgtaatttttgagaaaatctggcagatgattagttccaggaacatgcaaaacccaagttttcctttacccttctttcatgcattctgtttttttagttaaacctatgttcagtcttgctctatttatttcccctttccttctcagcaatcaagtgaaaaaggaaaaatagtagcccagtgtattttctacttataaaaactgaacatctcaagatactatattttttaaaggaggattttttgaagttcttccatgagctaagttattatagataaattttaatataatgttctcatgtttaagaacggtgtgctgaaataagatgttttagaggaaataggctttatgtttttaatgatatagtgatattatagttcacataatcaaaacactatttgggtttgaacttttagacagaaaaattcccttctaatacaattctgttctatcctattctcaatcatttgtgtggaggaagaagaacagtggtacgtaaagtgtgaatcagtaacagtggtatgtaaaatgcgaatcagtaaagaacctagaaaacatgtatgtattagttttaaatgataactctagatacattagtaaagccacactcacctttggtgggatagagataccagttttctataacagagcatcagtgttaatggaacaagagccaacctcccttctaactttgccatcatttgcagtgttacttagtggtttataggatgtggcatttttgtttttgctatgttattttcttggagttatggaaaagaggacaatgaaatgaatacagaaggatgacaatgaaggatagatatgaagcatggtaggtaaaaatttctgtaaaactaaaaccacttttatatactatgaagataatggaaaattgcctttgtttagtcatacctaaaaattacattggttttgtccttatgacattgtataactacaacatgttaaatactgtgcccattagctagtgtttttttttttgtttgtttgttttgttttttgaggcggagtgtcgctgttgttgcccaggctggagtgcaatggcaggatcttggctcatcgcaacctccgcctcccaggttcaagcgattatcctgcctcagcctcccgagtagctgggattacaggcatgcaccactgtgcctggctaattttgtatttttagtagagacgagctttctccatgttggtcaggctggtctcaaactcctgacctcaggtgatccacccgcctcagcctcccaaagcactgggattacaggcgtgagccaccgcgcccagccccatttgctagtttataagaaagttgtgtaagttttgtttatcctttgtttgcaatttgaaatttttagcatctagcatttgccccacggaacttttgttatggaggattttaggctagttcacaaaacaacctaatttaatgttaggttgctgaaatagggcatctgtaattgaactcaaaagattacaatttaaatatacaaatatatagaatgaacaaaacagaataaaggtgagaaagaaatcactttatgtttgtataaaagcattttttaacaagagaatgagatatgtcattgggctttagacttggggataatctttcttaaaataattttttaattgtgttttccccccttgatgcaggtagattactggtttcacctgcacatttgttatcagtgatggggtggagagcttacaatgaagtagagagaaagtttattgaggtgactggaggtgatgaagagttggagacaaaataaaggaggtacataagtgggaaggagacaagagagaggaatagggagaatatgtttctctcaaaagaaaaacaaaaagaatcagaagtcattggagaagacagttccttttgctttgcctctgttactaaattactgaggatttcctgcatagtacatatatttcacatttttcatttaatctaaattgtatttacccgtaaagattaacagacatgttttttaagatttttttttcacttttgagggcaatttaatgcaagttagagacaaattgtatagataattaaaattaaaaatgaatcaaaattatttccctccccaccaaaccagtcttgacttccttattgacagggctgatattgggcaaatagtacatagaaggccatccccgttgcttatggtcggccatccattctgattggttgatacccatcttttgtggtttttaaatattctaaatatccctcctataaccttgagcacccattcttgcctatctgctatctgggactctgtctgggaagaagaggcctagcctgggctcaaacctcttcaacctcacaaaagccattgtaataactaacattgcattcaataaaggaactgcattcaaagtgcaaataaatagagaattgaatattttgggctggagacaccagtggcattcacctcaaatagcatttagaaactgaagaaagacaaagactgaaagagagagaggtgtttattattcaattatccctttgttcttaccaaagtgtctcttctttgtgtcctgtgatggtctcatctgtggaaggaggcttgagaaaagatacctgtacattctctgcctgctgaagtaccttgttggatttcttcctagtcttattctgtggacatggtttcattctctgcattgattgtactagatatcaggctgtcattttaataaactagatagcaccaagtagaatttggcgcattgaatggctaaggagttccccaaatttttgccagatttcttagtctttgcatttcccttgagagtacaaaagcagatactggctggtccgagtgcagtggtgtttacaactaattgatcacaaccagttacagatttctttgttccttcttcactttgactgcttcactcggctagccagaaaaaaaaaaaaaaaagcagatacccatttttttctaaatgggaatttctttgtataaaacaccaatcttttaaaaaaagtcctagatttcagatgaaatcttccattaaaatagcaaattatgttaatgacagtgttttgggtacatcagttataatttgaatagtacagcagcagtgaggaccagtatgttattgagaataccacttgcaatattatgatgttggaagtgcctttaggatgactatgactgttgtttggttataaaagaataatttataataatttatatcaaagaaatgtaaatgagcagttgattattttaagaacaattttataggttcccacaggtgcttgaagagttttatccttttttgttgttcttttttttttttttcttttttttgatggagtcttgctctgtcaccaggctggagtgcagtggtgcggtcttggctcacagcaacctccgcctcccgggttcaagtgattctcctgcctcagcctcccaggtagctgggaatacaggcgtgtgccaccacgtccggctaatttttgtatttttagtagagatgggtttcaccatgtgggccaagatggtctcgatctcctgacctcatgatccacccaccaaggcctctcaaagtgctgggattacaggcgtgagccaccgcccccggccttgttgttctttttaaatgccaatgtagttatttggattaacttctgttataactctgtttttaagtgaaccttctttggaattgtggccaggttttcagatgaaataaaagatgaactcagatgaaatttctacttagaaatttttaaaataagctttaaacttcatattttatattttcaatgtgtattctattatatatgtaaattgcattataagtccaattatccatttatggatatccaattatccatttatccttttatgtatccagtggataaacaaacacatgtatccatttaaaaatactgtctaggcttaatgtttggagatttctagctgagtcacttttaagaatcatgatggagaagtggattaaaatgaaccataatagaatattatgtatttctctgggccattgtttactataattccatcagttttggtctatttatattgttaattattactgtagactttgcttctttaatttctatattctatgattaatttttaagctttgattacatatacttgctaagaattaatttcctattacatatttttcttgtctgtgtctcattttgaaattaataaggttttagtaatttgctacattaattcaacaggtatcctatttttaattgcatctatcatcgtatctttactttttatatttttgatacttgtagtatttagcctttgttgtatactcacagtatagtagctgttgtatatgagctatagaaaatacttagtcttgggtaccccataaatatatataccaactatgtgcctacaaaaattaaaaactgaaagaaataaaaaaagaaaatacttagttcttctgtcaagaagataacagttcggaaggttatggaatacctttctctggtgattttaaagaaaaaagtaggcagctatttgtattggttagatggtctgtcaaagtcttttctagtcttgtgtgtctgtatatatgaacgtattgatatacagaaggtattttccaaatgcctgtaaataaaatttaagtttctttctcatgttattctagcaatcgttttctcactggataaatttgaagagggaaaaggtgaaggaattaaataccttgatcccatttctgaattatacagtttggcttttaatctttaatcttgctctgttttacatgctataaatttagatttcagtttggtgactggcaactggtagtatcattttgtcttcttaaagtacccattctttgttgttttttagtaatcatatcaataatgatgagaatttgcatacttgggaattatatttgtgttgtcatcaacttttgcttaactgtactaataaacatcttcaaaagtataaatcaccttcactctggggacgagataattcttacttgtcttgggaagtgaattcatgacctcaaattccttccactcagggtgaattgggaaaacaggtattgactgtaactccatttacaaaacttaaatttttgaaccaccgacctgcagctcctcaaattggattaaatggactttttattaaccacgttagaaatccagggtatttatacagtgttatgctgtctatttctagagactcataatttgttaacttatttttctatttttttatgttacagttatgtgttaggtattttaaaaatatgtagctactaagtaaaataagcaattaaacatttttgtaaagcaaatcagctacttaaaagagcacaaattctttttgagtaataaatcaatgatagactggataaagaaaatgtggcacatgtacaccatggaatactatgcagccataaaaaaggatgagttcatatcctttgtagggacatgaatgaagctggaaaccatcattctcagcaaactaacacaggaacagaaaaccaaacaccacatgttctcactcataagtgggagttgaacaatgagaactcatgggcacagggaggggaacatcacacaccagagcctgttggaggctgggaggctagaggagggatagcattaggagaaatacctaatgtagatgacgggttgataggtgcagcaaaccaccatggtacgtgtaatacctatgtaacaaacctgcacgttctgcatgtatatcccataagttaaagtctaattaaaataatctatgaaaataacaatgtgtgtgtgttaaccttagagatttcagtgatattatatcctaactgggctgtcattttatgcggaggagtaatgtttttagctttgtttcagtttttaaagaaatgtcaacaggaggattattttattttctcttaaccatctgccaaatctgttaactatacaggtgtgaggttaacaatacattgataaagtttgtgtgatattgaggacacataacctgacaaaattttaaaaacaaccaaacatttaagtcttttgcctgtgatctgtgtctgtttgtatacatacacactggcattttttattgtaggcttgtttttgtggtttgttctttgtattatatttgctaatattatttttcctatttttcctttgatgagtcagttattagagcattgaaaagaggttctactgaggaaaggcctctctgtcacttctcttctttgtcagcttttcactttatggtatattttgctctatggtggggagatggttctgggctcatgttgacgccagagagaaacagaatgtgctgaaagtaagagtggctaaggaaagctgtgttgcccagatggaagcagtcatcacagataccaaaatctcatttacatgagagatttgttgtagatatacccctctgcccttaagaaagacatttccttgcttatatttccagataaataatgttgaaaattaatttgccctagggataattatcttattaaattattttcattatgagtgataactttgaaggaaccaaaatgaatgatagtaatgagtgatgcctatttacgtgaaagggaaatctagggtttgggtattagagcttttctgttcatggatctgctagctgtgtggtatttttaagaataatgactaagaagtggattgagatgaatcataatagaacaaccttctattttcccaagtttccatctggcaggaattttatcagtattttgggggtgggggtgggatacatttttgaggagagaagagtaactggtttggccatattccagttataacattgtttcttagagtagcttctaacttactgactttgatcattttcttttagtcagccttctagtggattaagtaaaggtggtttgcaaattatctgtttgtagatcattgatacatttagataagaatcctatttgtatctatttgaacattaaaagcataatttactcttattctagaacaggtatttgtgctatcaagatgtgattgccatgaaagtagtcatgttttaattttttttaattggcttaataggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcgtaagtgcatttatattaagcatagagacaaatttcttcactcagaaattcttatcaaatcataaaataagcagtcctgtaaaatcagataaaaatgtagttagggttttattttaaaactatttttctgagaaaatattgaagaccatctttatgccttatctgggcatatatcgttggcaagggaacaaattgtacgttacaaatacatcagtatattgtagcatatttcacctgtgcagtatatatggtcttcatcttgaaggttcatctaaagagtatacttagctcatttaaattataataaggtcttggatagaagtttggcatgttttctcattttctgcttttaaaaggccatatgatattttactgaacaggttacaatccttcattacagaaaactttcattgtttcttcttttacaaaatatgttacctattagtggccacaaagataattttctttatagattaaatgtacaaagttcaacattatccaaagtttgttcactgtgaatattatgatctatgactgttttaaaaataattctgttgacgtaatatcagatagttttcttttccataagcccatctggtaagctttatttgatggtcacctttttgtcttcccagtataaaattggtcataaatgtactttgatgtagaatactttggctatgtaaattaacccaaaaaggtaaaattttattatttcagataaaattgggatagtataatttttccaaaaataaaggcaggaagtccacattttatgttgtgacatatatttgtcattaccattattgtttggccttgttttcaattattttattctctattataaatagagtctgtcacagggaggggaacatcacacaccagggcctgtctggggttggggggctaggggagggatagcattaggagaaatacctaatgtaggtgacaggttgatgggtgcagcaaaccaccatggcacgtgtatacttatgtaacaaaacagcacgttctgcacatgtaccccagaacttaaagtataataatataaataaataagtaaataaataaaaaatacaaaaaagacagaaagacagaaaggaagaaagaaagaaagaaagccagatgtggctcatgcctgtagtcctagctgttagggaggctgaagcaggattgcttgaacacaataaataaataaataaataaataaataaataaataaataaataaataatgtccttgtagttgaccaattccaggctccatagagctgggaaagttcaaaatattggcattggctctggataagttcagagtaattctcagaatctttatttttcaatattctaagaaataaaagatagtttaatgtatttgagactaagctatttatcagagaatagaataactgttctcagcttttatactttcctgtttataaaaccctttcttgttagtgacatggtctttttcctgatcttttctacccaaagtttttttttctttgttgttacaatgatatttttttctaagaccagattttctagattgttggactatgtcgcatgatcatgaactgcataggttttccaatatattttaataattggacttttaaaagcagttaaggcataagtgtccttagtgtacaattgttctttaggcctcctcagtcaacctacacacattattttcatgttattatactattttaaatttgcggtatctggaaatatctagaaggtgcaagtagtgacttggttgtttcttagaaaatccctgtataagataatgttttcttaaatattttcttcacaaataacaggtcattaacttggtcagtcttcttttctcaaaggaagtagctccgtttttcaaagtcagtccttgcttgttgatattatcacccctgttaatatgcggctacttagctttcaatatatagttcctaatactaattaaaagccatattcttctgggagtttttaatcttcaggccaaggagagtcattacataaaaccaagatgctagaggcttctttctttgaacctatcccaactctctttcagctgctcctatggtatacccatctaggaactagaaatagaccacactgttgggcaagtggctcatacacaggaatccttgctcctgaccttcagaaaccacccctccatctctgattaaaaacagtcttctgtgtttcattttgaaagggaaaagaaacaaggaaatcatgcttttcttagggtattcctaaattcatatttaggctttaacaataaaatttctaaagcttaacctaaggataatgacttaaaaaaatttcccctctaatggtaaatataggtccattttaatcttatttcataaactgcatttaaaaaaaggcacatgtcattataatacaggcacaaaccatctattccaagaattctaattctagttatcatccaattatttgatattttattccatttgaaatgatctatagattacaaatctataatgacctcatagatttgtaacctataagtagctaaacttttgtagaaaatgattgcgtcccttaaaatcagcatacccatcaaacgcattctgtactaaacattttattatataatatattggaagtttaaaaaatattttgtgattgacttagtaagtgcattcaaatttagagtcttgatttcaggagaaaaaaggccaaaaagagtcattagataaagccaagaagcaagaggtttcatttgtttctgatccactccaccccctttgagttctttctatgttatactcaaatagaagcaagaagtagattgtcttgtcacgtcacatcctgtattacggaggtaaccaaacttgatgaaacctgccttgattactattgctcccaaagaataatattaatgaaatttcctgaattctatccatgatcgtgtttctctttatataaataaaaaatgaatttgtgttagttggcatttccagttttcttggacccattgtttttgcagaatagcagattttgattctaaagaaactcttgcctatatttctgaatgttcctgccagaaactgaggttttaacatttcccctaccctacaagcgctttttaaaaatagaattcctccttcaacgcacacattaacatctgttataataaattaacattcccattgtaactgattaagttgagacattcatatgcctatgtaaatagaaggaggtgatgggaatgggtggcaggaagaggggattgatgggaaagtcatttaacaatttaataggttgattagtaccagtatatcacttcatacacacagtaactattgcctgtatataattataaaaagaaaaatttgatgggtacaaaaatagttagaatgaattaataaggcctagtatttgatagcacagcagggtgactatagtcaataataatttaattgtatgttttacaataagtatgagtatatataattggattattcgtaacacagaggataaatgcctgaaaggatggatactccatcttctatgatgtgattattatacattgcatacctgcatcaaaacatctcatgtaccccataaaaatatacacgtactatgtacccacaaaaattaaaaattaaaaaaaaaacagtggcaacatttgcaagacagtttagatcactttaatgcattaggccttttaaaatctttccatggggtacttggaccaaaggaaacctaagcccattgttcatcaaaaaaagactgtgtgtgtgtgtgtgtgtgtgtgtgtgtgcacgcactagcacacgtgctcacctggtttagtgctgaaatataattccttcaaaatgctgctttcctttgacactggttacaatgggaaactaggggaggcttagagtagctgtcacttaagtgtaaaaggagtcagttatttctggcatctttcaaaattgtgtcatataagaaatcaatcttctattgaggcttcctatattgaagaagattatgacagctccaatatctttcacttcagttaaatattaataagttaaggtttcaaataatgaaataacttatagaaaacatgttagatgtttttcaaatacatgcacaataaaactactaaaatttattaaatgcctctataccccccaaaggatttgggggtttcttgatcactcaccagcgttctatgtttctagagtccatctcccctgtatgacagccatcactgtttaaatgattttctttaggctgatctctttcctaatcttaaagaacaaataaattccacatcctcttctgggaccgattctggattcctatggaattatctcagaaaataagaactcctgatatatgtgagataaccaacctaagtataattcttaaattggagagattctttaatgtaaacactaggccaccaaactactgaagttaattctctagattaggggccagcaaacttttgtaaagggccagaaagagtctatttccagctttgtgggccattaaatctctgtcacaagtaatcaactctgctgttgtagtgtaaaagcaaccctacataatccataaacaaatgagtgaggctgtgctccaataaagctttatttgtgaacatgaaatttgaattttatagaattttcataagttacaaaatagtcttgattctttttcaatgtgtaaaaaatgtaaaatcattcatatttttatcttttgggccctacaaaacaggaagtagactggatttggcctatggactgaggtttgctgccacctgctctagatttttccagttgcctctttaccatttccaactcttatagactacgattgaagcactgctttgtggctccaactctttgccttgcatcatcccttactccctcttcccatcagagttgttggtactaacctatatctgagtgtcgtgtaaatatggaaaatggaaataagagcatgtgtatctactttttaattagatgtattttattttaaaataaaatactattgattttactgataacaatagcaactctgcatggagaattgcatgacaataaaagttgacaataaaaattaaatgcctggaacagctaaaggagatgcatttttagctggaaaaaagcttaagaatgatggactattatatagtaattttgttattggtggttaatagctatcttgaactgagggcctcctgtgtgagaaagtacaaatggattcttataaccactattaggggaaaatgcaattaagtcactgacagaggaattatctttctacataggaaaatattaataataataaaaagtgaataagtattcaaattctaactccactataaaaagaataagaagaaactaatggaaatcacattggaacagtttgaattaaacataagaaaggacagttacaatccaaaaatttcaaagtttaagtcagagtcccgcattaagaaaagtgtaaaactatagtgaatcctgtctttggcttcaagcagatgaagatgatatctggaagtctttttagaccccgtttctgataggatgtgtggtttaattacttctaaaagcttcccattaatggctttgctaatgccaagtaccaatcaatgcactaggttttctcttatgtggcgagagagagagaaggagagagagagagagagaataataatgtaggattttgcttgtccgttaggtaaaagtcatgccaaaggcaaatagaaatgaacatttgaaaaggcatccagtgactggaaatagtaaaaaaaaacaacagtactggggcatgtggcagtttaacttgttattaattttagaaatagggtttaaaagaaatagaattggcaaggatccaggcctaaagcaatgaacaaagccaacaaagcagtaggtaaaaatgagaatagtaaaagcctttgaaataagactgaaaattcaaagctaaagtaagtggaaaaggaagtcagtagagagatacaagaagtggcatgatataggtgtgcttggaggagaaaagcatactttgcgtagtgaatttgatgatgaaatgaaattattgaatagagcggaaaagtagtctctctctctctctctctctctctcgctctcctctctctctctctctgtgtgtgtgtgtgtgtgtgtgttttgcctgtcaccatgttatttttttttaagtagagaatctcattcaaaggttgattcatcaggattgcatttggttgcaagtagctaaacctaattccagtggcttgatcaaattgtcctactcaataaacttctgcttacccgtcgctgcccagaactatatcatatggtggaccaaagcttcaagggaacctgctaaattaaatttcgtttttagcttggtgtagtgcttccctaagcagtgttgtggttctgttagtttaaaaaagtagggttgggggacgcaagaaattggattagcagttggcagtgtctgcaataaataatatgaacttttcaagtcaatctagacctcatgcttttgatgagttctcttaacagcttctctgccttttaaaaagtgattacattttccatctttcttggtgacattgttctgttcttgaggttataacagactgattgaaagatacttaagtgagttgaggtcacttctccaaaatacattatgttaaaagatgataaatacattactgacaggaagtattcttaataaagatcttcatattatgccgccaaccatcttcaggttaagagtagtactggctgcaatgatggtgggtatatacgaactattagctttaaagtataaatgtagagaaattattatcagtgtccattttgtagtctgtatatgaattaaagcagtgggcttcagaacataaaccaagaagtgtgtatattttcattctcaatgtaaaagtttgcttcttatgtattaacgtttgtttctatcaacatggggacccagaattgaggagtttttcatttcttttgatttttttcatcctttcttcctatgtttttagagcaaagaaaatggagaaatgtcaaattataaatatgtaagcagattacagaataaatcttagtgatttctgcaatgacagaaatttgttagattcttacactatctagtctaatgtaacatgtactaatggtttatattattaatatagtctcaataattactgtaagagctcccccaaagtcttacacatatctatcatagctataatagatatgtttcaagtgtttggatattattactgttccacttaagagaaaaataattaattgctaaatttgaagttaaaaataattttcttttctttttttttttaacagccacagtagaatgttacaatccaagaacaaatgaatggacctatgttgccaaaatgagtgagccccactatggccatgctggaactgtgtatggaggagtgatgtatatttcaggtaaacaagtatcatgtgaacacaatataatatataagcttttaactatatggttatctttccatatagtggtagtaataataataataattcaggcgtcaggagtttgagaccaggcgggccaacatggtgaaatcctgtctctattaaaaatacaaaaattaactgggtgtggtggtgcacgtctgtaatcccagctacttgggaggctgaggcaggagaatctcttgaacccagaagacggaggttgcagtgagccgagattgcgccactgtactccagcctgtgtgaaagagcgagactccatctcaaaaaaaaaaaaaatccagaaaaacggagaatcaaaatataatttatgttgattttagaaactatttttgtgtgtatttgcatatgaatgtcttgggcattctgtaaatttataagagtactagtaaaccaatcctgttgtaaggtataacttagaaaaaattggaaagcattcaaattttgctttccagtccccatgctctgtattctgataaacaccattcatagtttctgtagcaacaattaattcattttatttaagatttagctaaactatgtgaaggagtgtatcattatataacatataagttctcctatgcataaaacgtgcttccaatatgcataatagtacataataatgttcattctctctttcagtatagtccataatatgggtttccttcttccttagcattatagggggattctactatggtgtcattgcataaatatttctgtgctgattatctgtattttatgcacatgaagatatatttttctgttaaaaaattctgaaatggctatagtttgttcacagtgtcccagtagcaactttcattctcaaattgttggtgtttaaatcaatctactgtagaatttctttctttttttaatgcattttctgctttcattctcctgtagaatttaggaagaagtctcactttaatgtaatgaccacctctggtattgacatttaactttgttagtcaggttattatcatttggccctgacacactctgcctgggacaattcttccccatatgaaggcctgccagtgccaggccagcagttacattactagagaccaagggtgtaaaggcactatttgtgacctgattgaccactgccttatgaaatttttaatcaataagaatcaatgaaaggcctatagtatatgattggcaggtttctggtgttaaattcatgagcaactacagaatgtcttatattggaagagccatccaggtaataaatatgctcccattaatcaatgatttacaccatctatctattttatgtgggcagctgctgtaccattataatgagagctccaactcctctgagaaaaatgacacctgaattgttttagtggtgttttggcataactggcgtatattgcagaaatgaccttcccaatcaagagtggttagaaactatagctgattttcaaaacaatgaacactgttttgctttctgggaattctgtaaagcacaaggaaaatatttttaaaaagcagaaggaaacagtgatagtgattggcatctggccatttgacagtaaaggtttgaatgatttgactaaagattagcttacttctttcccttgtctacagaaggtatcgtttaatactttcattgtagagactggtttatatgtgatctaagagtacactttgtagatgatacagactaaattagattaacaacaaattggtgcatgtataaaattccacgtatattcagcattctaattctttagatttttaaatatgcattctgataagagatgacattatccaccctcactctgcccacagaaaactctataaacataaacaattctgaatattcttataagcttttacacatgtgcaagactttcaactttttcaaagcattttgataaatatctcacttcagagtcacaatcctgatgcaataactagagtagatattgttttgtgacaagtgaggaaatgggaacctggaatttaatgtgctctagcccagtgctcagtacccagagggtacccactaaaaggcagtaagtagtgaatgatgctttgtagttggaatttactacagacccaactctatcagtgatcaaaatatattttccttcagcaaagccttttaaataccagggatctacatttgagaaagtcattgcaataatgtaagtgattgcaaaaaaagtaattgttttgttctttaagaagatgaaaatgctattttctttacttttaatccagagaatgtatttatagagggaagacagtcctaagaacagtattgataaggtatatgtcataatatgtgactaaaagttatctgtgacagagctcctttaattacttttgcatttctataattatttacttcaaaactattgttttcattctttaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgt

SEQ ID NO: 3648 - DNA, 219051 bp, human; identical to SEQ ID NO: 3646

SEQ ID NO: 3649 - DNA, 33918 bp, human
gctccagcccggccgggctccgaggcgagaggctgcatggagtggccggcgcggctctgcgggctgtgggcgctgctgctctgcgccggcggcgggggcgggggcgggggcgccgcgcctacgggtgagtgcgaccctcggggcccgaggggcggccggagggctgagggcggtgagggtcacggctgaaaggccccggaggtcaacgccgggcggagggccgaagctggggtgggtgctgggggctgccctcgcgaggccccgcgctcggcggctgcggcttcccgcgcgggatctctggggcccggtactggggccggttcgaggtgggacccgggagctgcggggttttcccgaactccgggtgcggcggaggtggcggcagcgaagtaagagggctgcgacttgtagtgggaagagcccaggaggctggcgtccaggcgtgcgggggcggggggcccgaaacatgcccacggcgtcagagggccgtgggtcagcgcccggaatgtcgcctgtgagcccgggaggaaatgaggcgccagagccggcggggaccacgaccgaagtccaggcgagctgagaacgcgccggggctctttgcccgaggccgcgccaatcctcactgtctaagggtggctcttgcgagtggaagttgaagggaacctctaaacatctcagtccttgttgaaaaaggacgtgacgctcatgacctcctctggcgtcgaagaaatcctttgggaaatccagaatagcatcccggcagatgctccccccaccccactctctttaataaaccttatattttagggtaattgtagatttatggaaaagttgcaaagatacttcagagagttgtgtatatccctcaccctgtttggtaacttctagttaatcaacctggcagttgtgaaaaattgggagttaatgacttccttaggagcagctcctggaaggaatggccttctggacgtttttggtgacaatgaaagccccaaactgtataggttttattatcacattgacacaaacacttatatatgcttattgcatttttaccaatgtgctttgaaatccaagttgaaatgttgattaggaaaccttaatgccctctatggattcagtcaataaaatacatgctgccaggcagtgtttaggggctgaggatgcagcagtgagcaaaacagatgaggtgcctgccctcagacatatcggggggtgggggtaaaatatatgatatgtctgagggtgttaagtagagaaaaacagagcaggtgggaaggggtttgccattgtaaaaagggtggatcgagaagaaaacaaatgttgctgaaaggtggcatttgagtagagacctgagggagacttgaagcttgtcagtcaataattattcaggtgtctgccttatttagtactgagtcaggccctctaggttgacttagaacctgagagtgtatagcaaaattcttgccccaaaagggcctctagtttagttgggtacacctgatttccgtaatcatatggggacattgcagtccagagaagggaaggaacttgtctaaagttacccgtctcattagtctcctgattttcacagtgccactccagcaccctccctcctacagactcactcccacacacacctgaaacaacagctggccatctagagaatactggcaactcccaacttcatcagtcctgtcacaatggtttgtcgttagcttgcttatttagaaaacaaacttctttccccattaaaagtattgatagaattgcattgaggtatggtgggaaaaaattagatgtttccagtgagacttgagttttagtggttctgatatttaccacctgtgggactctgggctggtcatttcctctcttttgtgctgcagttagttttctcatctgtgaaatgaggaggttgaactgcataaattctaagagctcctccagctctaatcctcagagtgtttataaaagtgattagattactagcttagtttaacctgtcccactcaatggcccacattgtggcatgtcttaattataactagcatgtatatagcatttatgcccagcagttttctagctgctttacttgtactatttcatttaatctttaccaataatataacttgtaggtgctgttattagtcccattttgtacacgaaaaagttgaggcacagtgcgaccaagacccttgcccaaattcgcatacctggcaaagtggaagagctaggtttccaaccctggcagcctgattccagaggccatgcccttaaccactgtactcattgcttctgcccagcagaaaagacgagagtccttagctggacacctcccagggtagcagggcaggacggcttgggacccacgaaagtatgtgcaagccatttgttaagaagctaatgatactatattaggccgggtgcagtggctcatgcctgtaatcccagcactttaggagactgaggcagatggatcacttgaggccaggagtttgagcctggccaacatggcaaaaccccgtctactaaaaatacaaaaattagccgagtgtgggattacatgcctgtaatcccagctactcaggaagctgaggcatgagactcatttgatcctgggaggcagaggttgcagtgagggaagatcaggccactgcacttcagcctgggcgacagagcaagactgtctcaaaacaaaaaaagaagcgaatgatactacattggagactggctttatagtggctgggctgtgtggtccaaacaactagtactataggcattcaaaagagaaaaagctgacggttggtagtgttatggaagaggtaaaacttgagctagatcttctggatgactgggatttgagtaggtggagaatttattccaggtgggggcaatagcaggagcagagacccagaaatgagggcaagagtgctcctttgtggtcaagaaggaacctggcttggcaggagagtgcattggtaaagtcaatccaggcagaatagcttgatttgcccttgaaagctctgagtccggcacagcatgggaaaaataacacagaaggaggaagcaagcagggagacttcactgggtaggggagcccctggagtgtgaagctacataagaatctatggttgcaggtctccactagaaaaatgtgctgcgaacccttcctgtccaggaccatgacttactggtatcttcccacctggtggggcacaacagagcatatttgcatgattggggtaactaagaaagatgttggaagaaaaaaacgaacaggagttgatgcctgagtggatgtaagggaagggacagatgactcatatatgactcttgtgatttccttaacttttcccaaaatgtgcatgcctctgctagctgctgtgattggacaggcgagagcaaaagctataagctaagcaaaatgccttcttatgaaatagtagattgtgttaactcttaatttaaataggatgttgtgctagatgactgtacagacttgggatttgaggtttagatacagacatacttgggtcccttcctactcccttttctgaagtcagtggtgcaatccccaagacatggttgaaattaggtgcctaagggaagcttatcaggtagaagggatacttgttctgtctcaaaggccagggacacatatcaattcaacagaaaaccaaagcaaccctggccaggcacagtggttcacacctgtaatcccagcactttgggaggccgaggtgggtggatcacttgaggtcaggagttcgagaccagcctggccaacatggcgaaacccagtctctactaaaaatacaaaaattagccaggcgtggcagtgcacacctgtaatcccaactactcggaaggctgaggcaggagaatcgcttgaacccaggaggcagagtttgcagtgagctaagatcacaccagcgcactccagcctgggtaacagagcgagactccgtctccaaaaaaaaaaaaaaaaagcaactctttagaattgttttgtcttaaagaaataaagcagatagctaacacatagcacttgctgcctgtgggcactattctaagcacattgcttgtattaactcatttaatcctcataataaccctttgcaagaggttactattattatcctcatattagagatgagaaaactgagaaatagagaggttaagtaatttgcctgctggcaagtagtagaggtgggatataaactcaggcagtcaggctccagagtctgtgctcttaaacactacactatgttgaagttatacacgaagagctgttagagacctttacaagtagtataatcatcacttaatcatatatatgtctaggcatgttgtatacacacacagttcacatgtatttgtatatatttaaacatttggagattaaagtttcagtgcctgtgtttttttcaattttttattataaaatacacataaaatttaccatcttaatcatttttaagtacacagttcagtgttacgaaatacattcataatgctgtgcaaccatcatcaccatccatccccataactctttttatcttgtaaaactgaaactctgtacccattaaacaataactcctcattttcccctgcccctagcccctggcaaacaccattccactttctatctctatgattttgactactctaagtatctcatatgaatgtaatgatatactatttgtcttttttgtgactggcttatttctgttagcatagtgcccttatggttcatggtgtatcatatgtcagaatttttccttttttaaatttatatatatatatatatttattataccttaagttctagggtacattgcacaacgtgcaggtttgttacatatgtatacatgtgccatgttggtgtgctgcacccattaactcgtcatttacattaggtatatctcctaatgctatccctcccccatccccccaccccacaacaggccccggtgtgtgatgttccccttcctctgtccaagtgttctcaatgttcaattcccacctatgagtgagaacatgcagtgtttggtttttttgtccttgcgatagtttgctgaaaatgatggtttccagtttcatccatgtccctacaaaggagatgaactcatccttttttatgactgcatagtattccatggtgtatatgtgccacattttcttaatccagtctatcattgttggacatttgggttggttccaagtctttgctattgtgagtagtgctgcaataaacatacgtgtgcatgtgtctttatagcagcatgatttatactatttgtcttttttgtgactgacttatttctgttagcataatgccctcatggttcatgttgtatcatatgtcagaatttttcctttttaaaagctgactaatattccattgtatgcatataccatattttgcttatctgtttatctgtcaatggacacttaggttgcttccatgttttagcaatttcacaatactattatgaacctgggtgtagaatatctctttgagaccttgttttcacttcttttgggtatatacccagaaatggaattattgtatcatatgataattctatttgtaatttttttgaggaaccaccatactgttgtccatagtgaaattttaaatttccaccaactgtgcaccggggtttgaatttttccatatcattgccaacatttattttctgttttttgatagtagccattctaatgggagtgaggtgaaatctcattgtggttttggtttgcattttcctaaatattagtgatgatgaacaccttcatgtgcttattggctatttccttatctttgttggtgaaatatctatttaagcctttgcctatttctgaattgaatttttttttattgttgagttttaggcattctctgtatattctggatattaatcccttatcagatatatgatttacacatatttttccattctgtgagtcacttttttctgtgaatattttgatgcacacgttttaattttttccatgaaatccaattcgtcaattttttcttttgttacctacattgttggtgtcatatccaagaaattgttgctgaatccaatggtatgaagcttttgtcttatgttttcttctaaaaattttatagttttagtcttaaaatttcagtctctgatccattttgaattttttttttacttggtattgggtaagcgtccaatttcattctttttcatatggatatccagttttcccagcaccatttgttgaaaagattgtctgcattgagtggtcttggcactgttgtcaaaatcatttgaccatacatgtgatggtttatttctggactgtctattctattacattgatcagtatgtctgtctttatgccagtacacactgttttgattattgcagctttgtagtaagttcagaaatcaggaagtgtgagtcctacagctttgtttttccgtttcaagactgtttggctattcagggttccttgagatttcataagaattttaggatggatttttctatttctgcaaaactatgccattaagattttgataaggattgaattgaatctatatatcactttggatagtattgacatcttaacaatattaagtgttctaatacgtgaacatgggatgtgtttccatatcatctacaaacagagataattttacatcttattttaactggatgtcttttatctctttttcttgcctaattgctctgggtagaacttcaagtactatgttgaataggagtggtgaaagtgggcatctttgtttcattcctgaccctaaaggaaaagctttcagtctttcaccattaagggtgatgtttactgtgggtttttcatatataacttttaagtcaattttcttacactcctagtttgttgagtgtttttatcatgaaaagtaaattttgtctaatgctttttctgtatcaattgagatgatcaggtagttttttcccctttattctgttaatgtggtatattacattgatcaagttttgtatgttaaaacatctttgtattccaggaataaatcccacttggtcatggtctataatccttttgatatgcccgtgtattcactttactgctattttgttgagaatttgtacatcaatgttcataaggcatatgggtctgtagttttcttttcttgtagcgtctttgtctggctttggtatcaggtaatgctggcctcgtagaatgagttacgaagtttgagaaggtttggtactagttctttagatgtttggtagaattttatctgtgaagctatcaggtctagggcttttctttgttgagagatttttgattactgattcaatctccttactacttataggtctgtttagatttcctatttctttgtgatttagttttggtggttttgtgtttctggaaatgtgtccatttcatctaggctgtccaatttgttagtgtacggttgttcatagtactctcttataaccctttttatttctctagaatcagtagtgattctagagaaatactcattttcatttttgaaaatgagtaaagttctcattttcatttttgattttagtaatttcagtcttctttcttattagtccatctagctaaaggtttgtccgttttgttgatcttttcaagaagcttttagtttcattgattttctctatttttctattccctttttcttttatctctggtctaatcttcattatttccttccttatgatagcttaagattagtttgttctttttctagttacgcaagttgtaaagttaaggttgctgatttgagatctttcttgtttcttaatatgtgtttatagctataaatttttccaatagtactgctttcgctgcatcgtctacattttagatgtttatatttacgcctttcatcaaatttgggaagttgtcatccattatttctttattttctttttttgagacagagtctcactctgtcacccaggctggagtgcagtagcacgatctcagctcactgcaacctctgcctcccaggttcaagcgatgctcctgcctcagccacccaagtagctgggattacagatgtgcaccaccacactcagctaatttttgtatttttagtagaactggggtattgccatgttggctaggcttgtttcgaactcctggacccaggcaatctgcctgccttggcctcccaaagtgctgggatgagccaccacacccggctcattattttttcaagtattctttcttcctctttctctctcttctcctggaacccccataatgcatacactggtctgctgatggtgtaccacaggtctcttagactctgttcacttttcttcaatctttttttctttctgttcctcggactcaataatttttattgccctaatttcaagtttattgattctttcttctgcctgctcaaatctacctttgattctttttagtgaatttttcatttcagttgtgctttttctgctccagagtttctttttggtctctttttaggttttctatctctttattggtattttcattttgcttacatatcattttcttgactctctccacatcttcctttagttctgtgaacatctgaagatatttgtttcagaatctttctttaatatatttgccatcaggtctttttcagggacaggtttgctgttgtttaactttttttctttgggccatagtttcctggtttttttgttttgttttgttttgtctgtcttgtgattctttgttagaaactggacatttaaatctggtttctctggaaaccagattcccccttcccccaggatttgctgttttttgttattgttttgtttattgtctttatttttttgattattgtaggctgtctgtgtgttgagcatcaacctgaagtgtaaacttagtcttctcaggtttttttctgggctttccctgagcatgtgtggtcactttctgtttttctctgtatatatagttttgtttcattttgttttgttttgtttttgagacctagtctcgctctgttgcccaggctagagtgcagtggtgtgatcacagctcactgtaacctcgaatccctgggctcaagtgatcctcccacttcagtctcctgaggagctggaactacagattcatgccaccacacctagctaatttaaccaaacaaacaaaaaaaattgttttggtggagatgggatctcgcagtgttgccagggctgatctttaactgctggcctcaagtaatcctcctgcctcggcctaccgaagtgctgggattataggtgtgagtcaccatgcccagcctctgtagttgtttaagaatttctaatctttaatgcctggctcccaaaagtggaaaaggagaaaaatgaggcgacaagggaagagcgccattcttttacatcttctggaaatcactttagctagatagggagggcttgcaacagtggggataggtgcaaccacaatggctgccagcctctttgtctgtacctctgtgatcagaagcagcaatcagtaatcagaatacaaatccctgatatttggaggacagagtacttctgcccacatagcccacaagctgtgggcagagggctccaggaacatgtgcacagccgcctgccatggggttggggatgaaggatgggcagctactactatgtaaaagctgacattgattgaaatttatggcaatttgttgttcaagcctttcctgggaaattgcaagccttcaatgtaagtgtttcctgatataactctgcagtcttccaaaattgttacatcaaacagactctgccactaccattgttatctaggtgaggagatagatgtctggtgcttcctactcttgccttattcccagaatccatgtgtgtgtgtttttaaagtgtaggaagtagaaaaatcaaaagatatggaggaaaccagaagagaaaaagaaaaggatagcagatagccccaggaagcccaaaatgcaaaccagttagaagatctgaccaaaggacacttcaaaacagatgggagaatattaatcccatttgaaaggttgaatatagggcaggccattgttttatttcaaaactgaggttaaagtaggttttaaattaccttgaaaataaattggagtacaattgaaatgaaccacaaataggtatatttttattatcagggctttaatatttgtgtgggagtgggaggtaggtgggtagggagagtactggaagtgctaaactaggtttcttggatgtgtttctgggaactgcagaataaggcagataatcctacagtaaattgtagtctccagtaggaacaatgtttttattggaggctctctacctgacaaatgatttgtcttcaaaaatatcattgatatggtgttagaaaggccaaaatggaatagccatacatgcttttaatcacttaaaatcctaactttagcactgttgcctgagccattggtgctccctggtactagctcagttttaatgcagtgcaataggaattctttgtttccacaaggccttgtcctgctgtgggctgctccttcccacagttggaccttgggaaaaggtagagttagaagagggaatgattttttttatttcaaattttattatagattaaagggtatatgcacagatttgctacatgggtaaactgcatgacgctgagacttggggtccaacaatctgatcacccaggctgtaaccatggtacccaacaggtggttcttcggcccccaaacccacctccctccctcccttgtctagtgatccccagtgtctatcatttccatctttatgatcatgtgtattcagtgtttaacacccacttatgagtgagaacatgcggtatttggttttctattcttgcattagatcacttaggataaaggcctccagctccacccatgttgctgcaaagggcatggtttcattctttttatggctgcgtagtattccatggtatatatgtgccacattatctttatccagtccactgttggtgggcacttaggttagttccgtgtccttgcttttgtgaatagtgctgcagtgaacatacaggtgcatgtgtctttatgatagaatgagttattttcctttgggtatatatcaagtaatggaattgttgggttgaatggtagttctattttaagtccttttttttttttttttttttttttgagacatagtcttgctctgttgcccaggctggggtgcagtggtgcaatcttggctcactgcaacctccacctcctgggttcaagtgattcttatgccacagcctcctgagtttctggtattacagttgtacaccaccatgcctggctaatttttgtatttttagtagagacggtgtttcgttatgttgtccaggctggtcccgaactcatgatctcaagtgatccaaccgcctcagcctcccaaagtgctgggattataggcgtgaaccactgtgcctggcctattttaagttctttgagaaatctctaaagtgctttccacggtggtggaaccagtttgcatttccaccaacagggtataagcattccctattttccacagcctcatcaacatctgttttctgacttttaaataatcaccagggaatgaatgttgagggtcaagggcctttgtagactgctgaccaagtagctgctatgtataaaattgactgttagagaaacctcaactacagagtgtctgtgagtttgatgttttgatgttttgggacaaatggaattttttgctcagttagggaggaaggtaacagtataaatattgctgattatgtaacaggcccagtgcactccaaagtattagcatagagtacaagatttaactctatcatttggtaaattactattactataatccttaagtaattaataatggttccgttcatcactttagaaaatttgggggaattattttcaaataattttaataaacttctatgttgaaataatttttgatttacagaaaagttgcaaaggtgggacagagggttcctgtatacccatcacccagtttctgggggatgattttgatagtctcaggagaacttctcaggaaagtttaaaatgatgtttcacagttcctcctctttctcttccctcttcagattagtcaaagctctagctccagctgtttagtgtcagacctcaggggaacaagggctgctaagtctctttctcagtacttctttggaaaagctataaaaaaacaattaccaggtcatgttagcaagcagaattaaagatgagcttcttaaacttacttatagaactgctgagattttgaacaatctgattttttgttgttgtcattgtttttgagacagggtcttgctccgtcacccaggctagagtgcagtggcatgatcttggctcactgcagcggcatgatcttggctcactgcagcctcaaactcccgggctcaagtcatccttttgcttcagccccccagtacctgggactataggcatgtaccagcatgtttggctaacttttgtaacttttttgtatagatgggattttgctatgttgccggggctggtctcaaactcctgggctcaagccgcttggtctcccaaagtgccaggattacaggtgtgagccgccgtgcccagtctgaagagtctgtatggagtgaggtgtggatcccaaggttagggaaccccaaattcctggaagagaacaacttggaaatattagtatttaagaatatcactcttctctatggaagtggttaagaatgtgaccttggagccacacttttcaagtgacactcccagctctgccgtttactgtagccatgggatatggaacaaattacttcacctgcttgttgcttcagttgcctcatctttaacatgaggccaataggccaggtgtggtggctttatacctgtaatcccagaactttgggaggccaaggtgggcggatcacttgagctcaggagttcgagaccagcctggccagtgtggcaaaaacccatctctactaaaattacaaaaattagccaggcgtggtggcatgtgcctgtagtcccagtaacaggctaggtgaatcacttcaccccaggaggcagaggctgcagtgagctgagatcgtgccactgcactccagcctgggttacaaagtgagattctatctcaaaaaacaacaacaacaaaaacatgaggctaatactagtccctatctccaagattgttgtgaggattaaatggattaatatgtgtggaatatttagaatagtccctggcccagtaaatgttagatgttgttaactcagttattactgtcttgtcctctaggacttgggagaattaagcaaaccattaaaaatactgttgataaattcatttttttttgtccttgatttgaacagaaactcagccacctgtgacaaatttgagtgtctctgttgaaaacctctgcacagtaatatggacatggaatccacccgagggagccagctcaaattgtagtctatggtattttagtcattttggcgacaaacaagataaggtaagttttctgcaacatgttacattgatgaggtaaagtgaacactatgaattggagccaagaataagccaaattctagtcttacgtcaaagtggaaattgtattttagggtgtgtttaaatttcagttggggaaattatagaagcaactattgacacaagtgaacacttaaaaatatttgctaattatttgacaattaaatgcaattgagattgctctgacaggaaatactagatatctttttctctaaggtactcaataaataattatgttattgttaaaatttgttcctatgttcctgcctgtagctgtattgccttgtatctatataacacttaattttggggaatttttacatttaccatcttgctaatcacatggacaaatagatgtacaggcactatgtggtgtaaaagtaaacggccatatggaaagtgaaaaagtaagttgtcagtggcaggtgtgtttgagtagagggttctgtaatgcccgcggaaaaaggaggaagactttcaagatttctagtcaactgatataagtgaatttttgttaataggtttggataatttcaggtcctttatgataatcttattcaacttttttttcaaaatctttttataccttctttcggtgtgtatgtgtttgttgcagggtggcggcggtgagtgggttgggtgtttggggttgaatttgtccaggattttgagtaggcagaatgagaagttattagcaacagtgctttgcatcagtgaattgtagaagcaccaagttcaggcagctttggtggcaggaagtcaggagaactagcttctgattggcactgtcactcttagctgactctatggcctggaataaattgcttaacctctctgagcgtttgtttccttatgtataaagtatggctttactcacttcgctggcttgctgggacacagaaaataatgtatatatacaaaagtttaatagtcaggatggaacatgctcttcctctggagggaaatttgctaatctgccttcctctcccttgtcctgctgaggtgttacttatggtttaggcgttaattgataaagaattgaggcttatcagaagtatttgcattttaaaagaggtcttctaaatgtggaagccaatgatactactagcagtgagactggagtttgcctttacatactgtcggcttcctcttgttcctcctaaggaagggccttaggcatttggagtcttagtggtgatttttggtaattgagccttgagaaattcacagaaagaccctaagtgcctctggctgtaagccctgtaatcacccaagtgtctaactgaaaccctgagcagaggttgcttttcaggtcccttttccttaagttgtcaaggatcaatcaggtagccaggctggtgttctagcctagaaatggggctatttcctcagagtatgtgcagaaatctagagttaaatgtaactttaggagacagtagaatcagatagaattgtgcttgaaattttatctcttcccgtttcaagctgtttgattttgggcaaatcacttaacctctctgagctcccattttcttgtttataaaatatggggttgttttggcggggggcgggtaataatagtaccaactgaatatggatggtgtgtgcattaaaggagatgaggtttgtaatgcacctgacacagagttagtgctaggtaattgttagcttttattattgttactgttgttaggttgagccatgtgaaattaccacttttatgggtcaaaatggttgaatgttgtcagtattatttgtcagcctaatattatcatttaatcttgtttcctccattttacccctgaagaaaccagatagagaccaaaaagggtgacctctgcctaaggccagctcattcattgtagccatttgacagcattgatggccatcagtcctacatttgtgatgaacacggattattccttccagtcagtgataggagatatcctgtctggacctttttcaagtttatcatcaggaggctgaaaatgaatggcagaagtaattttcctctcctctttctgtcctttgggtacagcattagcatcattgggccaaactgaggtatccctgaagcatattgaagcaatggcattatgatagtttgtacattagggggcttaggaaaatgttcaaaggtcccaagttgctaaatgagataaacccttgaggtcattttcaatcttaagattggaggctcatcaagttgagagacagggatttgcagaggatttttggaaaagaaaagattagtgtaaatggcagccctccaccattttttaggcagtgtctaatagttcctcagctggcaagtagaaggaggatctagcatcagattttagatatctttcatcactaagagatgggcaagtcccattaggcaaactaatcaaaaggccaggcatccaaataggaagatgctgaagctaactccctttctttttgagaaaggaattctggagttgagaaaggtgcagtccagccaagtgaacattggtctggggagatcagttcaggactcttgccttggtttttgataaattttcaaagggaatcagattccctgcagggtggagcataacatcatacagcagctaccagtgggaatgattcaccaaagccaaaagtcacatgggagccatcacacatacctcatcaagatctgatgggagggttgaacgtggtgactcatgcctgtaatcccagcactttgggaggccgaggcgggctgatcacctgaggtcaggagttcaagaccagccttgccaacatggtgaaaccctgtctctactaaaaatacaaaagttagccaggcgtggtggtgtgcacctgtaatcccaactacttgggaggctgaggcaggagaatcgcttgaacccaggaggcagtggttgcagtgagccgagatcatgccactgcactccagcctgggcaacagagcaagactgtttaaaaaaaaaatctgatggaaggaatttaggaatttagtttcttgtgtgatacagagaggtgtacttgacttggcagttgttgataatctgggttcctactttattagtgccagtttaatattgtttaccttgaactttgaaagaaattaaaaaaaaattatttgaaaaaattttccctctactgtcccttttctatgttattattcatatgcctgaagcataaggttcggatttagatactaaggcattttttaattttttatgttattttattttgaaatggagtctgctctgtcacccaggctggagtgtagtggtacgatctcagctcactgaaacctctgcctcctaagttcaagcaattcttgtgccttagcctgccaaatagctggaactacaggtgcatgccaccacgaccagctaattttttttgtatttttagtggagacagtgttttgccatgttggccaggctggtttccaactcctgaccttaggtgatcctgacctcaggtgaccttggcctcccaaagtgctgggattacaggtgtgacccaccacgcctggccactaaggcattttttaaattaaaaattccattgtgataatttttgtgtactaaaactccgtaaccctctaactggaacaatgtccattataatatgaaaactgggattatcttcatgatgattctaatttgactgtatttgactgtacagtctaatttgacatttgactgtacattttcccctgatgtcttcaaagggcaaatatagcttccaaacaagaattgccatggatccttggataagggtggcttcttcaaagatatatgggacttgtgcttagtaaaattgtgaggttggtaaaatttgtattcgaagccttcctgccaccactaccatgatcctggaggcaggtcttcagcttcacatactcagaaacttcatttcctcagcacacatgcatctctcaggggctgattttttactttgttgtgaaaatggaatggtaatggtgaagcattctaggaagatttctgttagcataactggtgcatttcatccctgtcggcagagcctatatgggaagccaaatgttaagtaggtttcttggtgaggaatcagaaattagttgtaaaaatatacttgtctaagaatagctggaggccctactgagagtaaacagctttgccagtgggacagaaaaattcaatgcccacattcctgtatcaccctctttttcctgcctgtcaggattttgctcacagacatttctttttctgttcttccagggctgaccaactcccttttcagagtactgtcttgactggacctaagagctattctggttctataaagtgattttgtttttgtgtccttgctatgatttattcattgttgacttggtagttacttctcagaggccatccatatgtcctggttttgggggtatctcacagttgccctcatgctcagctggcagcaggcatgtgacatggcagaatagctctttagggtagcagatagaactaactgtggcaaattttcctcttcatggccgtcaacatgtagatgaaaggaaatactatctctgacttgagtcagaagctattgcaaaacaggaggtgctctccttggagctctgattaaaagcagctccattcttaattattccaactctgtcagtttgggaaatgttaatttcccggagagcccattaatcttattattctcagtcatagtaaccagactggtgatttatgtctctatgatgtctataaattggcttcctatggttccacaaagcttatctacttttcagaatgagagtgtatatactcagcacatatagcaatgtttgaaatttatacatatatatgaggtagtcaaaatagtcaaacagtagagaaagaggtttaatgaaaagtctctcttcagccctcaggccctcctcctttacttccttacccagaagtaaccatgattactggattttttttttgagacagggtctcactgcattgtccaggctagagtgcaatcttggctcactgcagcctcccgctcccaggctcaagtgatcctcccacctcagcctcatgagtagctgggactataggcatgagccaccatacctggccaatttttttttgtacagatggggttttgccattttgcccaggctggtctcgaactcctgggcttaagtgatctgcctgcctcagcctcccaaagtgctgggattataggcatgagccactgagcctggcatgattcctggattcttaaagcatccctttttaaccttaattttcctggtacagtgcatctacttctaagtgaattttgataatcatattgtttcctttaaaattgcttttagagagttgatatgttagcattgtaggtttataggtaaatttcatgtttatacctttaaaatgtgggaaattgttgtatctacaccagggtttctcaatggtgacactagtgacatttgctgaagggtttgttgtaggaggaggggggctgttgtgtgcattgtaggatgtttagcagcgtccttgacctctacttactagatgctggtaacctccccctcccaagttaggacaataaaaagtgttcgatattaccaaatgtctctgagagcggtagggagaacaaaatcagccccaattgagaatcactgatctataccatttgataacttttttgataaaaaaagcaccacatttagacatgctaatgtttcattatataagtgtgtgttagctgaagcaatgcctttttcaattttctaaccttagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtaacaactgaaagcgctatctcttggtgtttagagaataaatctgaatgctccaatgcttttgtgcattgttcattaattaattcaattctcaaacattttctgagtctaataagtgccaggcattgtactaggtgctagcagctcaatgaaaatatgagtatgtctctgccttgaagaagcttacaaacaacttgaataacaatgcctaatagttatataaaatttaataatttaaaaaatgatatacacatgcacgcgcgcgcacacacacactcacacacacacacacgcacacccctcctttagatcgagagtcacaagcttatcttgtgaagtgagtaaggcatgtattattaccctgatccattttatgaggaagaaaggaactgcgtgacttgctgtatgtcttcacatttcaggcccagtgctttaaaaataaaacacaaaatactctcttacccattatgtgtgatacttagtttgatatgcaggatatatttgggaaaagatgttgtttaaagagaaaaatattatgctggcctggctccaatacaagtctagacaagatagtacaagacaaccttaggaaaagctgtcaagtagtgaggatgatcattgttccccaatcccacctctcccaatgtccttctggctcttatgttacatacagggagtagcatatactgattaagagcagggctaccagaaaccaactgtctaactttaaatcccagctctgccagctactagctgtgtaaccttgggcaaatttcttagcccctctgcaccttagtttcctcatctgtaaactgggcatgatgatagtatctatctcctagaattattgggatgattacgtaagtcagtatatgtgaggtacttagaatagtgcctggcaaagagtgaatgttgtgtgtgtgtgtgtgtgtgtgtgtgtgtgtgtacacacacaaaaaacatatatatataacacatatatatactatatataatatatattatatacattatatgtaatatatataatattatataatatataattatatataatattatgttgtcccttggttgggtagggctgggccccatctcttaacctccagtccttagctctatgtgccctttgctctaagccattccatttacctgctttgtactgatcacaaacacatgaagtgctgtttgtaaaattataaaattcaggactgccaggagatttgaaacaacttacctgccctattctcctttccttaggagttaacgaaaaaaaaaaaaaaaaaaacggctagatgcagtggctcacacctgtaatcccagcactttgggaggccaaggtgggcgaatcacctaaggtcaggagtttgagaccagcctggtcaacatggagaaaaataataataattagccaggtgtggtgcatgcttgtagtcccagctactcaggaggctgaggcaggagaatcgcttgaacctgggaagcagaggttgcagtgagccaagatcacatgactgcactccagtctgggtgacagagcaagactctgtctcaaaaaaataataattactatactatgacataaaatggttgatgatggctcagtgtagtaccccttcaaggatcatgagggataacagatttacattttaaacagaggtgtttaatttaaagacattataccttaactaaaatggctttataaagatagagattttaggtcagaaagatactagggctcttaaagtcatgacacttaagaggcaactactaagagttaaattaggcttacctttccccagaattgcttcaggaggaatgtttgtttgtttgtttatttagagacagagtcttgttctgttgtccaggctggagtgcagtggcaagatcttggctcactgcaacctccacccccctggtttaagcaattcttgtgcctcagcctcccgagtagctgggactaaagatatgtgccaccacacctggctattttttgtatttttagtagagacagggttttgccgagttggccaggctgttcttgaactcctgacctcaaatgatccacccttgttggccttccaaagtgctgggaatacaggcgtgagccaccctgcctggctgaatgtttattttttaaaaaatgtgtcagtattgatcaaaagacagaaagttaaattgtacctcaataattttttaagacagatatatataagggttgtttgtatatccacattcatttaggaattgtgtagatattgtctatgattgaaatagtttttgatcttttatctctccctccagttaggaatattagttagggtccctcagtgatagggaagatgttttctttgtatcaggaggtaagagagaaggttgtgaacaaattagatttgagtttcctccatcctgggtgacttctgggtaaaatggggtgagagatgaagcatttgctttctgacaaagcagcatgaagcactctcatcatccccatgccaaagagtgatttgctactttgcattacaaggaaagaagggtcttaaactcttggcctggatattctaggtgatcctgagtctgctgtgactgagcttcaatgcatttggcacaacctgagctacatgaagtgttcttggctccctggaaggaataccagtcccgacactaactatactctctactattggtgagtatgtacagtacaattactggaagactgattgtaattgtgttgggagcctttggatccaacctagtcaaaaaaaaaagaactgtttaattttttctgcaaactcaacaagatggacagtttgcttcaatgaaaaatgcatctgtctttggtgtctactttttaaataaactttctatttttaaatatagatcctgtatattaccagaaaaaatgtacagagagatcccatatactccactcagtttctcccagtggtaacatcttgtgtaactatagtgcattatcaaaaccagaaaattggcattggtacaatccaaaaacctcagtcctatttcaacagttttacatgcactcgtgtgtgtgtatatgtagttgtatgcaattttatcacatgtgaagatatacaatggttgcatcaccataaggagttgctcttttatagccacactcacctccgtcttaaaccatctctccttgtacacccctctcccccaatcctctaacctctggcaaccactaatctgttctccagctctttaattttattatttcaagaatgttactgaaatggaatcctatagtatataaccacttaagactggcttaaaaaaaaaaaactcagcgtaataccctggagatctatacaagtagttgtatatcacgaggccactcctttttatagctcagtagtattccatgatatggatgtaccagttttttaaaccattcattcattaaaggatatctcagttttttccagttttttgctattatgaataaagctactgtaaatattcacatacagatttttatatgaacataacttttcatttctctggaataaatgcccaagagtgcaattgctgggtcatatagtaatggcttatttagtttttttttttaatgccaaactgttttctaaagaagttagttcaccttacatttccactagcaatgcatgagttattgatgtctacttttaaaaaggaaaatgatatgtccggggtcaaaaagttgtttgtttgtttatttatgtttttgagatagagtcttgctctgtcacccaggctagagtgcagtggtgagatctaggctcactgcaacctctgcctcctgggttcaagtgattctcctgcctcagcttcccaagcagctggaattacatgcatgcaccaccatgcctggctaatttttgtatttttggtagaaacagggtttcaacgtgttggccaggctggtctcgaactcctggcctcaagtgatctgcccatctcggcctcccaaagtgctgggattacaggtgtgagccaccacacccagcctcaaaaagtagtttagcttcctgcaaaacaactttgatattttgatatttgatactttagtatttggtatttgtgactatatctactacaaagtttgttaaatttctaagttagtcttccatcattccctttagagcctagaattattagcaacagaacaaggaagaaagaccagattaatccagtttaattcagtaaacctttatttagaacactttgtggataaaccactgaatgcacagcagagacaaaaaacatatctcttctctcctaaagctcaaaatatagaggagaagatagtgcctgatacagtgacctgcattaaattaagtaagacagtgtatgctgaaggctgttgcagagggatagatagattcctgtgggaagttaggttggagcttggggtggtggtcgaggggaggtggatgggtggatggagaggggactgagaggctttgatgaaggaggaagactgcctagatgggggagtttctctgatgctggcctctggggaagagcattttgagaaatggaggtatttaatcgttgtgatgtcagggtggagaaggggagacctagcataggcagtctgcctctacatggccttgttccctgactgtcatttgttaagacttcttctgagagaatgggatgtggagagccatgtccaagacttgtgaagctactggataaacatggcctttcatgctagagtgtctattttgcctgatgacatgatggaaagcatttttgatacattaaaacactcatggctatatcatggaatagaatgcaaaaaaaaaaaaaaaaaaagtaacacacatttttggatgaaaacctccaaagttgccccaggattcacatccgcactcctccctggtggaaggatcctcctggcaaagttgggaaatcctgcaggtggagccagaagttctgtgtggttatgtctgaggtctgtttctttttccccccctgatgtaaatctcatttgaggttttgtagtttcacctgctcactcttggtacctgttgtttctcctttacttaaaacccttcagtggctccctggtggctttaggttaaagtccaaactctccagcatgacagacaaatcgctttatgacagacctggcccctgtcaacctctccagactcggttgcatctgcctccatgcacccccgcccctcttgcagcctaccattcgcccgcagcaaacttctttcagttcctcagactgctttcttcaaatactcaaacacaacactagatttcaaacagaatattcaaacagaatagtggaaacattctgcatcctcttgtagcctaggcctttccttttcatttggatgcctcttatttgtctttatccttatttcagcccagacaccatttcctctccagaaagccttccttgacctctcaagtctagacatgtgtcccttcctcttgtctcacggcaccttgcaatttcttgtgtcatactacccagcacattgtgttgtcatttcctgttacttggtggtagcctgctacaggcttcagtttctcttgagagcgggagctgtgtcttgtttctcctggtgcctgatatatagtaggtattccataaataagttgtgaatgtttggtaggatccaaagctagagaatattcagggttgcggtgatgacttatgaggtataagcaactgaggaatattatggttcatgaataaaaagagagaaggattgagtagatccagctccctaaagaattgctaagaaggggccaaagaactaagccttactaagaaggagtagcctggctgttgatgttgtagtaaagtttagggagagctgttacacaggcttttaagatgtcttgtgagttggcagcatccatgtgtttattatgctattaacccctcttgttttccctggaatcattattggtaaaaccgcagggaaaacctttaaagaatctatgtctatataagggactggaaaagaagggaagaagtcttaaaactgtatctcattccatggcagactgggtagaaaattatcccagctattagaatcagggtggcactggaggcagatggtagcctagtccttggggttcttctaagacaaaaatagggaagtgccttggggatatactagcaaaaacaaagtctcaatgcaaattgttaaaagaatgtttcctctgggtgaatgaattacaaaaaaacctggactgaccaatttgaaaaagcattcctcttcctctgggctgaagcaggctctcaccaaagctgagagcagatggtacttgggctggctttcagccctcagttgatgtctttttgcagggaacaatctgcacagccactggaggtcgctcaagatgcaattccaagatagtggtgggtcactagcatccaagggggcagatatcaaggatcctacttttttttgcgatagggtcttgctctgttgcccaagctgaagtacagttggtgtgatcattgcccactgcggcttcaaccacccaggcccaagccatccccccatgtcagcctcctgagttgctgggatcacaggtgtgtaccaccatgcccagctaatttttgtgttttttgtagagatggggttttgctatgttgcccaggttgctctcgaactcctgggctcaagcccgtctcggcctcccaaagtgctgggattataggcatgagccaccgcacctggcctacttcttgtcatatacagtcccagagctggtcatcagcaggggatctttctgtagtgtagttctgtgccatccagtataggagccactggctacatgtggctagttacattttaatttaaatcaattaaaattgaatcaaattaaaacttcagttgcatagtctcgccaaccactttcacaagtgatgagtggctcttgtattggacagcacagatagcgaccatttccataatcccagaaagttctgttggatggtgctggtatagattctgtatcttatccccttaccaccccacagcttattctttctggagccacactgcttgggttgaaatcctggctctcttccttactttagtgtgattttgggtaagtcccttctctctcagccttagtttcataatctgtgaaatggagatagtaataatagtgcctacttcttaaggttgttgtgagggctagtgtttagagccatgactagctgctagcatatgtagagtaagtgctcaatccataatagctattattactattggccaggcgtggtggctcacgcctgtaatcccagcactttgggaggctgaggcaggtggatcatgaggtcaggagatccagaccatcctggctaacacagtgaaaccccgtctctactaaaaatacaaaaaaatagccaggcgtggtggcgggcacctgtagtcccagctactcaggaggctgaggcaggagaatggtgtgaacccgggaggcggagcttgcagtgagccgagatcccaccactgcactccagtctgggcaacagagcaagactccatctcaaaaaaaaaatactatttattattattattattgttattatccccactcctttgcagatgcagtcagtacacagcgctggcctcttcccgtctcacagaattagtacctaacccatatctccttctttcttgctctcctctagatagatcctttctaatcaaaaccacaaaagaaagggagtcaagacacagtgctcattagcaagcaccagaaatggtttaggtaccagtataaatcacatcaaacaaactgccagagactgttttccctaacccccaaccataaaatacggagtctttcttttttttttttttcttttttttttttttggagacagagtctcattctgtcgccaggctggagtgcagtggtgcgatctcggctcactgcagcctctgcctcccgagttccagtgattctccagcctcaacctcctgagtagctgggattacaggcacgtgccaccacacctggctaatttttgtattttcagtagagacagggttttaccatgttggccaggccggtctggaactcctgacctcaagtgattcacccacctcagcctcctaaagtgctgggattacaggcgtgacccatggcgcctggcctggagtcattttttgaaatcaaaataattcattgaagccctagggcaatgacttgtgtccctgtagggacagtctggcattgaacagaccccggcctgaagagcttcagactagtcatgccagcgaattttagggattttttttttttttaccacattaatcatcttctgagttgggagaatagtctttaatttgtcaatttccttctcatatctgcagtgtgactctgcagatgaattcagtatataaattttaacaggaatcacctgctgttttaggttaatgtttcacaagaattcaagaaatgttatctattcagaaccagtattttcccttctataattatttctaaattacaacaaaattgttttaaaatttcattatctgagatccatgagcatatgcagaatactcagggtacagaaatgaaaaagggatcaagaagattgtgcattcgaggagttcctttcatcattaaaaacaattttacacatggctttctttagttatgtaagaaaaatgtcattaaatttcttcagtttctgtttttggccatgggcggaaaacattccaggacagtctgatccaaaaactagtcatgacaataacttcatttttacaacactgttttcttcataaaccacagggcgctgcaactagggggaaaagcttatgtactacctattgaaggaaaaaagcattttctatatcgaagcattcctttgtgcagcctttgaaggaataaatacattagctctgagtttttttttttttaaactgacttgcagcagaatctcctggagaattgctgttcaaatgctggttcctaggtcctggcaaaaccttctaaatcagattttctgggagagggtttgagaaacctgcattttaaagtagtacagaggattctgaggtaacaggttaaggatttgggactctttactcttagttcatttttcttaaaattgtcttccttttctgcaaaacctttgtgcaactccctttgtggctgatgatgtaagacttgactctgtcttctgccagttactacaaaacagttctctgatagcctagactaaaaaaaaaagtgtaataaacacattgtctgcctgcgctgggctaggtgctgatgatctttggggaaaggtatgtgtcgaggagaaatgggaaataaggtacctgtaatactgcttatggaagacagttaaagccacacagtggagtgagacacttagaaagccattgtgttttagaacattgacctggcagtgattggagggcactaataatgaaggtcagggaggtcaatctgaagaagcaatggagcctgtagtcattagggtatgaatctcagggtgtgggcaatggatgtatcataaaagacgaggatccatgaagctttgcaaaggaagaaagaacagaatttggtgatagaatacagggaacagaggtgggggaaaaggtgattttaatttaaattacctaatctaggagcccaaagaaaatgagctctggctgataatgggaaggttggaagaaaaaacagtttggtggagaagagggtgcatgatgtgttttggacactggatttgaggcaatggtagaacactcaaatggagcagttggagatctgggatttgttctgaggtgagatgtcaggattaggaattaccagcatagaaactgtagttgaaggatgagggagtgataaactggatgtgagtggatgagggagtcagaaagagggaagaatgtgagtagtcctcctactccccctctgctggaagagagaggagggaacagaacaagccaagaaacaaggaaggagcagggcagagggaccagaggaggaatcgtagacttcagcagataggcattttcaagaagcatgaaacttctaatcccagccttagaatgtcttctcttatacagaagaaataggcctcctgtagtctctatagctgctgacagtaccagtgttcatcaaaaaggaacaatctaggctgggtgcaggggctcacgcctgtaatcccagcagtttgggaggccgaggcgggtggatcacttgtggtcaggagttcgagaccagcctggccaacatgctgaacccgtctccactaaaaatacaaaaattagccgggcgtagtagtgtgtgcctgtaatcccagctactcaggaggcatgagattcactggaactcgggaggcggaggctgcagtcagctgagatcgtgccactgtactccagcctgggcagacagagtgagactctgtctcaaaaaaaaaaaaaaaaaaaagcagaaaacagtcttttcttcctagcatatgaaatgagtcacattgtacaatagggtttttttaaaaaaagttatcttgcccattgcaaatattgcttttcatggacatctcagtcattaaaaagaattctgccttttttttttttttttttttttttttttttgtggaagggtcttactcggtcacccaggctggagtgcagtggtgcaatctcagttcactgcaacctctgcctcccaggttcaagagattctccttcctcagcctcctgagtaggtgggattacaagcacctgccaccacacccggctaatttttgtatttttggtagagacagggtttcaccatgttggcaaggctggtttccaactcctgacctcaagtgatccgcctgcctcagcctccaaaagtgctgggattacaggtgtgagccaccgcgcccagcctgctcttatttcttgaatactctgttgaatataatgcagaagattgtctcattttatcttgtaggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtggtaagttttagaagtcctctaaaacagtatggataaaaagtgtgttatatcttttgcacaatcaatacaaataataaaaaatgatcattctgggtttaagatcttctgaaagaagggactatattgatgtataactttctttgatagatcctttttaaagaagtaaacttggaaattctttttattgaacacatgtgccagatgctttatccttgtttagagtacactgagagttagaacagttagttgtagaaccaacattggaattgtcttagttcattttttgtttggtattttctggtattctgttgcttataacagaataccagagactgggtaatttataaagaaaaggaatttatttcttagagttctggaggcagggaagtggaaggtcaaggggccaagtctgatgagtgccttcttgtttgtggggactttctgcaaagtcccaagacagcacagggcatcacatggttagggagttgagcatgctagctcaggtctctcttcctctttgtatacatccacgagtcccactcccatgataatccattaatcggtcaatagatcaatcaattcatgaaggcagaaccctcatgacccaattatctctttaaaggtccaacctctccatactgccacattggggatgaagtttcaacatgagtttgggagaagataaacattcaaatcatagcaggaacccaggccatctgactctaaggtctagtctcttgatacttaaagaggatgatactcataatgatcatatgtagttcctaaataatctgtctcttagaaaaggcatagacttaaggtagtgtaatcgggtgatattcaaaatatttaacattctgtatggcatgggcactgatcagttagaaaaaccagtatagccttaactgtgggtgccagctgcatgtcagcctgttagaaagcaccctcagcttgaacacagattatctgattaggttctaactccttcactttgggcaaggcatataaacccccttcaaatatttccttatctgtgaaatggaatatataatctccctctatctaaaaaaattgtcataaggtccaaatgacataaagcgtattaacacattgtgtaaattactaaagcaaattccattagcgtaatggtttatttgttgaaatatcccaactgggagctcagattctggcttagatagtcatagaagtgaattctaatagggtaccaaagtcagcttactttgtaggccaagggagtgaggttggagtattttgcctagtggggtaagctgaagcagagcccttctctttgtttggcagattatcttagatgatcttttaagtcttattttgctgttttcctctctggatattaatggtgacataaaggaagaaggaagatccttctcagatagaagatgatatcttcaagttgttttctgttaattacccattatcttctattgcttggtcttaagtatagctgactcctgaaaaagtaaattgaccaggctaatgcatttttaaaaataaattatttttttctttttctgagacagggtctctgttgcccaggctggaatgcagtggcgtgatcacagctcactgcagccttgacctcccgggctcaagctatcctcccatctcagcctccctagtacctgggaccacaggcatgtgccaccacgccaggctaatttttgtattttttgtagagacggggttttgccatgtttcgcaggctggtctcaatctcctgagctcaagcgatctacccaccttggctcccaaagtattttactcttaattgtggttataaacacacaacattaaaattaccatcataaacattttaagtgtacagttcggtagtgttaagtatattcacattgttatgcagcagctctttagaactttttcatcttgcaaaaccgaactctgttcattaaacattaatttcccctcccctccgcccttagcaaccacctttctactttctgtttctatgaatttgactacttaagatacctcataggagtggattcatacaatatttgtcttttgtgactggcttattttacctagcataatttccttgaagtgcatttatgttgcagtgtgtgtcagagactaagccaatgttttaatggtggtctttgattggcattaataagtgacaactagggaagccccttgtatctggtgccttattactcatcaggtggaagtacatctggatccaagcctttctttattctctatgttgcgtctagatgtcctgattataccctggccattttctaaccagatgcaggtcagagttcatatcatctgctagataccccaaatatgttccttaaattcattttactaggcagttttaaataaacttcttctataattgtggctaaatagaaattctaaaactatgtatctgatcatgaaaggccactaaatgcatcagctctgttttgatttaactttatgaaccctgcatatatctgcagttgtctctcagtatttgtgagggattgcttccaggaacttccaaggataccaaaatccatggatgctcaagtccctgataaaaagtagcatagtacttgcatataacctatgcatattttctcacatactttaaatcatgtctacattacttataatacctaatacaatgtaaatgctatgtaaatagttgttatattatctagggaataaatgagaagaaaaaactctgtacatgttcagcacagatgctattttttaaaaaatattttcagttcatggttggttgaattcatgaatgtggaatccatggatatggagggccgactgtgtgtttgtgtgtataatcaagctttggaagcttacttgtgttctatttttgtttttcagtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggcct
